United States Patent 11,427,838 (MATERIALS AND METHODS FOR TREATMENT OF MYOTONIC DYSTROPHY TYPE 1 (DM1) AND OTHER RELATED DISORDERS) - sequence listing, part 2

SEQ ID NO: 7374 - DNA, 20 bp, Artificial Sequence
  Description of Artificial Sequence: Synthetic oligonucleotide
  Target: DMPK; (-) strand; PAM type: NRG; PAM sequence: TGG
ctccgcccgcttcggcggtt

SEQ ID NO: 7375 - DNA, 20 bp, Artificial Sequence
  Description of Artificial Sequence: Synthetic oligonucleotide
  Target: DMPK; (-) strand; PAM type: NRG; PAM sequence: CGG
gccggctccgcccgcttcgg

SEQ ID NO: 7376 - DNA, 20 bp, Artificial Sequence
  Description of Artificial Sequence: Synthetic oligonucleotide
  Target: DMPK; (-) strand; PAM type: NRG; PAM sequence: CGG
ccagccggctccgcccgctt

SEQ ID NO: 7377 - DNA, 20 bp, Artificial Sequence
  Description of Artificial Sequence: Synthetic oligonucleotide
  Target: DMPK; (-) strand; PAM type: NRG; PAM sequence: CGG
gctgctctcggagccccagc

SEQ ID NO: 7378 - DNA, 20 bp, Artificial Sequence
  Description of Artificial Sequence: Synthetic oligonucleotide
  Target: DMPK; (-) strand; PAM type: NRG; PAM sequence: CAG
ttgcgctgctctcggagccc

SEQ ID NO: 7379 - DNA, 20 bp, Artificial Sequence
  Description of Artificial Sequence: Synthetic oligonucleotide
  Target: DMPK; (-) strand; PAM type: NRG; PAM sequence: GAG
cctcacttgcgctgctctcg

SEQ ID NO: 7380 - DNA, 20 bp, Artificial Sequence
  Description of Artificial Sequence: Synthetic oligonucleotide
  Target: DMPK; (-) strand; PAM type: NRG; PAM sequence: CGG
ctcctcacttgcgctgctct

SEQ ID NO: 7381 - DNA, 20 bp, Artificial Sequence
  Description of Artificial Sequence: Synthetic oligonucleotide
  Target: DMPK; (-) strand; PAM type: NRG; PAM sequence: GGG
ttgccaaacccgctttttcg

SEQ ID NO: 7382 - DNA, 20 bp, Artificial Sequence
  Description of Artificial Sequence: Synthetic oligonucleotide
  Target: DMPK; (-) strand; PAM type: NRG; PAM sequence: GGG
tttgccaaacccgctttttc

SEQ ID NO: 7383 - DNA, 20 bp, Artificial Sequence
  Description of Artificial Sequence: Synthetic oligonucleotide
  Target: DMPK; (-) strand; PAM type: NRG; PAM sequence: CGG
ttttgccaaacccgcttttt

SEQ ID NO: 7384 - DNA, 20 bp, Artificial Sequence
  Description of Artificial Sequence: Synthetic oligonucleotide
  Target: DMPK; (-) strand; PAM type: NRG; PAM sequence: GGG
cgatctctgcctgcttactc

SEQ ID NO: 7385 - DNA, 20 bp, Artificial Sequence
  Description of Artificial Sequence: Synthetic oligonucleotide
  Target: DMPK; (-) strand; PAM type: NRG; PAM sequence: CGG
gcgatctctgcctgcttact

SEQ ID NO: 7386 - DNA, 20 bp, Artificial Sequence
  Description of Artificial Sequence: Synthetic oligonucleotide
  Target: DMPK; (-) strand; PAM type: NRG; PAM sequence: TGG
gccctgctctggggagcgtc

SEQ ID NO: 7387 - DNA, 20 bp, Artificial Sequence
  Description of Artificial Sequence: Synthetic oligonucleotide
  Target: DMPK; (-) strand; PAM type: NRG; PAM sequence: GAG
gcatgacgccctgctctggg

SEQ ID NO: 7388 - DNA, 20 bp, Artificial Sequence
  Description of Artificial Sequence: Synthetic oligonucleotide
  Target: DMPK; (-) strand; PAM type: NRG; PAM sequence: GGG
gtgcatgacgccctgctctg

SEQ ID NO: 7389 - DNA, 20 bp, Artificial Sequence
  Description of Artificial Sequence: Synthetic oligonucleotide
  Target: DMPK; (-) strand; PAM type: NRG; PAM sequence: GGG
tgtgcatgacgccctgctct

SEQ ID NO: 7390 - DNA, 20 bp, Artificial Sequence
  Description of Artificial Sequence: Synthetic oligonucleotide
  Target: DMPK; (-) strand; PAM type: NRG; PAM sequence: TGG
ttgtgcatgacgccctgctc

SEQ ID NO: 7391 - DNA, 20 bp, Artificial Sequence
  Description of Artificial Sequence: Synthetic oligonucleotide
  Target: DMPK; (-) strand; PAM type: NRG; PAM sequence: AAG
tcgttggttcgcaaagtgca

SEQ ID NO: 7392 - DNA, 20 bp, Artificial Sequence
  Description of Artificial Sequence: Synthetic oligonucleotide
  Target: DMPK; (-) strand; PAM type: NRG; PAM sequence: AAG
ccacctatcgttggttcgca

SEQ ID NO: 7393 - DNA, 20 bp, Artificial Sequence
  Description of Artificial Sequence: Synthetic oligonucleotide
  Target: DMPK; (-) strand; PAM type: NRG; PAM sequence: TGG
cacgcacccccacctatcgt

SEQ ID NO: 7394 - DNA, 20 bp, Artificial Sequence
  Description of Artificial Sequence: Synthetic oligonucleotide
  Target: DMPK; (-) strand; PAM type: NRG; PAM sequence: GGG
gcctgggaaggcagcaagcc

SEQ ID NO: 7395 - DNA, 20 bp, Artificial Sequence
  Description of Artificial Sequence: Synthetic oligonucleotide
  Target: DMPK; (-) strand; PAM type: NRG; PAM sequence: CGG
ggcctgggaaggcagcaagc

SEQ ID NO: 7396 - DNA, 20 bp, Artificial Sequence
  Description of Artificial Sequence: Synthetic oligonucleotide
  Target: DMPK; (-) strand; PAM type: NRG; PAM sequence: AAG
tgcaggcctgggaaggcagc

SEQ ID NO: 7397 - DNA, 20 bp, Artificial Sequence
  Description of Artificial Sequence: Synthetic oligonucleotide
  Target: DMPK; (-) strand; PAM type: NRG; PAM sequence: CAG
aaactgcaggcctgggaagg

SEQ ID NO: 7398 - DNA, 20 bp, Artificial Sequence
  Description of Artificial Sequence: Synthetic oligonucleotide
  Target: DMPK; (-) strand; PAM type: NRG; PAM sequence: AGG
ggcaaactgcaggcctggga

SEQ ID NO: 7399 - DNA, 20 bp, Artificial Sequence
  Description of Artificial Sequence: Synthetic oligonucleotide
  Target: DMPK; (-) strand; PAM type: NRG; PAM sequence: AAG
gggcaaactgcaggcctggg

SEQ ID NO: 7400 - DNA, 20 bp, Artificial Sequence
  Description of Artificial Sequence: Synthetic oligonucleotide
  Target: DMPK; (-) strand; PAM type: NRG; PAM sequence: GGG
gatgggcaaactgcaggcct

SEQ ID NO: 7401 - DNA, 20 bp, Artificial Sequence
  Description of Artificial Sequence: Synthetic oligonucleotide
  Target: DMPK; (-) strand; PAM type: NRG; PAM sequence: TGG
ggatgggcaaactgcaggcc

SEQ ID NO: 7402 - DNA, 20 bp, Artificial Sequence
  Description of Artificial Sequence: Synthetic oligonucleotide
  Target: DMPK; (-) strand; PAM type: NRG; PAM sequence: AGG
gacgtggatgggcaaactgc

SEQ ID NO: 7403 - DNA, 20 bp, Artificial Sequence
  Description of Artificial Sequence: Synthetic oligonucleotide
  Target: DMPK; (-) strand; PAM type: NRG; PAM sequence: CAG
tgacgtggatgggcaaactg

SEQ ID NO: 7404 - DNA, 20 bp, Artificial Sequence
  Description of Artificial Sequence: Synthetic oligonucleotide
  Target: DMPK; (-) strand; PAM type: NRG; PAM sequence: GGG
gctgaggccctgacgtggat

SEQ ID NO: 7405 - DNA, 20 bp, Artificial Sequence
  Description of Artificial Sequence: Synthetic oligonucleotide
  Target: DMPK; (-) strand; PAM type: NRG; PAM sequence: TGG
ggctgaggccctgacgtgga

SEQ ID NO: 7406 - DNA, 20 bp, Artificial Sequence
  Description of Artificial Sequence: Synthetic oligonucleotide
  Target: DMPK; (-) strand; PAM type: NRG; PAM sequence: TGG
gccaggctgaggccctgacg

SEQ ID NO: 7407 - DNA, 20 bp, Artificial Sequence
  Description of Artificial Sequence: Synthetic oligonucleotide
  Target: DMPK; (-) strand; PAM type: NRG; PAM sequence: AGG
tctttctttcggccaggctg

SEQ ID NO: 7408 - DNA, 20 bp, Artificial Sequence
  Description of Artificial Sequence: Synthetic oligonucleotide
  Target: DMPK; (-) strand; PAM type: NRG; PAM sequence: GAG
ttctttctttcggccaggct

SEQ ID NO: 7409 - DNA, 20 bp, Artificial Sequence
  Description of Artificial Sequence: Synthetic oligonucleotide
  Target: DMPK; (-) strand; PAM type: NRG; PAM sequence: AGG
accatttctttctttcggcc

SEQ ID NO: 7410 - DNA, 20 bp, Artificial Sequence
  Description of Artificial Sequence: Synthetic oligonucleotide
  Target: DMPK; (-) strand; PAM type: NRG; PAM sequence: CAG
gaccatttctttctttcggc

SEQ ID NO: 7411 - DNA, 20 bp, Artificial Sequence
  Description of Artificial Sequence: Synthetic oligonucleotide
  Target: DMPK; (-) strand; PAM type: NRG; PAM sequence: CGG
cacagaccatttctttcttt

SEQ ID NO: 7412 - DNA, 20 bp, Artificial Sequence
  Description of Artificial Sequence: Synthetic oligonucleotide
  Target: DMPK; (-) strand; PAM type: NRG; PAM sequence: CAG
tgctgctgctggggggatca

SEQ ID NO: 7413 - DNA, 20 bp, Artificial Sequence
  Description of Artificial Sequence: Synthetic oligonucleotide
  Target: DMPK; (-) strand; PAM type: NRG; PAM sequence: GGG
ctgctgctgctgctgctggg

SEQ ID NO: 7414 - DNA, 20 bp, Artificial Sequence
  Description of Artificial Sequence: Synthetic oligonucleotide
  Target: DMPK; (-) strand; PAM type: NRG; PAM sequence: GGG
gctgctgctgctgctgctgg

SEQ ID NO: 7415 - DNA, 20 bp, Artificial Sequence
  Description of Artificial Sequence: Synthetic oligonucleotide
  Target: DMPK; (-) strand; PAM type: NRG; PAM sequence: GGG
tgctgctgctgctgctgctg

SEQ ID NO: 7416 - DNA, 20 bp, Artificial Sequence
  Description of Artificial Sequence: Synthetic oligonucleotide
  Target: DMPK; (-) strand; PAM type: NRG; PAM sequence: GGG
ctgctgctgctgctgctgct

SEQ ID NO: 7417 - DNA, 20 bp, Artificial Sequence
  Description of Artificial Sequence: Synthetic oligonucleotide
  Target: DMPK; (-) strand; PAM type: NRG; PAM sequence: TGG
gctgctgctgctgctgctgc

SEQ ID NO: 7418 - DNA, 20 bp, Artificial Sequence
  Description of Artificial Sequence: Synthetic oligonucleotide
  Target: DMPK; (-) strand; PAM type: NRG; PAM sequence: GGG
ctcgaagggtccttgtagcc

SEQ ID NO: 7419 - DNA, 20 bp, Artificial Sequence
  Description of Artificial Sequence: Synthetic oligonucleotide
  Target: DMPK; (-) strand; PAM type: NRG; PAM sequence: CGG
gctcgaagggtccttgtagc

SEQ ID NO: 7420 - DNA, 20 bp, Artificial Sequence
  Description of Artificial Sequence: Synthetic oligonucleotide
  Target: DMPK; (-) strand; PAM type: NRG; PAM sequence: TAG
cggggctcgaagggtccttg

SEQ ID NO: 7421 - DNA, 20 bp, Artificial Sequence
  Description of Artificial Sequence: Synthetic oligonucleotide
  Target: DMPK; (-) strand; PAM type: NRG; PAM sequence: GGG
gccggcgaacggggctcgaa

SEQ ID NO: 7422 - DNA, 20 bp, Artificial Sequence
  Description of Artificial Sequence: Synthetic oligonucleotide
  Target: DMPK; (-) strand; PAM type: NRG; PAM sequence: AGG
ggccggcgaacggggctcga

SEQ ID NO: 7423 - DNA, 20 bp, Artificial Sequence
  Description of Artificial Sequence: Synthetic oligonucleotide
  Target: DMPK; (-) strand; PAM type: NRG; PAM sequence: AAG
cggccggcgaacggggctcg

SEQ ID NO: 7424 - DNA, 20 bp, Artificial Sequence
  Description of Artificial Sequence: Synthetic oligonucleotide
  Target: DMPK; (-) strand; PAM type: NRG; PAM sequence: GGG
gggtccgcggccggcgaacg

SEQ ID NO: 7425 - DNA, 20 bp, Artificial Sequence
  Description of Artificial Sequence: Synthetic oligonucleotide
  Target: DMPK; (-) strand; PAM type: NRG; PAM sequence: GGG
cgggtccgcggccggcgaac

SEQ ID NO: 7426 - DNA, 20 bp, Artificial Sequence
  Description of Artificial Sequence: Synthetic oligonucleotide
  Target: DMPK; (-) strand; PAM type: NRG; PAM sequence: CGG
ccgggtccgcggccggcgaa

SEQ ID NO: 7427 - DNA, 20 bp, Artificial Sequence
  Description of Artificial Sequence: Synthetic oligonucleotide
  Target: DMPK; (-) strand; PAM type: NRG; PAM sequence: CGG
ggaggggccgggtccgcggc

SEQ ID NO: 7428 - DNA, 20 bp, Artificial Sequence
  Description of Artificial Sequence: Synthetic oligonucleotide
  Target: DMPK; (-) strand; PAM type: NRG; PAM sequence: CGG
ggagggaggggccgggtccg

SEQ ID NO: 7429 - DNA, 20 bp, Artificial Sequence
  Description of Artificial Sequence: Synthetic oligonucleotide
  Target: DMPK; (-) strand; PAM type: NRG; PAM sequence: GGG
cggccggggagggaggggcc

SEQ ID NO: 7430 - DNA, 20 bp, Artificial Sequence
  Description of Artificial Sequence: Synthetic oligonucleotide
  Target: DMPK; (-) strand; PAM type: NRG; PAM sequence: CGG
gcggccggggagggaggggc

SEQ ID NO: 7431 - DNA, 20 bp, Artificial Sequence
  Description of Artificial Sequence: Synthetic oligonucleotide
  Target: DMPK; (-) strand; PAM type: NRG; PAM sequence: GGG
cctagcggccggggagggag

SEQ ID NO: 7432 - DNA, 20 bp, Artificial Sequence
  Description of Artificial Sequence: Synthetic oligonucleotide
  Target: DMPK; (-) strand; PAM type: NRG; PAM sequence: GGG
ccctagcggccggggaggga

SEQ ID NO: 7433 - DNA, 20 bp, Artificial Sequence
  Description of Artificial Sequence: Synthetic oligonucleotide
  Target: DMPK; (-) strand; PAM type: NRG; PAM sequence: AGG
cccctagcggccggggaggg

SEQ ID NO: 7434 - DNA, 20 bp, Artificial Sequence
  Description of Artificial Sequence: Synthetic oligonucleotide
  Target: DMPK; (-) strand; PAM type: NRG; PAM sequence: GAG
ccccctagcggccggggagg

SEQ ID NO: 7435 - DNA, 20 bp, Artificial Sequence
  Description of Artificial Sequence: Synthetic oligonucleotide
  Target: DMPK; (-) strand; PAM type: NRG; PAM sequence: GGG
cgccccctagcggccgggga

SEQ ID NO: 7436 - DNA, 20 bp, Artificial Sequence
  Description of Artificial Sequence: Synthetic oligonucleotide
  Target: DMPK; (-) strand; PAM type: NRG; PAM sequence: AGG
ccgccccctagcggccgggg

SEQ ID NO: 7437 - DNA, 20 bp, Artificial Sequence
  Description of Artificial Sequence: Synthetic oligonucleotide
  Target: DMPK; (-) strand; PAM type: NRG; PAM sequence: GAG
cccgccccctagcggccggg

SEQ ID NO: 7438 - DNA, 20 bp, Artificial Sequence
  Description of Artificial Sequence: Synthetic oligonucleotide
  Target: DMPK; (-) strand; PAM type: NRG; PAM sequence: GGG
ggcccgccccctagcggccg

SEQ ID NO: 7439 - DNA, 20 bp, Artificial Sequence
  Description of Artificial Sequence: Synthetic oligonucleotide
  Target: DMPK; (-) strand; PAM type: NRG; PAM sequence: GGG
gggcccgccccctagcggcc

SEQ ID NO: 7440 - DNA, 20 bp, Artificial Sequence
  Description of Artificial Sequence: Synthetic oligonucleotide
  Target: DMPK; (-) strand; PAM type: NRG; PAM sequence: CGG
cgggcccgccccctagcggc

SEQ ID NO: 7441 - DNA, 20 bp, Artificial Sequence
  Description of Artificial Sequence: Synthetic oligonucleotide
  Target: DMPK; (-) strand; PAM type: NRG; PAM sequence: CGG
gatccgggcccgccccctag

SEQ ID NO: 7442 - DNA, 20 bp, Artificial Sequence
  Description of Artificial Sequence: Synthetic oligonucleotide
  Target: DMPK; (-) strand; PAM type: NRG; PAM sequence: TAG
tgtgatccgggcccgccccc

SEQ ID NO: 7443 - DNA, 20 bp, Artificial Sequence
  Description of Artificial Sequence: Synthetic oligonucleotide
  Target: DMPK; (-) strand; PAM type: NRG; PAM sequence: GGG
cagctccagtcctgtgatcc

SEQ ID NO: 7444 - DNA, 20 bp, Artificial Sequence
  Description of Artificial Sequence: Synthetic oligonucleotide
  Target: DMPK; (-) strand; PAM type: NRG; PAM sequence: CGG
ccagctccagtcctgtgatc

SEQ ID NO: 7445 - DNA, 20 bp, Artificial Sequence
  Description of Artificial Sequence: Synthetic oligonucleotide
  Target: DMPK; (-) strand; PAM type: NRG; PAM sequence: CAG
cgtgggtctccgcccagctc

SEQ ID NO: 7446 - DNA, 20 bp, Artificial Sequence
  Description of Artificial Sequence: Synthetic oligonucleotide
  Target: DMPK; (-) strand; PAM type: NRG; PAM sequence: CAG
tccgagcgtgggtctccgcc

SEQ ID NO: 7447 - DNA, 20 bp, Artificial Sequence
  Description of Artificial Sequence: Synthetic oligonucleotide
  Target: DMPK; (-) strand; PAM type: NRG; PAM sequence: GGG
ttcacaaccgctccgagcgt

SEQ ID NO: 7448 - DNA, 20 bp, Artificial Sequence
  Description of Artificial Sequence: Synthetic oligonucleotide
  Target: DMPK; (-) strand; PAM type: NRG; PAM sequence: TGG
gttcacaaccgctccgagcg

SEQ ID NO: 7449 - DNA, 20 bp, Artificial Sequence
  Description of Artificial Sequence: Synthetic oligonucleotide
  Target: DMPK; (-) strand; PAM type: NRG; PAM sequence: GAG
tgccagttcacaaccgctcc

SEQ ID NO: 7450 - DNA, 20 bp, Artificial Sequence
  Description of Artificial Sequence: Synthetic oligonucleotide
  Target: DMPK; (-) strand; PAM type: NRG; PAM sequence: CAG
aagccgcgcccaccgcctgc

SEQ ID NO: 7451 - DNA, 20 bp, Artificial Sequence
  Description of Artificial Sequence: Synthetic oligonucleotide
  Target: DMPK; (-) strand; PAM type: NRG; PAM sequence: AAG
gtgcccggggcacggcacag

SEQ ID NO: 7452 - DNA, 20 bp, Artificial Sequence
  Description of Artificial Sequence: Synthetic oligonucleotide
  Target: DMPK; (-) strand; PAM type: NRG; PAM sequence: CAG
tgagtgcccggggcacggca

SEQ ID NO: 7453 - DNA, 20 bp, Artificial Sequence
  Description of Artificial Sequence: Synthetic oligonucleotide
  Target: DMPK; (-) strand; PAM type: NRG; PAM sequence: CGG
aagactgagtgcccggggca

SEQ ID NO: 7454 - DNA, 20 bp, Artificial Sequence
  Description of Artificial Sequence: Synthetic oligonucleotide
  Target: DMPK; (-) strand; PAM type: NRG; PAM sequence: GGG
gttggaagactgagtgcccg

SEQ ID NO: 7455 - DNA, 20 bp, Artificial Sequence
  Description of Artificial Sequence: Synthetic oligonucleotide
  Target: DMPK; (-) strand; PAM type: NRG; PAM sequence: GGG
cgttggaagactgagtgccc

SEQ ID NO: 7456 - DNA, 20 bp, Artificial Sequence
  Description of Artificial Sequence: Synthetic oligonucleotide
  Target: DMPK; (-) strand; PAM type: NRG; PAM sequence: CGG
ccgttggaagactgagtgcc

SEQ ID NO: 7457 - DNA, 20 bp, Artificial Sequence
  Description of Artificial Sequence: Synthetic oligonucleotide
  Target: DMPK; (-) strand; PAM type: NRG; PAM sequence: GAG
cggggccccgttggaagact

SEQ ID NO: 7458 - DNA, 20 bp, Artificial Sequence
  Description of Artificial Sequence: Synthetic oligonucleotide
  Target: DMPK; (-) strand; PAM type: NRG; PAM sequence: AAG
cgactccggggccccgttgg

SEQ ID NO: 7459 - DNA, 20 bp, Artificial Sequence
  Description of Artificial Sequence: Synthetic oligonucleotide
  Target: DMPK; (-) strand; PAM type: NRG; PAM sequence: TGG
cttcgactccggggccccgt

SEQ ID NO: 7460 - DNA, 20 bp, Artificial Sequence
  Description of Artificial Sequence: Synthetic oligonucleotide
  Target: DMPK; (-) strand; PAM type: NRG; PAM sequence: GGG
tagaactgtcttcgactccg

SEQ ID NO: 7461 - DNA, 20 bp, Artificial Sequence
  Description of Artificial Sequence: Synthetic oligonucleotide
  Target: DMPK; (-) strand; PAM type: NRG; PAM sequence: GGG
ctagaactgtcttcgactcc

SEQ ID NO: 7462 - DNA, 20 bp, Artificial Sequence
  Description of Artificial Sequence: Synthetic oligonucleotide
  Target: DMPK; (-) strand; PAM type: NRG; PAM sequence: CGG
cctagaactgtcttcgactc

SEQ ID NO: 7463 - DNA, 20 bp, Artificial Sequence
  Description of Artificial Sequence: Synthetic oligonucleotide
  Target: DMPK; (-) strand; PAM type: NRG; PAM sequence: TAG
cgcccgcgctccctgaaccc

SEQ ID NO: 7464 - DNA, 20 bp, Artificial Sequence
  Description of Artificial Sequence: Synthetic oligonucleotide
  Target: DMPK; (-) strand; PAM type: NRG; PAM sequence: GAG
cgcagtctggcgccgcccag

SEQ ID NO: 7465 - DNA, 20 bp, Artificial Sequence
  Description of Artificial Sequence: Synthetic oligonucleotide
  Target: DMPK; (-) strand; PAM type: NRG; PAM sequence: AGG
accgcagtctggcgccgccc

SEQ ID NO: 7466 - DNA, 20 bp, Artificial Sequence
  Description of Artificial Sequence: Synthetic oligonucleotide
  Target: DMPK; (-) strand; PAM type: NRG; PAM sequence: CAG
caccgcagtctggcgccgcc

SEQ ID NO: 7467 - DNA, 20 bp, Artificial Sequence
  Description of Artificial Sequence: Synthetic oligonucleotide
  Target: DMPK; (-) strand; PAM type: NRG; PAM sequence: TGG
ccggccaactcaccgcagtc

SEQ ID NO: 7468 - DNA, 20 bp, Artificial Sequence
  Description of Artificial Sequence: Synthetic oligonucleotide
  Target: DMPK; (-) strand; PAM type: NRG; PAM sequence: CAG
ccacgccggccaactcaccg

SEQ ID NO: 7469 - DNA, 20 bp, Artificial Sequence
  Description of Artificial Sequence: Synthetic oligonucleotide
  Target: DMPK; (-) strand; PAM type: NRG; PAM sequence: CGG
attgggttggtggcccacgc

SEQ ID NO: 7470 - DNA, 20 bp, Artificial Sequence
  Description of Artificial Sequence: Synthetic oligonucleotide
  Target: DMPK; (-) strand; PAM type: NRG; PAM sequence: TGG
cctgggctgcattgggttgg

SEQ ID NO: 7471 - DNA, 20 bp, Artificial Sequence
  Description of Artificial Sequence: Synthetic oligonucleotide
  Target: DMPK; (-) strand; PAM type: NRG; PAM sequence: TGG
cgccctgggctgcattgggt

SEQ ID NO: 7472 - DNA, 20 bp, Artificial Sequence
  Description of Artificial Sequence: Synthetic oligonucleotide
  Target: DMPK; (-) strand; PAM type: NRG; PAM sequence: GGG
ccgccgccctgggctgcatt

SEQ ID NO: 7473 - DNA, 20 bp, Artificial Sequence
  Description of Artificial Sequence: Synthetic oligonucleotide
  Target: DMPK; (-) strand; PAM type: NRG; PAM sequence: TGG
gccgccgccctgggctgcat

SEQ ID NO: 7474 - DNA, 20 bp, Artificial Sequence
  Description of Artificial Sequence: Synthetic oligonucleotide
  Target: DMPK; (-) strand; PAM type: NRG; PAM sequence: GGG
ctgtctcgtgccgccgccct

SEQ ID NO: 7475 - DNA, 20 bp, Artificial Sequence
  Description of Artificial Sequence: Synthetic oligonucleotide
  Target: DMPK; (-) strand; PAM type: NRG; PAM sequence: TGG
tctgtctcgtgccgccgccc

SEQ ID NO: 7476 - DNA, 20 bp, Artificial Sequence
  Description of Artificial Sequence: Synthetic oligonucleotide
  Target: DMPK; (-) strand; PAM type: NRG; PAM sequence: AGG
ccctaggcctggcctatcgg

SEQ ID NO: 7477 - DNA, 20 bp, Artificial Sequence
  Description of Artificial Sequence: Synthetic oligonucleotide
  Target: DMPK; (-) strand; PAM type: NRG; PAM sequence: GAG
tccctaggcctggcctatcg

SEQ ID NO: 7478 - DNA, 20 bp, Artificial Sequence
  Description of Artificial Sequence: Synthetic oligonucleotide
  Target: DMPK; (-) strand; PAM type: NRG; PAM sequence: CGG
ggtccctaggcctggcctat

SEQ ID NO: 7479 - DNA, 20 bp, Artificial Sequence
  Description of Artificial Sequence: Synthetic oligonucleotide
  Target: DMPK; (-) strand; PAM type: NRG; PAM sequence: TGG
tccccgcaggtccctaggcc

SEQ ID NO: 7480 - DNA, 20 bp, Artificial Sequence
  Description of Artificial Sequence: Synthetic oligonucleotide
  Target: DMPK; (-) strand; PAM type: NRG; PAM sequence: AGG
ccctctccccgcaggtccct

SEQ ID NO: 7481 - DNA, 20 bp, Artificial Sequence
  Description of Artificial Sequence: Synthetic oligonucleotide
  Target: DMPK; (-) strand; PAM type: NRG; PAM sequence: TAG
gccctctccccgcaggtccc

SEQ ID NO: 7482 - DNA, 20 bp, Artificial Sequence
  Description of Artificial Sequence: Synthetic oligonucleotide
  Target: DMPK; (-) strand; PAM type: NRG; PAM sequence: AGG
tgacctcgccctctccccgc

SEQ ID NO: 7483 - DNA, 20 bp, Artificial Sequence
  Description of Artificial Sequence: Synthetic oligonucleotide
  Target: DMPK; (-) strand; PAM type: NRG; PAM sequence: CAG
ttgacctcgccctctccccg

SEQ ID NO: 7484 - DNA, 20 bp, Artificial Sequence
  Description of Artificial Sequence: Synthetic oligonucleotide
  Target: DMPK; (-) strand; PAM type: NRG; PAM sequence: GGG
gccaatcagaggcccatgcc

SEQ ID NO: 7485 - DNA, 20 bp, Artificial Sequence
  Description of Artificial Sequence: Synthetic oligonucleotide
  Target: DMPK; (-) strand; PAM type: NRG; PAM sequence: CGG
agccaatcagaggcccatgc

SEQ ID NO: 7486 - DNA, 20 bp, Artificial Sequence
  Description of Artificial Sequence: Synthetic oligonucleotide
  Target: DMPK; (-) strand; PAM type: NRG; PAM sequence: AGG
gagtcccaggagccaatcag

SEQ ID NO: 7487 - DNA, 20 bp, Artificial Sequence
  Description of Artificial Sequence: Synthetic oligonucleotide
  Target: DMPK; (-) strand; PAM type: NRG; PAM sequence: GAG
cgagtcccaggagccaatca

SEQ ID NO: 7488 - DNA, 20 bp, Artificial Sequence
  Description of Artificial Sequence: Synthetic oligonucleotide
  Target: DMPK; (-) strand; PAM type: NRG; PAM sequence: CAG
ggcgagtcccaggagccaat

SEQ ID NO: 7489 - DNA, 20 bp, Artificial Sequence
  Description of Artificial Sequence: Synthetic oligonucleotide
  Target: DMPK; (-) strand; PAM type: NRG; PAM sequence: GAG
gtaggcggggcgagtcccag

SEQ ID NO: 7490 - DNA, 20 bp, Artificial Sequence
  Description of Artificial Sequence: Synthetic oligonucleotide
  Target: DMPK; (-) strand; PAM type: NRG; PAM sequence: AGG
gcgtaggcggggcgagtccc

SEQ ID NO: 7491 - DNA, 20 bp, Artificial Sequence
  Description of Artificial Sequence: Synthetic oligonucleotide
  Target: DMPK; (-) strand; PAM type: NRG; PAM sequence: CAG
ggcgtaggcggggcgagtcc

SEQ ID NO: 7492 - DNA, 20 bp, Artificial Sequence
  Description of Artificial Sequence: Synthetic oligonucleotide
  Target: DMPK; (-) strand; PAM type: NRG; PAM sequence: GAG
cctatgggcgtaggcggggc

SEQ ID NO: 7493 - DNA, 20 bp, Artificial Sequence
  Description of Artificial Sequence: Synthetic oligonucleotide
  Target: DMPK; (-) strand; PAM type: NRG; PAM sequence: GGG
cccacctatgggcgtaggcg

SEQ ID NO: 7494 - DNA, 20 bp, Artificial Sequence
  Description of Artificial Sequence: Synthetic oligonucleotide
  Target: DMPK; (-) strand; PAM type: NRG; PAM sequence: GGG
gcccacctatgggcgtaggc

SEQ ID NO: 7495 - DNA, 20 bp, Artificial Sequence
  Description of Artificial Sequence: Synthetic oligonucleotide
  Target: DMPK; (-) strand; PAM type: NRG; PAM sequence: CGG
ggcccacctatgggcgtagg

SEQ ID NO: 7496 - DNA, 20 bp, Artificial Sequence
  Description of Artificial Sequence: Synthetic oligonucleotide
  Target: DMPK; (-) strand; PAM type: NRG; PAM sequence: AGG
gcgggcccacctatgggcgt

SEQ ID NO: 7497 - DNA, 20 bp, Artificial Sequence
  Description of Artificial Sequence: Synthetic oligonucleotide
  Target: DMPK; (-) strand; PAM type: NRG; PAM sequence: TAG
tgcgggcccacctatgggcg

SEQ ID NO: 7498 - DNA, 20 bp, Artificial Sequence
  Description of Artificial Sequence: Synthetic oligonucleotide
  Target: DMPK; (-) strand; PAM type: NRG; PAM sequence: GGG
aagagtgcgggcccacctat

SEQ ID NO: 7499 - DNA, 20 bp, Artificial Sequence
  Description of Artificial Sequence: Synthetic oligonucleotide
  Target: DMPK; (-) strand; PAM type: NRG; PAM sequence: TGG
gaagagtgcgggcccaccta

SEQ ID NO: 7500 - DNA, 20 bp, Artificial Sequence
  Description of Artificial Sequence: Synthetic oligonucleotide
  Target: DMPK; (-) strand; PAM type: NRG; PAM sequence: GGG
cggggcgcagggaagagtgc

SEQ ID NO: 7501 - DNA, 20 bp, Artificial Sequence
  Description of Artificial Sequence: Synthetic oligonucleotide
  Target: DMPK; (-) strand; PAM type: NRG; PAM sequence: CGG
gcggggcgcagggaagagtg

SEQ ID NO: 7502 - DNA, 20 bp, Artificial Sequence
  Description of Artificial Sequence: Synthetic oligonucleotide
  Target: DMPK; (-) strand; PAM type: NRG; PAM sequence: GAG
cgggggcggggcgcagggaa

SEQ ID NO: 7503 - DNA, 20 bp, Artificial Sequence
  Description of Artificial Sequence: Synthetic oligonucleotide
  Target: DMPK; (-) strand; PAM type: NRG; PAM sequence: AAG
ggcgggggcggggcgcaggg

SEQ ID NO: 7504 - DNA, 20 bp, Artificial Sequence
  Description of Artificial Sequence: Synthetic oligonucleotide
  Target: DMPK; (-) strand; PAM type: NRG; PAM sequence: GGG
tggggcgggggcggggcgca

SEQ ID NO: 7505 - DNA, 20 bp, Artificial Sequence
  Description of Artificial Sequence: Synthetic oligonucleotide
  Target: DMPK; (-) strand; PAM type: NRG; PAM sequence: AGG
ttggggcgggggcggggcgc

SEQ ID NO: 7506 - DNA, 20 bp, Artificial Sequence
  Description of Artificial Sequence: Synthetic oligonucleotide
  Target: DMPK; (-) strand; PAM type: NRG; PAM sequence: CAG
gttggggcgggggcggggcg

SEQ ID NO: 7507 - DNA, 20 bp, Artificial Sequence
  Description of Artificial Sequence: Synthetic oligonucleotide
  Target: DMPK; (-) strand; PAM type: NRG; PAM sequence: GGG
aggctgttggggcgggggcg

SEQ ID NO: 7508 - DNA, 20 bp, Artificial Sequence
  Description of Artificial Sequence: Synthetic oligonucleotide
  Target: DMPK; (-) strand; PAM type: NRG; PAM sequence: GGG
taggctgttggggcgggggc

SEQ ID NO: 7509 - DNA, 20 bp, Artificial Sequence
  Description of Artificial Sequence: Synthetic oligonucleotide
  Target: DMPK; (-) strand; PAM type: NRG; PAM sequence: CGG
gtaggctgttggggcggggg

SEQ ID NO: 7510 - DNA, 20 bp, Artificial Sequence
  Description of Artificial Sequence: Synthetic oligonucleotide
  Target: DMPK; (-) strand; PAM type: NRG; PAM sequence: GGG
gctgtaggctgttggggcgg

SEQ ID NO: 7511 - DNA, 20 bp, Artificial Sequence
  Description of Artificial Sequence: Synthetic oligonucleotide
  Target: DMPK; (-) strand; PAM type: NRG; PAM sequence: GGG
agctgtaggctgttggggcg

SEQ ID NO: 7512 - DNA, 20 bp, Artificial Sequence
  Description of Artificial Sequence: Synthetic oligonucleotide
  Target: DMPK; (-) strand; PAM type: NRG; PAM sequence: GGG
cagctgtaggctgttggggc

SEQ ID NO: 7513 - DNA, 20 bp, Artificial Sequence
  Description of Artificial Sequence: Synthetic oligonucleotide
  Target: DMPK; (-) strand; PAM type: NRG; PAM sequence: CGG
acagctgtaggctgttgggg

SEQ ID NO: 7514 - DNA, 20 bp, Artificial Sequence
  Description of Artificial Sequence: Synthetic oligonucleotide
  Target: DMPK; (-) strand; PAM type: NRG; PAM sequence: GGG
acaacagctgtaggctgttg

SEQ ID NO: 7515 - DNA, 20 bp, Artificial Sequence
  Description of Artificial Sequence: Synthetic oligonucleotide
  Target: DMPK; (-) strand; PAM type: NRG; PAM sequence: GGG
aacaacagctgtaggctgtt

SEQ ID NO: 7516 - DNA, 20 bp, Artificial Sequence
  Description of Artificial Sequence: Synthetic oligonucleotide
  Target: DMPK; (-) strand; PAM type: NRG; PAM sequence: TGG
taacaacagctgtaggctgt

SEQ ID NO: 7517 - DNA, 20 bp, Artificial Sequence
  Description of Artificial Sequence: Synthetic oligonucleotide
  Target: DMPK; (-) strand; PAM type: NRG; PAM sequence: AGG
agtggactaacaacagctgt

SEQ ID NO: 7518 - DNA, 20 bp, Artificial Sequence
  Description of Artificial Sequence: Synthetic oligonucleotide
  Target: DMPK; (-) strand; PAM type: NRG; PAM sequence: TAG
gagtggactaacaacagctg

SEQ ID NO: 7519 - DNA, 20 bp, Artificial Sequence
  Description of Artificial Sequence: Synthetic oligonucleotide
  Target: DMPK; (-) strand; PAM type: NRG; PAM sequence: CAG
gcgtgcgagtggactaacaa

SEQ ID NO: 7520 - DNA, 20 bp, Artificial Sequence
  Description of Artificial Sequence: Synthetic oligonucleotide
  Target: DMPK; (-) strand; PAM type: NRG; PAM sequence: TGG
cgggattcgaggcgtgcgag

SEQ ID NO: 7521 - DNA, 20 bp, Artificial Sequence
  Description of Artificial Sequence: Synthetic oligonucleotide
  Target: DMPK; (-) strand; PAM type: NRG; PAM sequence: GAG
ggacgggattcgaggcgtgc

SEQ ID NO: 7522 - DNA, 20 bp, Artificial Sequence
  Description of Artificial Sequence: Synthetic oligonucleotide
  Target: DMPK; (-) strand; PAM type: NRG; PAM sequence: AGG
acgagttcggacgggattcg

SEQ ID NO: 7523 - DNA, 20 bp, Artificial Sequence
  Description of Artificial Sequence: Synthetic oligonucleotide
  Target: DMPK; (-) strand; PAM type: NRG; PAM sequence: GAG
gacgagttcggacgggattc

SEQ ID NO: 7524 - DNA, 20 bp, Artificial Sequence
  Description of Artificial Sequence: Synthetic oligonucleotide
  Target: DMPK; (-) strand; PAM type: NRG; PAM sequence: GGG
agccaatgacgagttcggac

SEQ ID NO: 7525 - DNA, 20 bp, Artificial Sequence
  Description of Artificial Sequence: Synthetic oligonucleotide
  Target: DMPK; (-) strand; PAM type: NRG; PAM sequence: CGG
cagccaatgacgagttcgga

SEQ ID NO: 7526 - DNA, 20 bp, Artificial Sequence
  Description of Artificial Sequence: Synthetic oligonucleotide
  Target: DMPK; (-) strand; PAM type: NRG; PAM sequence: CGG
gaagcagccaatgacgagtt

SEQ ID NO: 7527 - DNA, 20 bp, Artificial Sequence
  Description of Artificial Sequence: Synthetic oligonucleotide
  Target: DMPK; (-) strand; PAM type: NRG; PAM sequence: GAG
gctaggaagcagccaatgac

SEQ ID NO: 7528 - DNA, 20 bp, Artificial Sequence
  Description of Artificial Sequence: Synthetic oligonucleotide
  Target: DMPK; (-) strand; PAM type: NRG; PAM sequence: CAG
caacacaggccgctaggaag

SEQ ID NO: 7529 - DNA, 20 bp, Artificial Sequence
  Description of Artificial Sequence: Synthetic oligonucleotide
  Target: DMPK; (-) strand; PAM type: NRG; PAM sequence: AAG
aatcaacacaggccgctagg

SEQ ID NO: 7530 - DNA, 20 bp, Artificial Sequence
  Description of Artificial Sequence: Synthetic oligonucleotide
  Target: DMPK; (-) strand; PAM type: NRG; PAM sequence: AGG
gccaatcaacacaggccgct

SEQ ID NO: 7531 - DNA, 20 bp, Artificial Sequence
  Description of Artificial Sequence: Synthetic oligonucleotide
  Target: DMPK; (-) strand; PAM type: NRG; PAM sequence: TAG
agccaatcaacacaggccgc

SEQ ID NO: 7532 - DNA, 20 bp, Artificial Sequence
  Description of Artificial Sequence: Synthetic oligonucleotide
  Target: DMPK; (-) strand; PAM type: NRG; PAM sequence: AGG
ttcgggcagccaatcaacac

SEQ ID NO: 7533 - DNA, 20 bp, Artificial Sequence
  Description of Artificial Sequence: Synthetic oligonucleotide
  Target: DMPK; (-) strand; PAM type: NRG; PAM sequence: CAG
cttcgggcagccaatcaaca

SEQ ID NO: 7534 - DNA, 20 bp, Artificial Sequence
  Description of Artificial Sequence: Synthetic oligonucleotide
  Target: DMPK; (-) strand; PAM type: NRG; PAM sequence: CAG
caggagggcggatcttcggg

SEQ ID NO: 7535 - DNA, 20 bp, Artificial Sequence
  Description of Artificial Sequence: Synthetic oligonucleotide
  Target: DMPK; (-) strand; PAM type: NRG; PAM sequence: GGG
cggcaggagggcggatcttc

SEQ ID NO: 7536 - DNA, 20 bp, Artificial Sequence
  Description of Artificial Sequence: Synthetic oligonucleotide
  Target: DMPK; (-) strand; PAM type: NRG; PAM sequence: CGG
acggcaggagggcggatctt

SEQ ID NO: 7537 - DNA, 20 bp, Artificial Sequence
  Description of Artificial Sequence: Synthetic oligonucleotide
  Target: DMPK; (-) strand; PAM type: NRG; PAM sequence: CGG
ctgggcccacggcaggaggg

SEQ ID NO: 7538 - DNA, 20 bp, Artificial Sequence
  Description of Artificial Sequence: Synthetic oligonucleotide
  Target: DMPK; (-) strand; PAM type: NRG; PAM sequence: GGG
gggctgggcccacggcagga

SEQ ID NO: 7539 - DNA, 20 bp, Artificial Sequence
  Description of Artificial Sequence: Synthetic oligonucleotide
  Target: DMPK; (-) strand; PAM type: NRG; PAM sequence: AGG
ggggctgggcccacggcagg

SEQ ID NO: 7540 - DNA, 20 bp, Artificial Sequence
  Description of Artificial Sequence: Synthetic oligonucleotide
  Target: DMPK; (-) strand; PAM type: NRG; PAM sequence: GAG
cggggctgggcccacggcag

SEQ ID NO: 7541 - DNA, 20 bp, Artificial Sequence
  Description of Artificial Sequence: Synthetic oligonucleotide
  Target: DMPK; (-) strand; PAM type: NRG; PAM sequence: AGG
tgcggggctgggcccacggc

SEQ ID NO: 7542 - DNA, 20 bp, Artificial Sequence
  Description of Artificial Sequence: Synthetic oligonucleotide
  Target: DMPK; (-) strand; PAM type: NRG; PAM sequence: CAG
ttgcggggctgggcccacgg

SEQ ID NO: 7543 - DNA, 20 bp, Artificial Sequence
  Description of Artificial Sequence: Synthetic oligonucleotide
  Target: DMPK; (-) strand; PAM type: NRG; PAM sequence: CGG
catttgcggggctgggccca

SEQ ID NO: 7544 - DNA, 20 bp, Artificial Sequence
  Description of Artificial Sequence: Synthetic oligonucleotide
  Target: DMPK; (-) strand; PAM type: NRG; PAM sequence: GGG
agctgcgcatttgcggggct

SEQ ID NO: 7545 - DNA, 20 bp, Artificial Sequence
  Description of Artificial Sequence: Synthetic oligonucleotide
  Target: DMPK; (-) strand; PAM type: NRG; PAM sequence: TGG
tagctgcgcatttgcggggc

SEQ ID NO: 7546 - DNA, 20 bp, Artificial Sequence
  Description of Artificial Sequence: Synthetic oligonucleotide
  Target: DMPK; (-) strand; PAM type: NRG; PAM sequence: GGG
cgcttagctgcgcatttgcg

SEQ ID NO: 7547 - DNA, 20 bp, Artificial Sequence
  Description of Artificial Sequence: Synthetic oligonucleotide
  Target: DMPK; (-) strand; PAM type: NRG; PAM sequence: GGG
ccgcttagctgcgcatttgc

SEQ ID NO: 7548 - DNA, 20 bp, Artificial Sequence
  Description of Artificial Sequence: Synthetic oligonucleotide
  Target: DMPK; (-) strand; PAM type: NRG; PAM sequence: CGG
cccgcttagctgcgcatttg

SEQ ID NO: 7549 - DNA, 20 bp, Artificial Sequence
  Description of Artificial Sequence: Synthetic oligonucleotide
  Target: DMPK; (-) strand; PAM type: NRG; PAM sequence: TAG
cccgccccttgccacccgct

SEQ ID NO: 7550 - DNA, 20 bp, Artificial Sequence
  Description of Artificial Sequence: Synthetic oligonucleotide
  Target: DMPK; (-) strand; PAM type: NRG; PAM sequence: CGG
gctccctgccagggtacgtc

SEQ ID NO: 7551 - DNA, 20 bp, Artificial Sequence
  Description of Artificial Sequence: Synthetic oligonucleotide
  Target: DMPK; (-) strand; PAM type: NRG; PAM sequence: GGG
ccacctgctgctccctgcca

SEQ ID NO: 7552 - DNA, 20 bp, Artificial Sequence
  Description of Artificial Sequence: Synthetic oligonucleotide
  Target: DMPK; (-) strand; PAM type: NRG; PAM sequence: AGG
gccacctgctgctccctgcc

SEQ ID NO: 7553 - DNA, 20 bp, Artificial Sequence
  Description of Artificial Sequence: Synthetic oligonucleotide
  Target: DMPK; (-) strand; PAM type: NRG; PAM sequence: CAG
cgccacctgctgctccctgc

SEQ ID NO: 7554 - DNA, 20 bp, Artificial Sequence
  Description of Artificial Sequence: Synthetic oligonucleotide
  Target: DMPK; (-) strand; PAM type: NRG; PAM sequence: AGG
cagtgcccgctggtggggcc

SEQ ID NO: 7555 - DNA, 20 bp, Artificial Sequence
  Description of Artificial Sequence: Synthetic oligonucleotide
  Target: DMPK; (-) strand; PAM type: NRG; PAM sequence: CAG
ccagtgcccgctggtggggc

SEQ ID NO: 7556 - DNA, 20 bp, Artificial Sequence
  Description of Artificial Sequence: Synthetic oligonucleotide
  Target: DMPK; (-) strand; PAM type: NRG; PAM sequence: GGG
tgggccagtgcccgctggtg

SEQ ID NO: 7557 - DNA, 20 bp, Artificial Sequence
  Description of Artificial Sequence: Synthetic oligonucleotide
  Target: DMPK; (-) strand; PAM type: NRG; PAM sequence: GGG
gtgggccagtgcccgctggt

SEQ ID NO: 7558 - DNA, 20 bp, Artificial Sequence
  Description of Artificial Sequence: Synthetic oligonucleotide
  Target: DMPK; (-) strand; PAM type: NRG; PAM sequence: TGG
tgtgggccagtgcccgctgg

SEQ ID NO: 7559 - DNA, 20 bp, Artificial Sequence
  Description of Artificial Sequence: Synthetic oligonucleotide
  Target: DMPK; (-) strand; PAM type: NRG; PAM sequence: TGG
ggctgtgggccagtgcccgc

SEQ ID NO: 7560 - DNA, 20 bp, Artificial Sequence
  Description of Artificial Sequence: Synthetic oligonucleotide
  Target: DMPK; (-) strand; PAM type: NRG; PAM sequence: CAG
ccccggccgtggctgtgggc

SEQ ID NO: 7561 - DNA, 20 bp, Artificial Sequence
  Description of Artificial Sequence: Synthetic oligonucleotide
  Target: DMPK; (-) strand; PAM type: NRG; PAM sequence: GGG
ggccccccggccgtggctgt

SEQ ID NO: 7562 - DNA, 20 bp, Artificial Sequence
  Description of Artificial Sequence: Synthetic oligonucleotide
  Target: DMPK; (-) strand; PAM type: NRG; PAM sequence: TGG
tggccccccggccgtggctg

SEQ ID NO: 7563 - DNA, 20 bp, Artificial Sequence
  Description of Artificial Sequence: Synthetic oligonucleotide
  Target: DMPK; (-) strand; PAM type: NRG; PAM sequence: TGG
gctagatggccccccggccg

SEQ ID NO: 7564 - DNA, 20 bp, Artificial Sequence
  Description of Artificial Sequence: Synthetic oligonucleotide
  Target: DMPK; (-) strand; PAM type: NRG; PAM sequence: CGG
tctccagctagatggccccc

SEQ ID NO: 7565 - DNA, 20 bp, Artificial Sequence
  Description of Artificial Sequence: Synthetic oligonucleotide
  Target: DMPK; (-) strand; PAM type: NRG; PAM sequence: TGG
cccttctctctccagctaga

SEQ ID NO: 7566 - DNA, 20 bp, Artificial Sequence
  Description of Artificial Sequence: Synthetic oligonucleotide
  Target: DMPK; (-) strand; PAM type: NRG; PAM sequence: TAG
ctgtcccttctctctccagc

SEQ ID NO: 7567 - DNA, 20 bp, Artificial Sequence
  Description of Artificial Sequence: Synthetic oligonucleotide
  Target: DMPK; (-) strand; PAM type: NRG; PAM sequence: CAG
tcacctgtcccttctctctc

SEQ ID NO: 7568 - DNA, 20 bp, Artificial Sequence
  Description of Artificial Sequence: Synthetic oligonucleotide
  Target: DMPK; (-) strand; PAM type: NRG; PAM sequence: GGG
ggctgggctgggctccgatc

SEQ ID NO: 7569 - DNA, 20 bp, Artificial Sequence
  Description of Artificial Sequence: Synthetic oligonucleotide
  Target: DMPK; (-) strand; PAM type: NRG; PAM sequence: CGG
gggctgggctgggctccgat

SEQ ID NO: 7570 - DNA, 20 bp, Artificial Sequence
  Description of Artificial Sequence: Synthetic oligonucleotide
  Target: DMPK; (-) strand; PAM type: NRG; PAM sequence: GGG
ccaccgctgagggctgggct

SEQ ID NO: 7571 - DNA, 20 bp, Artificial Sequence
  Description of Artificial Sequence: Synthetic oligonucleotide
  Target: DMPK; (-) strand; PAM type: NRG; PAM sequence: TGG
cccaccgctgagggctgggc

SEQ ID NO: 7572 - DNA, 20 bp, Artificial Sequence
  Description of Artificial Sequence: Synthetic oligonucleotide
  Target: DMPK; (-) strand; PAM type: NRG; PAM sequence: GGG
tcgccccaccgctgagggct

SEQ ID NO: 7573 - DNA, 20 bp, Artificial Sequence
  Description of Artificial Sequence: Synthetic oligonucleotide
  Target: DMPK; (-) strand; PAM type: NRG; PAM sequence: TGG
ctcgccccaccgctgagggc

SEQ ID NO: 7574 - DNA, 20 bp, Artificial Sequence
  Description of Artificial Sequence: Synthetic oligonucleotide
  Target: DMPK; (-) strand; PAM type: NRG; PAM sequence: GGG
gtctctcgccccaccgctga

SEQ ID NO: 7575 - DNA, 20 bp, Artificial Sequence
  Description of Artificial Sequence: Synthetic oligonucleotide
  Target: DMPK; (-) strand; PAM type: NRG; PAM sequence: AGG
tgtctctcgccccaccgctg

SEQ ID NO: 7576 - DNA, 20 bp, Artificial Sequence
  Description of Artificial Sequence: Synthetic oligonucleotide
  Target: DMPK; (-) strand; PAM type: NRG; PAM sequence: GAG
ctgtctctcgccccaccgct

SEQ ID NO: 7577 - DNA, 20 bp, Artificial Sequence
  Description of Artificial Sequence: Synthetic oligonucleotide
  Target: DMPK; (-) strand; PAM type: NRG; PAM sequence: TAG
gattccctccgggatctccc

SEQ ID NO: 7578 - DNA, 20 bp, Artificial Sequence
  Description of Artificial Sequence: Synthetic oligonucleotide
  Target: DMPK; (-) strand; PAM type: NRG; PAM sequence: GGG
ggcctcaccagattccctcc

SEQ ID NO: 7579 - DNA, 20 bp, Artificial Sequence
  Description of Artificial Sequence: Synthetic oligonucleotide
  Target: DMPK; (-) strand; PAM type: NRG; PAM sequence: CGG
aggcctcaccagattccctc

SEQ ID NO: 7580 - DNA, 20 bp, Artificial Sequence
  Description of Artificial Sequence: Synthetic oligonucleotide
  Target: DMPK; (-) strand; PAM type: NRG; PAM sequence: CAG
tccctccgttcaggcctcac

SEQ ID NO: 7581 - DNA, 20 bp, Artificial Sequence
  Description of Artificial Sequence: Synthetic oligonucleotide
  Target: DMPK; (-) strand; PAM type: NRG; PAM sequence: AGG
ccccagatctccctccgttc

SEQ ID NO: 7582 - DNA, 20 bp, Artificial Sequence
  Description of Artificial Sequence: Synthetic oligonucleotide
  Target: DMPK; (-) strand; PAM type: NRG; PAM sequence: CAG
gccccagatctccctccgtt

SEQ ID NO: 7583 - DNA, 20 bp, Artificial Sequence
  Description of Artificial Sequence: Synthetic oligonucleotide
  Target: DMPK; (-) strand; PAM type: NRG; PAM sequence: CAG
agaagccctttattcagccc

SEQ ID NO: 7584 - DNA, 20 bp, Artificial Sequence
  Description of Artificial Sequence: Synthetic oligonucleotide
  Target: DMPK; (-) strand; PAM type: NRG; PAM sequence: CAG
gagggcagaagccctttatt

SEQ ID NO: 7585 - DNA, 20 bp, Artificial Sequence
  Description of Artificial Sequence: Synthetic oligonucleotide
  Target: DMPK; (-) strand; PAM type: NRG; PAM sequence: AAG
tttgcgactttagagggcag

SEQ ID NO: 7586 - DNA, 20 bp, Artificial Sequence
  Description of Artificial Sequence: Synthetic oligonucleotide
  Target: DMPK; (-) strand; PAM type: NRG; PAM sequence: CAG
gtctttgcgactttagaggg

SEQ ID NO: 7587 - DNA, 20 bp, Artificial Sequence
  Description of Artificial Sequence: Synthetic oligonucleotide
  Target: DMPK; (-) strand; PAM type: NRG; PAM sequence: GGG
tacgtctttgcgactttaga

SEQ ID NO: 7588 - DNA, 20 bp, Artificial Sequence
  Description of Artificial Sequence: Synthetic oligonucleotide
  Target: DMPK; (-) strand; PAM type: NRG; PAM sequence: AGG
ctacgtctttgcgactttag

SEQ ID NO: 7589 - DNA, 20 bp, Artificial Sequence
  Description of Artificial Sequence: Synthetic oligonucleotide
  Target: DMPK; (-) strand; PAM type: NRG; PAM sequence: GAG
cctacgtctttgcgacttta

SEQ ID NO: 7590 - DNA, 20 bp, Artificial Sequence
  Description of Artificial Sequence: Synthetic oligonucleotide
  Target: DMPK; (-) strand; PAM type: NRG; PAM sequence: TAG
accctacgtctttgcgactt

SEQ ID NO: 7591 - DNA, 20 bp, Artificial Sequence
  Description of Artificial Sequence: Synthetic oligonucleotide
  Target: DMPK; (-) strand; PAM type: NRG; PAM sequence: GGG
ggtctccccgtccagatata

SEQ ID NO: 7592 - DNA, 20 bp, Artificial Sequence
  Description of Artificial Sequence: Synthetic oligonucleotide
  Target: DMPK; (-) strand; PAM type: NRG; PAM sequence: AGG
tggtctccccgtccagatat

SEQ ID NO: 7593 - DNA, 20 bp, Artificial Sequence
  Description of Artificial Sequence: Synthetic oligonucleotide
  Target: DMPK; (-) strand; PAM type: NRG; PAM sequence: TAG
ctggtctccccgtccagata

SEQ ID NO: 7594 - DNA, 20 bp, Artificial Sequence
  Description of Artificial Sequence: Synthetic oligonucleotide
  Target: DMPK; (-) strand; PAM type: NRG; PAM sequence: CAG
tggctcctggtctccccgtc

SEQ ID NO: 7595 - DNA, 20 bp, Artificial Sequence
  Description of Artificial Sequence: Synthetic oligonucleotide
  Target: DMPK; (-) strand; PAM type: NRG; PAM sequence: TGG
cagatcccctccctggctcc

SEQ ID NO: 7596 - DNA, 20 bp, Artificial Sequence
  Description of Artificial Sequence: Synthetic oligonucleotide
  Target: DMPK; (-) strand; PAM type: NRG; PAM sequence: TGG
cattctgcagatcccctccc

SEQ ID NO: 7597 - DNA, 20 bp, Artificial Sequence
  Description of Artificial Sequence: Synthetic oligonucleotide
  Target: DMPK; (-) strand; PAM type: NRG; PAM sequence: CAG
cagacctgctgcccattctg

SEQ ID NO: 7598 - DNA, 20 bp, Artificial Sequence
  Description of Artificial Sequence: Synthetic oligonucleotide
  Target: DMPK; (-) strand; PAM type: NRG; PAM sequence: CAG
cccctctctttcccctgcct

SEQ ID NO: 7599 - DNA, 20 bp, Artificial Sequence
  Description of Artificial Sequence: Synthetic oligonucleotide
  Target: DMPK; (-) strand; PAM type: NRG; PAM sequence: AAG
acggatccaccttcccatgt

SEQ ID NO: 7600 - DNA, 20 bp, Artificial Sequence
  Description of Artificial Sequence: Synthetic oligonucleotide
  Target: DMPK; (-) strand; PAM type: NRG; PAM sequence: CGG
ggtccccagtccccgggcca

SEQ ID NO: 7601 - DNA, 20 bp, Artificial Sequence
  Description of Artificial Sequence: Synthetic oligonucleotide
  Target: DMPK; (-) strand; PAM type: NRG; PAM sequence: GGG
cacgggggtccccagtcccc

SEQ ID NO: 7602 - DNA, 20 bp, Artificial Sequence
  Description of Artificial Sequence: Synthetic oligonucleotide
  Target: DMPK; (-) strand; PAM type: NRG; PAM sequence: CGG
tcacgggggtccccagtccc

SEQ ID NO: 7603 - DNA, 20 bp, Artificial Sequence
  Description of Artificial Sequence: Synthetic oligonucleotide
  Target: DMPK; (-) strand; PAM type: NRG; PAM sequence: CAG
ccagctgtcacgggggtccc

SEQ ID NO: 7604 - DNA, 20 bp, Artificial Sequence
  Description of Artificial Sequence: Synthetic oligonucleotide
  Target: DMPK; (-) strand; PAM type: NRG; PAM sequence: GGG
tctccttccagctgtcacgg

SEQ ID NO: 7605 - DNA, 20 bp, Artificial Sequence
  Description of Artificial Sequence: Synthetic oligonucleotide
  Target: DMPK; (-) strand; PAM type: NRG; PAM sequence: GGG
ttctccttccagctgtcacg

SEQ ID NO: 7606 - DNA, 20 bp, Artificial Sequence
  Description of Artificial Sequence: Synthetic oligonucleotide
  Target: DMPK; (-) strand; PAM type: NRG; PAM sequence: GGG
cttctccttccagctgtcac

SEQ ID NO: 7607 - DNA, 20 bp, Artificial Sequence
  Description of Artificial Sequence: Synthetic oligonucleotide
  Target: DMPK; (-) strand; PAM type: NRG; PAM sequence: CGG
tcttctccttccagctgtca

SEQ ID NO: 7608 - DNA, 20 bp, Artificial Sequence
  Description of Artificial Sequence: Synthetic oligonucleotide
  Target: DMPK; (-) strand; PAM type: NRG; PAM sequence: CAG
atgcctctttcttctccttc

SEQ ID NO: 7609 - DNA, 20 bp, Artificial Sequence
  Description of Artificial Sequence: Synthetic oligonucleotide
  Target: DMPK; (-) strand; PAM type: NRG; PAM sequence: GGG
gagggaagggacccacgctg

SEQ ID NO: 7610 - DNA, 20 bp, Artificial Sequence
  Description of Artificial Sequence: Synthetic oligonucleotide
  Target: DMPK; (-) strand; PAM type: NRG; PAM sequence: GGG
ggagggaagggacccacgct

SEQ ID NO: 7611 - DNA, 20 bp, Artificial Sequence
  Description of Artificial Sequence: Synthetic oligonucleotide
  Target: DMPK; (-) strand; PAM type: NRG; PAM sequence: TGG
aggagggaagggacccacgc

SEQ ID NO: 7612 - DNA, 20 bp, Artificial Sequence
  Description of Artificial Sequence: Synthetic oligonucleotide
  Target: DMPK; (-) strand; PAM type: NRG; PAM sequence: GGG
tagacacctggaggagggaa

SEQ ID NO: 7613 - DNA, 20 bp, Artificial Sequence
  Description of Artificial Sequence: Synthetic oligonucleotide
  Target: DMPK; (-) strand; PAM type: NRG; PAM sequence: AGG
atagacacctggaggaggga

SEQ ID NO: 7614 - DNA, 20 bp, Artificial Sequence
  Description of Artificial Sequence: Synthetic oligonucleotide
  Target: DMPK; (-) strand; PAM type: NRG; PAM sequence: AAG
tatagacacctggaggaggg

SEQ ID NO: 7615 - DNA, 20 bp, Artificial Sequence
  Description of Artificial Sequence: Synthetic oligonucleotide
  Target: DMPK; (-) strand; PAM type: NRG; PAM sequence: GGG
gtgtatagacacctggagga

SEQ ID NO: 7616 - DNA, 20 bp, Artificial Sequence
  Description of Artificial Sequence: Synthetic oligonucleotide
  Target: DMPK; (-) strand; PAM type: NRG; PAM sequence: AGG
cgtgtatagacacctggagg

SEQ ID NO: 7617 - DNA, 20 bp, Artificial Sequence
  Description of Artificial Sequence: Synthetic oligonucleotide
  Target: DMPK; (-) strand; PAM type: NRG; PAM sequence: GAG
gcgtgtatagacacctggag

SEQ ID NO: 7618 - DNA, 20 bp, Artificial Sequence
  Description of Artificial Sequence: Synthetic oligonucleotide
  Target: DMPK; (-) strand; PAM type: NRG; PAM sequence: AGG
gggcgtgtatagacacctgg

SEQ ID NO: 7619 - DNA, 20 bp, Artificial Sequence
  Description of Artificial Sequence: Synthetic oligonucleotide
  Target: DMPK; (-) strand; PAM type: NRG; PAM sequence: GAG
ggggcgtgtatagacacctg

SEQ ID NO: 7620 - DNA, 20 bp, Artificial Sequence
  Description of Artificial Sequence: Synthetic oligonucleotide
  Target: DMPK; (-) strand; PAM type: NRG; PAM sequence: TGG
gcggggcgtgtatagacacc

SEQ ID NO: 7621 - DNA, 20 bp, Artificial Sequence
  Description of Artificial Sequence: Synthetic oligonucleotide
  Target: DMPK; (-) strand; PAM type: NRG; PAM sequence: TAG
tctgctccgcggggcgtgta

SEQ ID NO: 7622 - DNA, 20 bp, Artificial Sequence
  Description of Artificial Sequence: Synthetic oligonucleotide
  Target: DMPK; (-) strand; PAM type: NRG; PAM sequence: GGG
ggtgggccgtctgctccgcg

SEQ ID NO: 7623 - DNA, 20 bp, Artificial Sequence
  Description of Artificial Sequence: Synthetic oligonucleotide
  Target: DMPK; (-) strand; PAM type: NRG; PAM sequence: GGG
aggtgggccgtctgctccgc

SEQ ID NO: 7624 - DNA, 20 bp, Artificial Sequence
  Description of Artificial Sequence: Synthetic oligonucleotide
  Target: DMPK; (-) strand; PAM type: NRG; PAM sequence: CGG
gaggtgggccgtctgctccg

SEQ ID NO: 7625 - DNA, 20 bp, Artificial Sequence
  Description of Artificial Sequence: Synthetic oligonucleotide
  Target: DMPK; (-) strand; PAM type: NRG; PAM sequence: GGG
ccggaggaccgggaggaggt

SEQ ID NO: 7626 - DNA, 20 bp, Artificial Sequence
  Description of Artificial Sequence: Synthetic oligonucleotide
  Target: DMPK; (-) strand; PAM type: NRG; PAM sequence: TGG
cccggaggaccgggaggagg

SEQ ID NO: 7627 - DNA, 20 bp, Artificial Sequence
  Description of Artificial Sequence: Synthetic oligonucleotide
  Target: DMPK; (-) strand; PAM type: NRG; PAM sequence: AGG
ttccccggaggaccgggagg

SEQ ID NO: 7628 - DNA, 20 bp, Artificial Sequence
  Description of Artificial Sequence: Synthetic oligonucleotide
  Target: DMPK; (-) strand; PAM type: NRG; PAM sequence: GAG
cttccccggaggaccgggag

SEQ ID NO: 7629 - DNA, 20 bp, Artificial Sequence
  Description of Artificial Sequence: Synthetic oligonucleotide
  Target: DMPK; (-) strand; PAM type: NRG; PAM sequence: AGG
cccttccccggaggaccggg

SEQ ID NO: 7630 - DNA, 20 bp, Artificial Sequence
  Description of Artificial Sequence: Synthetic oligonucleotide
  Target: DMPK; (-) strand; PAM type: NRG; PAM sequence: GAG
ccccttccccggaggaccgg

SEQ ID NO: 7631 - DNA, 20 bp, Artificial Sequence
  Description of Artificial Sequence: Synthetic oligonucleotide
  Target: DMPK; (-) strand; PAM type: NRG; PAM sequence: GGG
gtccccttccccggaggacc

SEQ ID NO: 7632 - DNA, 20 bp, Artificial Sequence
  Description of Artificial Sequence: Synthetic oligonucleotide
  Target: DMPK; (-) strand; PAM type: NRG; PAM sequence: CGG
tgtccccttccccggaggac

SEQ ID NO: 7633 - DNA, 20 bp, Artificial Sequence
  Description of Artificial Sequence: Synthetic oligonucleotide
  Target: DMPK; (-) strand; PAM type: NRG; PAM sequence: AGG
tcatgtgtccccttccccgg

SEQ ID NO: 7634 - DNA, 20 bp, Artificial Sequence
  Description of Artificial Sequence: Synthetic oligonucleotide
  Target: DMPK; (-) strand; PAM type: NRG; PAM sequence: GAG
ctcatgtgtccccttccccg

SEQ ID NO: 7635 - DNA, 20 bp, Artificial Sequence
  Description of Artificial Sequence: Synthetic oligonucleotide
  Target: DMPK; (-) strand; PAM type: NRG; PAM sequence: CGG
ccctcatgtgtccccttccc

SEQ ID NO: 7636 - DNA, 20 bp, Artificial Sequence
  Description of Artificial Sequence: Synthetic oligonucleotide
  Target: DMPK; (-) strand; PAM type: NRG; PAM sequence: GAG
aggcagagggagccacaggt

SEQ ID NO: 7637 - DNA, 20 bp, Artificial Sequence
  Description of Artificial Sequence: Synthetic oligonucleotide
  Target: DMPK; (-) strand; PAM type: NRG; PAM sequence: AGG
ctgcaggcagagggagccac

SEQ ID NO: 7638 - DNA, 20 bp, Artificial Sequence
  Description of Artificial Sequence: Synthetic oligonucleotide
  Target: DMPK; (-) strand; PAM type: NRG; PAM sequence: CAG
gctgcaggcagagggagcca

SEQ ID NO: 7639 - DNA, 20 bp, Artificial Sequence
  Description of Artificial Sequence: Synthetic oligonucleotide
  Target: DMPK; (-) strand; PAM type: NRG; PAM sequence: GAG
ggagttgctgcaggcagagg

SEQ ID NO: 7640 - DNA, 20 bp, Artificial Sequence
  Description of Artificial Sequence: Synthetic oligonucleotide
  Target: DMPK; (-) strand; PAM type: NRG; PAM sequence: GGG
atggagttgctgcaggcaga

SEQ ID NO: 7641 - DNA, 20 bp, Artificial Sequence
  Description of Artificial Sequence: Synthetic oligonucleotide
  Target: DMPK; (-) strand; PAM type: NRG; PAM sequence: AGG
gatggagttgctgcaggcag

SEQ ID NO: 7642 - DNA, 20 bp, Artificial Sequence
  Description of Artificial Sequence: Synthetic oligonucleotide
  Target: DMPK; (-) strand; PAM type: NRG; PAM sequence: GAG
ggatggagttgctgcaggca

SEQ ID NO: 7643 - DNA, 20 bp, Artificial Sequence
  Description of Artificial Sequence: Synthetic oligonucleotide
  Target: DMPK; (-) strand; PAM type: NRG; PAM sequence: CAG
gcggatggagttgctgcagg

SEQ ID NO: 7644 - DNA, 20 bp, Artificial Sequence
  Description of Artificial Sequence: Synthetic oligonucleotide
  Target: DMPK; (-) strand; PAM type: NRG; PAM sequence: AGG
ggagcggatggagttgctgc

SEQ ID NO: 7645 - DNA, 20 bp, Artificial Sequence
  Description of Artificial Sequence: Synthetic oligonucleotide
  Target: DMPK; (-) strand; PAM type: NRG; PAM sequence: CAG
aggagcggatggagttgctg

SEQ ID NO: 7646 - DNA, 20 bp, Artificial Sequence
  Description of Artificial Sequence: Synthetic oligonucleotide
  Target: DMPK; (-) strand; PAM type: NRG; PAM sequence: GAG
ggcagttgcaggagcggatg

SEQ ID NO: 7647 - DNA, 20 bp, Artificial Sequence
  Description of Artificial Sequence: Synthetic oligonucleotide
  Target: DMPK; (-) strand; PAM type: NRG; PAM sequence: TGG
ccggcagttgcaggagcgga

SEQ ID NO: 7648 - DNA, 20 bp, Artificial Sequence
  Description of Artificial Sequence: Synthetic oligonucleotide
  Target: DMPK; (-) strand; PAM type: NRG; PAM sequence: CGG
acgtccggcagttgcaggag

SEQ ID NO: 7649 - DNA, 20 bp, Artificial Sequence
  Description of Artificial Sequence: Synthetic oligonucleotide
  Target: DMPK; (-) strand; PAM type: NRG; PAM sequence: GAG
cacacgtccggcagttgcag

SEQ ID NO: 7650 - DNA, 20 bp, Artificial Sequence
  Description of Artificial Sequence: Synthetic oligonucleotide
  Target: DMPK; (-) strand; PAM type: NRG; PAM sequence: AGG
ggcacacgtccggcagttgc

SEQ ID NO: 7651 - DNA, 20 bp, Artificial Sequence
  Description of Artificial Sequence: Synthetic oligonucleotide
  Target: DMPK; (-) strand; PAM type: NRG; PAM sequence: CAG
aggcacacgtccggcagttg

SEQ ID NO: 7652 - DNA, 20 bp, Artificial Sequence
  Description of Artificial Sequence: Synthetic oligonucleotide
  Target: DMPK; (-) strand; PAM type: NRG; PAM sequence: CAG
acctagaggcacacgtccgg

SEQ ID NO: 7653 - DNA, 20 bp, Artificial Sequence
  Description of Artificial Sequence: Synthetic oligonucleotide
  Target: DMPK; (-) strand; PAM type: NRG; PAM sequence: CGG
gggacctagaggcacacgtc

SEQ ID NO: 7654 - DNA, 20 bp, Artificial Sequence
  Description of Artificial Sequence: Synthetic oligonucleotide
  Target: DMPK; (-) strand; PAM type: NRG; PAM sequence: AGG
ggctcggaaccgggacctag

SEQ ID NO: 7655 - DNA, 20 bp, Artificial Sequence
  Description of Artificial Sequence: Synthetic oligonucleotide
  Target: DMPK; (-) strand; PAM type: NRG; PAM sequence: GAG
aggctcggaaccgggaccta

SEQ ID NO: 7656 - DNA, 20 bp, Artificial Sequence
  Description of Artificial Sequence: Synthetic oligonucleotide
  Target: DMPK; (-) strand; PAM type: NRG; PAM sequence: TAG
agaggctcggaaccgggacc

SEQ ID NO: 7657 - DNA, 20 bp, Artificial Sequence
  Description of Artificial Sequence: Synthetic oligonucleotide
  Target: DMPK; (-) strand; PAM type: NRG; PAM sequence: GGG
cgaggcagaggctcggaacc

SEQ ID NO: 7658 - DNA, 20 bp, Artificial Sequence
  Description of Artificial Sequence: Synthetic oligonucleotide
  Target: DMPK; (-) strand; PAM type: NRG; PAM sequence: CGG
gcgaggcagaggctcggaac

SEQ ID NO: 7659 - DNA, 20 bp, Artificial Sequence
  Description of Artificial Sequence: Synthetic oligonucleotide
  Target: DMPK; (-) strand; PAM type: NRG; PAM sequence: CGG
aactacgcgaggcagaggct

SEQ ID NO: 7660 - DNA, 20 bp, Artificial Sequence
  Description of Artificial Sequence: Synthetic oligonucleotide
  Target: DMPK; (-) strand; PAM type: NRG; PAM sequence: AGG
cagtcaactacgcgaggcag

SEQ ID NO: 7661 - DNA, 20 bp, Artificial Sequence
  Description of Artificial Sequence: Synthetic oligonucleotide
  Target: DMPK; (-) strand; PAM type: NRG; PAM sequence: GAG
acagtcaactacgcgaggca

SEQ ID NO: 7662 - DNA, 20 bp, Artificial Sequence
  Description of Artificial Sequence: Synthetic oligonucleotide
  Target: DMPK; (-) strand; PAM type: NRG; PAM sequence: CAG
ccacagtcaactacgcgagg

SEQ ID NO: 7663 - DNA, 20 bp, Artificial Sequence
  Description of Artificial Sequence: Synthetic oligonucleotide
  Target: DMPK; (-) strand; PAM type: NRG; PAM sequence: AGG
tccccacagtcaactacgcg

SEQ ID NO: 7664 - DNA, 20 bp, Artificial Sequence
  Description of Artificial Sequence: Synthetic oligonucleotide
  Target: DMPK; (-) strand; PAM type: NRG; PAM sequence: GAG
ctccccacagtcaactacgc

SEQ ID NO: 7665 - DNA, 20 bp, Artificial Sequence
  Description of Artificial Sequence: Synthetic oligonucleotide
  Target: DMPK; (-) strand; PAM type: NRG; PAM sequence: CAG
tcaccgtccttacctcccca

SEQ ID NO: 7666 - DNA, 20 bp, Artificial Sequence
  Description of Artificial Sequence: Synthetic oligonucleotide
  Target: DMPK; (-) strand; PAM type: NRG; PAM sequence: CGG
cccctctcgtccggcccgga

SEQ ID NO: 7667 - DNA, 20 bp, Artificial Sequence
  Description of Artificial Sequence: Synthetic oligonucleotide
  Target: DMPK; (-) strand; PAM type: NRG; PAM sequence: CGG
gcatcccctctcgtccggcc

SEQ ID NO: 7668 - DNA, 20 bp, Artificial Sequence
  Description of Artificial Sequence: Synthetic oligonucleotide
  Target: DMPK; (-) strand; PAM type: NRG; PAM sequence: CGG
ccttggcatcccctctcgtc

SEQ ID NO: 7669 - DNA, 20 bp, Artificial Sequence
  Description of Artificial Sequence: Synthetic oligonucleotide
  Target: DMPK; (-) strand; PAM type: NRG; PAM sequence: TGG
tgcgggccggtggcaaccct

SEQ ID NO: 7670 - DNA, 20 bp, Artificial Sequence
  Description of Artificial Sequence: Synthetic oligonucleotide
  Target: DMPK; (-) strand; PAM type: NRG; PAM sequence: TGG
ggggccgggatgcgggccgg

SEQ ID NO: 7671 - DNA, 20 bp, Artificial Sequence
  Description of Artificial Sequence: Synthetic oligonucleotide
  Target: DMPK; (-) strand; PAM type: NRG; PAM sequence: CGG
gccggggccgggatgcgggc

SEQ ID NO: 7672 - DNA, 20 bp, Artificial Sequence
  Description of Artificial Sequence: Synthetic oligonucleotide
  Target: DMPK; (-) strand; PAM type: NRG; PAM sequence: GGG
cggggccggggccgggatgc

SEQ ID NO: 7673 - DNA, 20 bp, Artificial Sequence
  Description of Artificial Sequence: Synthetic oligonucleotide
  Target: DMPK; (-) strand; PAM type: NRG; PAM sequence: CGG
ccggggccggggccgggatg

SEQ ID NO: 7674 - DNA, 20 bp, Artificial Sequence
  Description of Artificial Sequence: Synthetic oligonucleotide
  Target: DMPK; (-) strand; PAM type: NRG; PAM sequence: GGG
tcggggccggggccggggcc

SEQ ID NO: 7675 - DNA, 20 bp, Artificial Sequence
  Description of Artificial Sequence: Synthetic oligonucleotide
  Target: DMPK; (-) strand; PAM type: NRG; PAM sequence: CGG
atcggggccggggccggggc

SEQ ID NO: 7676 - DNA, 20 bp, Artificial Sequence
  Description of Artificial Sequence: Synthetic oligonucleotide
  Target: DMPK; (-) strand; PAM type: NRG; PAM sequence: GGG
cgggatcggggccggggccg

SEQ ID NO: 7677 - DNA, 20 bp, Artificial Sequence
  Description of Artificial Sequence: Synthetic oligonucleotide
  Target: DMPK; (-) strand; PAM type: NRG; PAM sequence: GGG
tcgggatcggggccggggcc

SEQ ID NO: 7678 - DNA, 20 bp, Artificial Sequence
  Description of Artificial Sequence: Synthetic oligonucleotide
  Target: DMPK; (-) strand; PAM type: NRG; PAM sequence: CGG
gtcgggatcggggccggggc

SEQ ID NO: 7679 - DNA, 20 bp, Artificial Sequence
  Description of Artificial Sequence: Synthetic oligonucleotide
  Target: DMPK; (-) strand; PAM type: NRG; PAM sequence: GGG
ccaggtcgggatcggggccg

SEQ ID NO: 7680 - DNA, 20 bp, Artificial Sequence
  Description of Artificial Sequence: Synthetic oligonucleotide
  Target: DMPK; (-) strand; PAM type: NRG; PAM sequence: GGG
gccaggtcgggatcggggcc

SEQ ID NO: 7681 - DNA, 20 bp, Artificial Sequence
  Description of Artificial Sequence: Synthetic oligonucleotide
  Target: DMPK; (-) strand; PAM type: NRG; PAM sequence: CGG
cgccaggtcgggatcggggc

SEQ ID NO: 7682 - DNA, 20 bp, Artificial Sequence
  Description of Artificial Sequence: Synthetic oligonucleotide
  Target: DMPK; (-) strand; PAM type: NRG; PAM sequence: GGG
acttcgccaggtcgggatcg

SEQ ID NO: 7683 - DNA, 20 bp, Artificial Sequence
  Description of Artificial Sequence: Synthetic oligonucleotide
  Target: DMPK; (-) strand; PAM type: NRG; PAM sequence: GGG
aacttcgccaggtcgggatc

SEQ ID NO: 7684 - DNA, 20 bp, Artificial Sequence
  Description of Artificial Sequence: Synthetic oligonucleotide
  Target: DMPK; (-) strand; PAM type: NRG; PAM sequence: CGG
gaacttcgccaggtcgggat

SEQ ID NO: 7685 - DNA, 20 bp, Artificial Sequence
  Description of Artificial Sequence: Synthetic oligonucleotide
  Target: DMPK; (-) strand; PAM type: NRG; PAM sequence: GGG
aaccagaacttcgccaggtc

SEQ ID NO: 7686 - DNA, 20 bp, Artificial Sequence
  Description of Artificial Sequence: Synthetic oligonucleotide
  Target: DMPK; (-) strand; PAM type: NRG; PAM sequence: CGG
caaccagaacttcgccaggt

SEQ ID NO: 7687 - DNA, 20 bp, Artificial Sequence
  Description of Artificial Sequence: Synthetic oligonucleotide
  Target: DMPK; (-) strand; PAM type: NRG; PAM sequence: AGG
cggacaaccagaacttcgcc

SEQ ID NO: 7688 - DNA, 20 bp, Artificial Sequence
  Description of Artificial Sequence: Synthetic oligonucleotide
  Target: DMPK; (-) strand; PAM type: NRG; PAM sequence: CAG
acggacaaccagaacttcgc

SEQ ID NO: 7689 - DNA, 20 bp, Artificial Sequence
  Description of Artificial Sequence: Synthetic oligonucleotide
  Target: DMPK; (-) strand; PAM type: NRG; PAM sequence: CAG
aggccatccgcacggacaac

SEQ ID NO: 7690 - DNA, 20 bp, Artificial Sequence
  Description of Artificial Sequence: Synthetic oligonucleotide
  Target: DMPK; (-) strand; PAM type: NRG; PAM sequence: CGG
ggagatggaggccatccgca

SEQ ID NO: 7691 - DNA, 20 bp, Artificial Sequence
  Description of Artificial Sequence: Synthetic oligonucleotide
  Target: DMPK; (-) strand; PAM type: NRG; PAM sequence: AGG
gagcctgagccgggagatgg

SEQ ID NO: 7692 - DNA, 20 bp, Artificial Sequence
  Description of Artificial Sequence: Synthetic oligonucleotide
  Target: DMPK; (-) strand; PAM type: NRG; PAM sequence: GAG
agagcctgagccgggagatg

SEQ ID NO: 7693 - DNA, 20 bp, Artificial Sequence
  Description of Artificial Sequence: Synthetic oligonucleotide
  Target: DMPK; (-) strand; PAM type: NRG; PAM sequence: TGG
gcagagcctgagccgggaga

SEQ ID NO: 7694 - DNA, 20 bp, Artificial Sequence
  Description of Artificial Sequence: Synthetic oligonucleotide
  Target: DMPK; (-) strand; PAM type: NRG; PAM sequence: GAG
cccggcagagcctgagccgg

SEQ ID NO: 7695 - DNA, 20 bp, Artificial Sequence
  Description of Artificial Sequence: Synthetic oligonucleotide
  Target: DMPK; (-) strand; PAM type: NRG; PAM sequence: GGG
cacccggcagagcctgagcc

SEQ ID NO: 7696 - DNA, 20 bp, Artificial Sequence
  Description of Artificial Sequence: Synthetic oligonucleotide
  Target: DMPK; (-) strand; PAM type: NRG; PAM sequence: CGG
tcacccggcagagcctgagc

SEQ ID NO: 7697 - DNA, 20 bp, Artificial Sequence
  Description of Artificial Sequence: Synthetic oligonucleotide
  Target: DMPK; (-) strand; PAM type: NRG; PAM sequence: GAG
gtgctcacccggcagagcct

SEQ ID NO: 7698 - DNA, 20 bp, Artificial Sequence
  Description of Artificial Sequence: Synthetic oligonucleotide
  Target: DMPK; (-) strand; PAM type: NRG; PAM sequence: GAG
gaggaggtgctcacccggca

SEQ ID NO: 7699 - DNA, 20 bp, Artificial Sequence
  Description of Artificial Sequence: Synthetic oligonucleotide
  Target: DMPK; (-) strand; PAM type: NRG; PAM sequence: CAG
aggaggaggtgctcacccgg

SEQ ID NO: 7700 - DNA, 20 bp, Artificial Sequence
  Description of Artificial Sequence: Synthetic oligonucleotide
  Target: DMPK; (-) strand; PAM type: NRG; PAM sequence: CGG
tggaggaggaggtgctcacc

SEQ ID NO: 7701 - DNA, 20 bp, Artificial Sequence
  Description of Artificial Sequence: Synthetic oligonucleotide
  Target: DMPK; (-) strand; PAM type: NRG; PAM sequence: AGG
ccaggaagccctggaggagg

SEQ ID NO: 7702 - DNA, 20 bp, Artificial Sequence
  Description of Artificial Sequence: Synthetic oligonucleotide
  Target: DMPK; (-) strand; PAM type: NRG; PAM sequence: GAG
tccaggaagccctggaggag

SEQ ID NO: 7703 - DNA, 20 bp, Artificial Sequence
  Description of Artificial Sequence: Synthetic oligonucleotide
  Target: DMPK; (-) strand; PAM type: NRG; PAM sequence: AGG
gctccaggaagccctggagg

SEQ ID NO: 7704 - DNA, 20 bp, Artificial Sequence
  Description of Artificial Sequence: Synthetic oligonucleotide
  Target: DMPK; (-) strand; PAM type: NRG; PAM sequence: GAG
agctccaggaagccctggag

SEQ ID NO: 7705 - DNA, 20 bp, Artificial Sequence
  Description of Artificial Sequence: Synthetic oligonucleotide
  Target: DMPK; (-) strand; PAM type: NRG; PAM sequence: AGG
ggagctccaggaagccctgg

SEQ ID NO: 7706 - DNA, 20 bp, Artificial Sequence
  Description of Artificial Sequence: Synthetic oligonucleotide
  Target: DMPK; (-) strand; PAM type: NRG; PAM sequence: GAG
gggagctccaggaagccctg

SEQ ID NO: 7707 - DNA, 20 bp, Artificial Sequence
  Description of Artificial Sequence: Synthetic oligonucleotide
  Target: DMPK; (-) strand; PAM type: NRG; PAM sequence: TGG
gcgggagctccaggaagccc

SEQ ID NO: 7708 - DNA, 20 bp, Artificial Sequence
  Description of Artificial Sequence: Synthetic oligonucleotide
  Target: DMPK; (-) strand; PAM type: NRG; PAM sequence: AAG
gacgctgcgggagctccagg

SEQ ID NO: 7709 - DNA, 20 bp, Artificial Sequence
  Description of Artificial Sequence: Synthetic oligonucleotide
  Target: DMPK; (-) strand; PAM type: NRG; PAM sequence: AGG
ggtgacgctgcgggagctcc

SEQ ID NO: 7710 - DNA, 20 bp, Artificial Sequence
  Description of Artificial Sequence: Synthetic oligonucleotide
  Target: DMPK; (-) strand; PAM type: NRG; PAM sequence: CAG
aggtgacgctgcgggagctc

SEQ ID NO: 7711 - DNA, 20 bp, Artificial Sequence
  Description of Artificial Sequence: Synthetic oligonucleotide
  Target: DMPK; (-) strand; PAM type: NRG; PAM sequence: GAG
aggccgaggtgacgctgcgg

SEQ ID NO: 7712 - DNA, 20 bp, Artificial Sequence
  Description of Artificial Sequence: Synthetic oligonucleotide
  Target: DMPK; (-) strand; PAM type: NRG; PAM sequence: GGG
tgaggccgaggtgacgctgc

SEQ ID NO: 7713 - DNA, 20 bp, Artificial Sequence
  Description of Artificial Sequence: Synthetic oligonucleotide
  Target: DMPK; (-) strand; PAM type: NRG; PAM sequence: CGG
ctgaggccgaggtgacgctg

SEQ ID NO: 7714 - DNA, 20 bp, Artificial Sequence
  Description of Artificial Sequence: Synthetic oligonucleotide
  Target: DMPK; (-) strand; PAM type: NRG; PAM sequence: AGG
tgcggcagaggctgaggccg

SEQ ID NO: 7715 - DNA, 20 bp, Artificial Sequence
  Description of Artificial Sequence: Synthetic oligonucleotide
  Target: DMPK; (-) strand; PAM type: NRG; PAM sequence: GAG
ctgcggcagaggctgaggcc

SEQ ID NO: 7716 - DNA, 20 bp, Artificial Sequence
  Description of Artificial Sequence: Synthetic oligonucleotide
  Target: DMPK; (-) strand; PAM type: NRG; PAM sequence: AGG
tgtccctgcggcagaggctg

SEQ ID NO: 7717 - DNA, 20 bp, Artificial Sequence
  Description of Artificial Sequence: Synthetic oligonucleotide
  Target: DMPK; (-) strand; PAM type: NRG; PAM sequence: GAG
ctgtccctgcggcagaggct

SEQ ID NO: 7718 - DNA, 20 bp, Artificial Sequence
  Description of Artificial Sequence: Synthetic oligonucleotide
  Target: DMPK; (-) strand; PAM type: NRG; PAM sequence: AGG
agcggctgtccctgcggcag

SEQ ID NO: 7719 - DNA, 20 bp, Artificial Sequence
  Description of Artificial Sequence: Synthetic oligonucleotide
  Target: DMPK; (-) strand; PAM type: NRG; PAM sequence: GAG
cagcggctgtccctgcggca

SEQ ID NO: 7720 - DNA, 20 bp, Artificial Sequence
  Description of Artificial Sequence: Synthetic oligonucleotide
  Target: DMPK; (-) strand; PAM type: NRG; PAM sequence: CAG
tccagcggctgtccctgcgg

SEQ ID NO: 7721 - DNA, 20 bp, Artificial Sequence
  Description of Artificial Sequence: Synthetic oligonucleotide
  Target: DMPK; (-) strand; PAM type: NRG; PAM sequence: CGG
agttccagcggctgtccctg

SEQ ID NO: 7722 - DNA, 20 bp, Artificial Sequence
  Description of Artificial Sequence: Synthetic oligonucleotide
  Target: DMPK; (-) strand; PAM type: NRG; PAM sequence: CGG
ggctgaagtggcagttccag

SEQ ID NO: 7723 - DNA, 20 bp, Artificial Sequence
  Description of Artificial Sequence: Synthetic oligonucleotide
  Target: DMPK; (-) strand; PAM type: NRG; PAM sequence: CAG
acaggctgaagtggcagttc

SEQ ID NO: 7724 - DNA, 20 bp, Artificial Sequence
  Description of Artificial Sequence: Synthetic oligonucleotide
  Target: DMPK; (-) strand; PAM type: NRG; PAM sequence: CAG
ccatacacaggctgaagtgg

SEQ ID NO: 7725 - DNA, 20 bp, Artificial Sequence
  Description of Artificial Sequence: Synthetic oligonucleotide
  Target: DMPK; (-) strand; PAM type: NRG; PAM sequence: TGG
tccccatacacaggctgaag

SEQ ID NO: 7726 - DNA, 20 bp, Artificial Sequence
  Description of Artificial Sequence: Synthetic oligonucleotide
  Target: DMPK; (-) strand; PAM type: NRG; PAM sequence: AAG
tggtccccatacacaggctg

SEQ ID NO: 7727 - DNA, 20 bp, Artificial Sequence
  Description of Artificial Sequence: Synthetic oligonucleotide
  Target: DMPK; (-) strand; PAM type: NRG; PAM sequence: AGG
taagcctggtccccatacac

SEQ ID NO: 7728 - DNA, 20 bp, Artificial Sequence
  Description of Artificial Sequence: Synthetic oligonucleotide
  Target: DMPK; (-) strand; PAM type: NRG; PAM sequence: CAG
ttaagcctggtccccataca

SEQ ID NO: 7729 - DNA, 20 bp, Artificial Sequence
  Description of Artificial Sequence: Synthetic oligonucleotide
  Target: DMPK; (-) strand; PAM type: NRG; PAM sequence: TGG
gccacaggcagccttaagcc

SEQ ID NO: 7730 - DNA, 20 bp, Artificial Sequence
  Description of Artificial Sequence: Synthetic oligonucleotide
  Target: DMPK; (-) strand; PAM type: NRG; PAM sequence: AAG
caggagccacaggcagcctt

SEQ ID NO: 7731 - DNA, 20 bp, Artificial Sequence
  Description of Artificial Sequence: Synthetic oligonucleotide
  Target: DMPK; (-) strand; PAM type: NRG; PAM sequence: CAG
agtcttccaggagccacagg

SEQ ID NO: 7732 - DNA, 20 bp, Artificial Sequence
  Description of Artificial Sequence: Synthetic oligonucleotide
  Target: DMPK; (-) strand; PAM type: NRG; PAM sequence: AGG
ctgagtcttccaggagccac

SEQ ID NO: 7733 - DNA, 20 bp, Artificial Sequence
  Description of Artificial Sequence: Synthetic oligonucleotide
  Target: DMPK; (-) strand; PAM type: NRG; PAM sequence: CAG
cctgagtcttccaggagcca

SEQ ID NO: 7734 - DNA, 20 bp, Artificial Sequence
  Description of Artificial Sequence: Synthetic oligonucleotide
  Target: DMPK; (-) strand; PAM type: NRG; PAM sequence: GAG
ccaagtcctgagtcttccag

SEQ ID NO: 7735 - DNA, 20 bp, Artificial Sequence
  Description of Artificial Sequence: Synthetic oligonucleotide
  Target: DMPK; (-) strand; PAM type: NRG; PAM sequence: AGG
gcccaagtcctgagtcttcc

SEQ ID NO: 7736 - DNA, 20 bp, Artificial Sequence
  Description of Artificial Sequence: Synthetic oligonucleotide
  Target: DMPK; (-) strand; PAM type: NRG; PAM sequence: CAG
tgcccaagtcctgagtcttc

SEQ ID NO: 7737 - DNA, 20 bp, Artificial Sequence
  Description of Artificial Sequence: Synthetic oligonucleotide
  Target: DMPK; (-) strand; PAM type: NRG; PAM sequence: GAG
ggaaccagtgcccaagtcct

SEQ ID NO: 7738 - DNA, 20 bp, Artificial Sequence
  Description of Artificial Sequence: Synthetic oligonucleotide
  Target: DMPK; (-) strand; PAM type: NRG; PAM sequence: AAG
ctagcctggaaccagtgccc

SEQ ID NO: 7739 - DNA, 20 bp, Artificial Sequence
  Description of Artificial Sequence: Synthetic oligonucleotide
  Target: DMPK; (-) strand; PAM type: NRG; PAM sequence: CAG
aaggattcctagcctggaac

SEQ ID NO: 7740 - DNA, 20 bp, Artificial Sequence
  Description of Artificial Sequence: Synthetic oligonucleotide
  Target: DMPK; (-) strand; PAM type: NRG; PAM sequence: TGG
ataaacaaggattcctagcc

SEQ ID NO: 7741 - DNA, 20 bp, Artificial Sequence
  Description of Artificial Sequence: Synthetic oligonucleotide
  Target: DMPK; (-) strand; PAM type: NRG; PAM sequence: TAG
aggggataaacaaggattcc

SEQ ID NO: 7742 - DNA, 20 bp, Artificial Sequence
  Description of Artificial Sequence: Synthetic oligonucleotide
  Target: DMPK; (-) strand; PAM type: NRG; PAM sequence: AGG
ggaggagtaggggataaaca

SEQ ID NO: 7743 - DNA, 20 bp, Artificial Sequence
  Description of Artificial Sequence: Synthetic oligonucleotide
  Target: DMPK; (-) strand; PAM type: NRG; PAM sequence: AAG
cggaggagtaggggataaac

SEQ ID NO: 7744 - DNA, 20 bp, Artificial Sequence
  Description of Artificial Sequence: Synthetic oligonucleotide
  Target: DMPK; (-) strand; PAM type: NRG; PAM sequence: GGG
ttgaggggacggaggagtag

SEQ ID NO: 7745 - DNA, 20 bp, Artificial Sequence
  Description of Artificial Sequence: Synthetic oligonucleotide
  Target: DMPK; (-) strand; PAM type: NRG; PAM sequence: GGG
gttgaggggacggaggagta

SEQ ID NO: 7746 - DNA, 20 bp, Artificial Sequence
  Description of Artificial Sequence: Synthetic oligonucleotide
  Target: DMPK; (-) strand; PAM type: NRG; PAM sequence: AGG
tgttgaggggacggaggagt

SEQ ID NO: 7747 - DNA, 20 bp, Artificial Sequence
  Description of Artificial Sequence: Synthetic oligonucleotide
  Target: DMPK; (-) strand; PAM type: NRG; PAM sequence: TAG
atgttgaggggacggaggag

SEQ ID NO: 7748 - DNA, 20 bp, Artificial Sequence
  Description of Artificial Sequence: Synthetic oligonucleotide
  Target: DMPK; (-) strand; PAM type: NRG; PAM sequence: GAG
gaaatgttgaggggacggag

SEQ ID NO: 7749 - DNA, 20 bp, Artificial Sequence
  Description of Artificial Sequence: Synthetic oligonucleotide
  Target: DMPK; (-) strand; PAM type: NRG; PAM sequence: AGG
cagaaatgttgaggggacgg

SEQ ID NO: 7750 - DNA, 20 bp, Artificial Sequence
  Description of Artificial Sequence: Synthetic oligonucleotide
  Target: DMPK; (-) strand; PAM type: NRG; PAM sequence: GAG
ccagaaatgttgaggggacg

SEQ ID NO: 7751 - DNA, 20 bp, Artificial Sequence
  Description of Artificial Sequence: Synthetic oligonucleotide
  Target: DMPK; (-) strand; PAM type: NRG; PAM sequence: CGG
ttccagaaatgttgagggga

SEQ ID NO: 7752 - DNA, 20 bp, Artificial Sequence
  Description of Artificial Sequence: Synthetic oligonucleotide
  Target: DMPK; (-) strand; PAM type: NRG; PAM sequence: GGG
gggattccagaaatgttgag

SEQ ID NO: 7753 - DNA, 20 bp, Artificial Sequence
  Description of Artificial Sequence: Synthetic oligonucleotide
  Target: DMPK; (-) strand; PAM type: NRG; PAM sequence: GGG
ggggattccagaaatgttga

SEQ ID NO: 7754 - DNA, 20 bp, Artificial Sequence
  Description of Artificial Sequence: Synthetic oligonucleotide
  Target: DMPK; (-) strand; PAM type: NRG; PAM sequence: AGG
tggggattccagaaatgttg

SEQ ID NO: 7755 - DNA, 20 bp, Artificial Sequence
  Description of Artificial Sequence: Synthetic oligonucleotide
  Target: DMPK; (-) strand; PAM type: NRG; PAM sequence: GAG
atggggattccagaaatgtt

SEQ ID NO: 7756 - DNA, 20 bp, Artificial Sequence
  Description of Artificial Sequence: Synthetic oligonucleotide
  Target: DMPK; (-) strand; PAM type: NRG; PAM sequence: CAG
tgcaggagctatggggattc

SEQ ID NO: 7757 - DNA, 20 bp, Artificial Sequence
  Description of Artificial Sequence: Synthetic oligonucleotide
  Target: DMPK; (-) strand; PAM type: NRG; PAM sequence: GGG
ggatcattgcaggagctatg

SEQ ID NO: 7758 - DNA, 20 bp, Artificial Sequence
  Description of Artificial Sequence: Synthetic oligonucleotide
  Target: DMPK; (-) strand; PAM type: NRG; PAM sequence: GGG
tggatcattgcaggagctat

SEQ ID NO: 7759 - DNA, 20 bp, Artificial Sequence
  Description of Artificial Sequence: Synthetic oligonucleotide
  Target: DMPK; (-) strand; PAM type: NRG; PAM sequence: TGG
ttggatcattgcaggagcta

SEQ ID NO: 7760 - DNA, 20 bp, Artificial Sequence
  Description of Artificial Sequence: Synthetic oligonucleotide
  Target: DMPK; (-) strand; PAM type: NRG; PAM sequence: GAG
gggggcttggatcattgcag

SEQ ID NO: 7761 - DNA, 20 bp, Artificial Sequence
  Description of Artificial Sequence: Synthetic oligonucleotide
  Target: DMPK; (-) strand; PAM type: NRG; PAM sequence: AGG
gagggggcttggatcattgc

SEQ ID NO: 7762 - DNA, 20 bp, Artificial Sequence
  Description of Artificial Sequence: Synthetic oligonucleotide
  Target: DMPK; (-) strand; PAM type: NRG; PAM sequence: CAG
ggagggggcttggatcattg

SEQ ID NO: 7763 - DNA, 20 bp, Artificial Sequence
  Description of Artificial Sequence: Synthetic oligonucleotide
  Target: DMPK; (-) strand; PAM type: NRG; PAM sequence: TGG
ggtagggaagggagggggct

SEQ ID NO: 7764 - DNA, 20 bp, Artificial Sequence
  Description of Artificial Sequence: Synthetic oligonucleotide
  Target: DMPK; (-) strand; PAM type: NRG; PAM sequence: GGG
agggaggtagggaagggagg

SEQ ID NO: 7765 - DNA, 20 bp, Artificial Sequence
  Description of Artificial Sequence: Synthetic oligonucleotide
  Target: DMPK; (-) strand; PAM type: NRG; PAM sequence: GGG
gagggaggtagggaagggag

SEQ ID NO: 7766 - DNA, 20 bp, Artificial Sequence
  Description of Artificial Sequence: Synthetic oligonucleotide
  Target: DMPK; (-) strand; PAM type: NRG; PAM sequence: GGG
tgagggaggtagggaaggga

SEQ ID NO: 7767 - DNA, 20 bp, Artificial Sequence
  Description of Artificial Sequence: Synthetic oligonucleotide
  Target: DMPK; (-) strand; PAM type: NRG; PAM sequence: AGG
ctgagggaggtagggaaggg

SEQ ID NO: 7768 - DNA, 20 bp, Artificial Sequence
  Description of Artificial Sequence: Synthetic oligonucleotide
  Target: DMPK; (-) strand; PAM type: NRG; PAM sequence: GAG
gctgagggaggtagggaagg

SEQ ID NO: 7769 - DNA, 20 bp, Artificial Sequence
  Description of Artificial Sequence: Synthetic oligonucleotide
  Target: DMPK; (-) strand; PAM type: NRG; PAM sequence: GGG
gggctgagggaggtagggaa

SEQ ID NO: 7770 - DNA, 20 bp, Artificial Sequence
  Description of Artificial Sequence: Synthetic oligonucleotide
  Target: DMPK; (-) strand; PAM type: NRG; PAM sequence: AGG
ggggctgagggaggtaggga

SEQ ID NO: 7771 - DNA, 20 bp, Artificial Sequence
  Description of Artificial Sequence: Synthetic oligonucleotide
  Target: DMPK; (-) strand; PAM type: NRG; PAM sequence: AAG
tggggctgagggaggtaggg

SEQ ID NO: 7772 - DNA, 20 bp, Artificial Sequence
  Description of Artificial Sequence: Synthetic oligonucleotide
  Target: DMPK; (-) strand; PAM type: NRG; PAM sequence: GGG
ggatggggctgagggaggta

SEQ ID NO: 7773 - DNA, 20 bp, Artificial Sequence
  Description of Artificial Sequence: Synthetic oligonucleotide
  Target: DMPK; (-) strand; PAM type: NRG; PAM sequence: AGG
gggatggggctgagggaggt

SEQ ID NO: 7774 - DNA, 20 bp, Artificial Sequence
  Description of Artificial Sequence: Synthetic oligonucleotide
  Target: DMPK; (-) strand; PAM type: NRG; PAM sequence: TAG
agggatggggctgagggagg

SEQ ID NO: 7775 - DNA, 20 bp, Artificial Sequence
  Description of Artificial Sequence: Synthetic oligonucleotide
  Target: DMPK; (-) strand; PAM type: NRG; PAM sequence: AGG
ctcagggatggggctgaggg

SEQ ID NO: 7776 - DNA, 20 bp, Artificial Sequence
  Description of Artificial Sequence: Synthetic oligonucleotide
  Target: DMPK; (-) strand; PAM type: NRG; PAM sequence: GAG
actcagggatggggctgagg

SEQ ID NO: 7777 - DNA, 20 bp, Artificial Sequence
  Description of Artificial Sequence: Synthetic oligonucleotide
  Target: DMPK; (-) strand; PAM type: NRG; PAM sequence: GGG
agactcagggatggggctga

SEQ ID NO: 7778 - DNA, 20 bp, Artificial Sequence
  Description of Artificial Sequence: Synthetic oligonucleotide
  Target: DMPK; (-) strand; PAM type: NRG; PAM sequence: AGG
cagactcagggatggggctg

SEQ ID NO: 7779 - DNA, 20 bp, Artificial Sequence
  Description of Artificial Sequence: Synthetic oligonucleotide
  Target: DMPK; (-) strand; PAM type: NRG; PAM sequence: GAG
ccagactcagggatggggct

SEQ ID NO: 7780 - DNA, 20 bp, Artificial Sequence
  Description of Artificial Sequence: Synthetic oligonucleotide
  Target: DMPK; (-) strand; PAM type: NRG; PAM sequence: GGG
gaggaccagactcagggatg

SEQ ID NO: 7781 - DNA, 20 bp, Artificial Sequence
  Description of Artificial Sequence: Synthetic oligonucleotide
  Target: DMPK; (-) strand; PAM type: NRG; PAM sequence: GGG
agaggaccagactcagggat

SEQ ID NO: 7782 - DNA, 20 bp, Artificial Sequence
  Description of Artificial Sequence: Synthetic oligonucleotide
  Target: DMPK; (-) strand; PAM type: NRG; PAM sequence: TGG
tagaggaccagactcaggga

SEQ ID NO: 7783 - DNA, 20 bp, Artificial Sequence
  Description of Artificial Sequence: Synthetic oligonucleotide
  Target: DMPK; (-) strand; PAM type: NRG; PAM sequence: GGG
gatttagaggaccagactca

SEQ ID NO: 7784 - DNA, 20 bp, Artificial Sequence
  Description of Artificial Sequence: Synthetic oligonucleotide
  Target: DMPK; (-) strand; PAM type: NRG; PAM sequence: AGG
agatttagaggaccagactc

SEQ ID NO: 7785 - DNA, 20 bp, Artificial Sequence
  Description of Artificial Sequence: Synthetic oligonucleotide
  Target: DMPK; (-) strand; PAM type: NRG; PAM sequence: CAG
tagatttagaggaccagact

SEQ ID NO: 7786 - DNA, 20 bp, Artificial Sequence
  Description of Artificial Sequence: Synthetic oligonucleotide
  Target: DMPK; (-) strand; PAM type: NRG; PAM sequence: CAG
cctgtgtagatttagaggac

SEQ ID NO: 7787 - DNA, 20 bp, Artificial Sequence
  Description of Artificial Sequence: Synthetic oligonucleotide
  Target: DMPK; (-) strand; PAM type: NRG; PAM sequence: AGG
tggtccctgtgtagatttag

SEQ ID NO: 7788 - DNA, 20 bp, Artificial Sequence
  Description of Artificial Sequence: Synthetic oligonucleotide
  Target: DMPK; (-) strand; PAM type: NRG; PAM sequence: GAG
ctggtccctgtgtagattta

SEQ ID NO: 7789 - DNA, 20 bp, Artificial Sequence
  Description of Artificial Sequence: Synthetic oligonucleotide
  Target: DMPK; (-) strand; PAM type: NRG; PAM sequence: TAG
ctctggtccctgtgtagatt

SEQ ID NO: 7790 - DNA, 20 bp, Artificial Sequence
  Description of Artificial Sequence: Synthetic oligonucleotide
  Target: DMPK; (-) strand; PAM type: NRG; PAM sequence: TAG
ccagccctctggtccctgtg

SEQ ID NO: 7791 - DNA, 20 bp, Artificial Sequence
  Description of Artificial Sequence: Synthetic oligonucleotide
  Target: DMPK; (-) strand; PAM type: NRG; PAM sequence: TGG
gtgtttgagcaccagccctc

SEQ ID NO: 7792 - DNA, 20 bp, Artificial Sequence
  Description of Artificial Sequence: Synthetic oligonucleotide
  Target: DMPK; (-) strand; PAM type: NRG; PAM sequence: CAG
ttgtgttagtgtttgagcac

SEQ ID NO: 7793 - DNA, 20 bp, Artificial Sequence
  Description of Artificial Sequence: Synthetic oligonucleotide
  Target: DMPK; (-) strand; PAM type: NRG; PAM sequence: GAG
cataggttgtgttagtgttt

SEQ ID NO: 7794 - DNA, 20 bp, Artificial Sequence
  Description of Artificial Sequence: Synthetic oligonucleotide
  Target: DMPK; (-) strand; PAM type: NRG; PAM sequence: TAG
cagagggacataggttgtgt

SEQ ID NO: 7795 - DNA, 20 bp, Artificial Sequence
  Description of Artificial Sequence: Synthetic oligonucleotide
  Target: DMPK; (-) strand; PAM type: NRG; PAM sequence: AGG
tttgagcagcagagggacat

SEQ ID NO: 7796 - DNA, 20 bp, Artificial Sequence
  Description of Artificial Sequence: Synthetic oligonucleotide
  Target: DMPK; (-) strand; PAM type: NRG; PAM sequence: TAG
ttttgagcagcagagggaca

SEQ ID NO: 7797 - DNA, 20 bp, Artificial Sequence
  Description of Artificial Sequence: Synthetic oligonucleotide
  Target: DMPK; (-) strand; PAM type: NRG; PAM sequence: GGG
gagggattttgagcagcaga

SEQ ID NO: 7798 - DNA, 20 bp, Artificial Sequence
  Description of Artificial Sequence: Synthetic oligonucleotide
  Target: DMPK; (-) strand; PAM type: NRG; PAM sequence: AGG
ggagggattttgagcagcag

SEQ ID NO: 7799 - DNA, 20 bp, Artificial Sequence
  Description of Artificial Sequence: Synthetic oligonucleotide
  Target: DMPK; (-) strand; PAM type: NRG; PAM sequence: GAG
tggagggattttgagcagca

SEQ ID NO: 7800 - DNA, 20 bp, Artificial Sequence
  Description of Artificial Sequence: Synthetic oligonucleotide
  Target: DMPK; (-) strand; PAM type: NRG; PAM sequence: CAG
gctggagggattttgagcag

SEQ ID NO: 7801 - DNA, 20 bp, Artificial Sequence
  Description of Artificial Sequence: Synthetic oligonucleotide
  Target: DMPK; (-) strand; PAM type: NRG; PAM sequence: CAG
ggagctggagggattttgag

SEQ ID NO: 7802 - DNA, 20 bp, Artificial Sequence
  Description of Artificial Sequence: Synthetic oligonucleotide
  Target: DMPK; (-) strand; PAM type: NRG; PAM sequence: GAG
tagggagctggagggatttt

SEQ ID NO: 7803 - DNA, 20 bp, Artificial Sequence
  Description of Artificial Sequence: Synthetic oligonucleotide
  Target: DMPK; (-) strand; PAM type: NRG; PAM sequence: GGG
gagggcattagggagctgga

SEQ ID NO: 7804 - DNA, 20 bp, Artificial Sequence
  Description of Artificial Sequence: Synthetic oligonucleotide
  Target: DMPK; (-) strand; PAM type: NRG; PAM sequence: AGG
tgagggcattagggagctgg

SEQ ID NO: 7805 - DNA, 20 bp, Artificial Sequence
  Description of Artificial Sequence: Synthetic oligonucleotide
  Target: DMPK; (-) strand; PAM type: NRG; PAM sequence: GAG
gtgagggcattagggagctg

SEQ ID NO: 7806 - DNA, 20 bp, Artificial Sequence
  Description of Artificial Sequence: Synthetic oligonucleotide
  Target: DMPK; (-) strand; PAM type: NRG; PAM sequence: TGG
tcgtgagggcattagggagc

SEQ ID NO: 7807 - DNA, 20 bp, Artificial Sequence
  Description of Artificial Sequence: Synthetic oligonucleotide
  Target: DMPK; (-) strand; PAM type: NRG; PAM sequence: GAG
tttgtcgtgagggcattagg

SEQ ID NO: 7808 - DNA, 20 bp, Artificial Sequence
  Description of Artificial Sequence: Synthetic oligonucleotide
  Target: DMPK; (-) strand; PAM type: NRG; PAM sequence: GGG
cttttgtcgtgagggcatta

SEQ ID NO: 7809 - DNA, 20 bp, Artificial Sequence
  Description of Artificial Sequence: Synthetic oligonucleotide
  Target: DMPK; (-) strand; PAM type: NRG; PAM sequence: AGG
ccttttgtcgtgagggcatt

SEQ ID NO: 7810 - DNA, 20 bp, Artificial Sequence
  Description of Artificial Sequence: Synthetic oligonucleotide
  Target: DMPK; (-) strand; PAM type: NRG; PAM sequence: TAG
gccttttgtcgtgagggcat

SEQ ID NO: 7811 - DNA, 20 bp, Artificial Sequence
  Description of Artificial Sequence: Synthetic oligonucleotide
  Target: DMPK; (-) strand; PAM type: NRG; PAM sequence: GGG
agcaaggccttttgtcgtga

SEQ ID NO: 7812 - DNA, 20 bp, Artificial Sequence
  Description of Artificial Sequence: Synthetic oligonucleotide
  Target: DMPK; (-) strand; PAM type: NRG; PAM sequence: AGG
cagcaaggccttttgtcgtg

SEQ ID NO: 7813 - DNA, 20 bp, Artificial Sequence
  Description of Artificial Sequence: Synthetic oligonucleotide
  Target: DMPK; (-) strand; PAM type: NRG; PAM sequence: GAG
ccagcaaggccttttgtcgt

SEQ ID NO: 7814 - DNA, 20 bp, Artificial Sequence
  Description of Artificial Sequence: Synthetic oligonucleotide
  Target: DMPK; (-) strand; PAM type: NRG; PAM sequence: AGG
gcaggaaacaaaacccagca

SEQ ID NO: 7815 - DNA, 20 bp, Artificial Sequence
  Description of Artificial Sequence: Synthetic oligonucleotide
  Target: DMPK; (-) strand; PAM type: NRG; PAM sequence: AAG
agcaggaaacaaaacccagc

SEQ ID NO: 7816 - DNA, 20 bp, Artificial Sequence
  Description of Artificial Sequence: Synthetic oligonucleotide
  Target: DMPK; (-) strand; PAM type: NRG; PAM sequence: CAG
ggccagcaggaaacaaaacc

SEQ ID NO: 7817 - DNA, 20 bp, Artificial Sequence
  Description of Artificial Sequence: Synthetic oligonucleotide
  Target: DMPK; (-) strand; PAM type: NRG; PAM sequence: AGG
agaaggctggagaggccagc

SEQ ID NO: 7818 - DNA, 20 bp, Artificial Sequence
  Description of Artificial Sequence: Synthetic oligonucleotide
  Target: DMPK; (-) strand; PAM type: NRG; PAM sequence: CAG
gagaaggctggagaggccag

SEQ ID NO: 7819 - DNA, 20 bp, Artificial Sequence
  Description of Artificial Sequence: Synthetic oligonucleotide
  Target: DMPK; (-) strand; PAM type: NRG; PAM sequence: CAG
cctgagaaggctggagaggc

SEQ ID NO: 7820 - DNA, 20 bp, Artificial Sequence
  Description of Artificial Sequence: Synthetic oligonucleotide
  Target: DMPK; (-) strand; PAM type: NRG; PAM sequence: AGG
cattcctgagaaggctggag

SEQ ID NO: 7821 - DNA, 20 bp, Artificial Sequence
  Description of Artificial Sequence: Synthetic oligonucleotide
  Target: DMPK; (-) strand; PAM type: NRG; PAM sequence: GAG
tcattcctgagaaggctgga

SEQ ID NO: 7822 - DNA, 20 bp, Artificial Sequence
  Description of Artificial Sequence: Synthetic oligonucleotide
  Target: DMPK; (-) strand; PAM type: NRG; PAM sequence: GAG
aatcattcctgagaaggctg

SEQ ID NO: 7823 - DNA, 20 bp, Artificial Sequence
  Description of Artificial Sequence: Synthetic oligonucleotide
  Target: DMPK; (-) strand; PAM type: NRG; PAM sequence: TGG
tgaatcattcctgagaaggc

SEQ ID NO: 7824 - DNA, 20 bp, Artificial Sequence
  Description of Artificial Sequence: Synthetic oligonucleotide
  Target: DMPK; (-) strand; PAM type: NRG; PAM sequence: AGG
tggctgaatcattcctgaga

SEQ ID NO: 7825 - DNA, 20 bp, Artificial Sequence
  Description of Artificial Sequence: Synthetic oligonucleotide
  Target: DMPK; (-) strand; PAM type: NRG; PAM sequence: AAG
ttggctgaatcattcctgag

SEQ ID NO: 7826 - DNA, 20 bp, Artificial Sequence
  Description of Artificial Sequence: Synthetic oligonucleotide
  Target: DMPK; (-) strand; PAM type: NRG; PAM sequence: GAG
agtttggctgaatcattcct

SEQ ID NO: 7827 - DNA, 20 bp, Artificial Sequence
  Description of Artificial Sequence: Synthetic oligonucleotide
  Target: DMPK; (-) strand; PAM type: NRG; PAM sequence: TGG
tttgttcctgaaaggtagtt

SEQ ID NO: 7828 - DNA, 20 bp, Artificial Sequence
  Description of Artificial Sequence: Synthetic oligonucleotide
  Target: DMPK; (-) strand; PAM type: NRG; PAM sequence: TAG
cctgatttgttcctgaaagg

SEQ ID NO: 7829 - DNA, 20 bp, Artificial Sequence
  Description of Artificial Sequence: Synthetic oligonucleotide
  Target: DMPK; (-) strand; PAM type: NRG; PAM sequence: AGG
aatcctgatttgttcctgaa

SEQ ID NO: 7830 - DNA, 20 bp, Artificial Sequence
  Description of Artificial Sequence: Synthetic oligonucleotide
  Target: DMPK; (-) strand; PAM type: NRG; PAM sequence: AAG
gaatcctgatttgttcctga

SEQ ID NO: 7831 - DNA, 20 bp, Artificial Sequence
  Description of Artificial Sequence: Synthetic oligonucleotide
  Target: DMPK; (-) strand; PAM type: NRG; PAM sequence: GGG
ggcaaaggccttgggcaggt

SEQ ID NO: 7832 - DNA, 20 bp, Artificial Sequence
  Description of Artificial Sequence: Synthetic oligonucleotide
  Target: DMPK; (-) strand; PAM type: NRG; PAM sequence: TGG
gggcaaaggccttgggcagg

SEQ ID NO: 7833 - DNA, 20 bp, Artificial Sequence
  Description of Artificial Sequence: Synthetic oligonucleotide
  Target: DMPK; (-) strand; PAM type: NRG; PAM sequence: AGG
ccagggcaaaggccttgggc

SEQ ID NO: 7834 - DNA, 20 bp, Artificial Sequence
  Description of Artificial Sequence: Synthetic oligonucleotide
  Target: DMPK; (-) strand; PAM type: NRG; PAM sequence: CAG
tccagggcaaaggccttggg

SEQ ID NO: 7835 - DNA, 20 bp, Artificial Sequence
  Description of Artificial Sequence: Synthetic oligonucleotide
  Target: DMPK; (-) strand; PAM type: NRG; PAM sequence: GGG
gcctccagggcaaaggcctt

SEQ ID NO: 7836 - DNA, 20 bp, Artificial Sequence
  Description of Artificial Sequence: Synthetic oligonucleotide
  Target: DMPK; (-) strand; PAM type: NRG; PAM sequence: TGG
agcctccagggcaaaggcct

SEQ ID NO: 7837 - DNA, 20 bp, Artificial Sequence
  Description of Artificial Sequence: Synthetic oligonucleotide
  Target: DMPK; (-) strand; PAM type: NRG; PAM sequence: AGG
ggcgagagcctccagggcaa

SEQ ID NO: 7838 - DNA, 20 bp, Artificial Sequence
  Description of Artificial Sequence: Synthetic oligonucleotide
  Target: DMPK; (-) strand; PAM type: NRG; PAM sequence: AAG
aggcgagagcctccagggca

SEQ ID NO: 7839 - DNA, 20 bp, Artificial Sequence
  Description of Artificial Sequence: Synthetic oligonucleotide
  Target: DMPK; (-) strand; PAM type: NRG; PAM sequence: GGG
tggtcaggcgagagcctcca

SEQ ID NO: 7840 - DNA, 20 bp, Artificial Sequence
  Description of Artificial Sequence: Synthetic oligonucleotide
  Target: DMPK; (-) strand; PAM type: NRG; PAM sequence: AGG
gtggtcaggcgagagcctcc

SEQ ID NO: 7841 - DNA, 20 bp, Artificial Sequence
  Description of Artificial Sequence: Synthetic oligonucleotide
  Target: DMPK; (-) strand; PAM type: NRG; PAM sequence: CAG
agtggtcaggcgagagcctc

SEQ ID NO: 7842 - DNA, 20 bp, Artificial Sequence
  Description of Artificial Sequence: Synthetic oligonucleotide
  Target: DMPK; (-) strand; PAM type: NRG; PAM sequence: GAG
ggtgccaagtggtcaggcga

SEQ ID NO: 7843 - DNA, 20 bp, Artificial Sequence
  Description of Artificial Sequence: Synthetic oligonucleotide
  Target: DMPK; (-) strand; PAM type: NRG; PAM sequence: GAG
aaggtgccaagtggtcaggc

SEQ ID NO: 7844 - DNA, 20 bp, Artificial Sequence
  Description of Artificial Sequence: Synthetic oligonucleotide
  Target: DMPK; (-) strand; PAM type: NRG; PAM sequence: AGG
aggaaaggtgccaagtggtc

SEQ ID NO: 7845 - DNA, 20 bp, Artificial Sequence
  Description of Artificial Sequence: Synthetic oligonucleotide
  Target: DMPK; (-) strand; PAM type: NRG; PAM sequence: CAG
aaggaaaggtgccaagtggt

SEQ ID NO: 7846 - DNA, 20 bp, Artificial Sequence
  Description of Artificial Sequence: Synthetic oligonucleotide
  Target: DMPK; (-) strand; PAM type: NRG; PAM sequence: TGG
atggaaggaaaggtgccaag

SEQ ID NO: 7847 - DNA, 20 bp, Artificial Sequence
  Description of Artificial Sequence: Synthetic oligonucleotide
  Target: DMPK; (-) strand; PAM type: NRG; PAM sequence: AAG
gccatggaaggaaaggtgcc

SEQ ID NO: 7848 - DNA, 20 bp, Artificial Sequence
  Description of Artificial Sequence: Synthetic oligonucleotide
  Target: DMPK; (-) strand; PAM type: NRG; PAM sequence: AGG
gaaacaagccatggaaggaa

SEQ ID NO: 7849 - DNA, 20 bp, Artificial Sequence
  Description of Artificial Sequence: Synthetic oligonucleotide
  Target: DMPK; (-) strand; PAM type: NRG; PAM sequence: AAG
agaaacaagccatggaagga

SEQ ID NO: 7850 - DNA, 20 bp, Artificial Sequence
  Description of Artificial Sequence: Synthetic oligonucleotide
  Target: DMPK; (-) strand; PAM type: NRG; PAM sequence: AGG
aaggagaaacaagccatgga

SEQ ID NO: 7851 - DNA, 20 bp, Artificial Sequence
  Description of Artificial Sequence: Synthetic oligonucleotide
  Target: DMPK; (-) strand; PAM type: NRG; PAM sequence: AAG
gaaggagaaacaagccatgg

SEQ ID NO: 7852 - DNA, 20 bp, Artificial Sequence
  Description of Artificial Sequence: Synthetic oligonucleotide
  Target: DMPK; (-) strand; PAM type: NRG; PAM sequence: TGG
ggtgaaggagaaacaagcca

SEQ ID NO: 7853 - DNA, 20 bp, Artificial Sequence
  Description of Artificial Sequence: Synthetic oligonucleotide
  Target: DMPK; (-) strand; PAM type: NRG; PAM sequence: AAG
agcgctggtgaaggagaaac

SEQ ID NO: 7854 - DNA, 20 bp, Artificial Sequence
  Description of Artificial Sequence: Synthetic oligonucleotide
  Target: DMPK; (-) strand; PAM type: NRG; PAM sequence: GAG
tgagctgagcgctggtgaag

SEQ ID NO: 7855 - DNA, 20 bp, Artificial Sequence
  Description of Artificial Sequence: Synthetic oligonucleotide
  Target: DMPK; (-) strand; PAM type: NRG; PAM sequence: AGG
tttgagctgagcgctggtga

SEQ ID NO: 7856 - DNA, 20 bp, Artificial Sequence
  Description of Artificial Sequence: Synthetic oligonucleotide
  Target: DMPK; (-) strand; PAM type: NRG; PAM sequence: AAG
ctttgagctgagcgctggtg

SEQ ID NO: 7857 - DNA, 20 bp, Artificial Sequence
  Description of Artificial Sequence: Synthetic oligonucleotide
  Target: DMPK; (-) strand; PAM type: NRG; PAM sequence: TGG
tcgatctttgagctgagcgc

SEQ ID NO: 7858 - DNA, 20 bp, Artificial Sequence
  Description of Artificial Sequence: Synthetic oligonucleotide
  Target: DMPK; (-) strand; PAM type: NRG; PAM sequence: GAG
gagaagtcgatctttgagct

SEQ ID NO: 7859 - DNA, 20 bp, Artificial Sequence
  Description of Artificial Sequence: Synthetic oligonucleotide
  Target: DMPK; (-) strand; PAM type: NRG; PAM sequence: GAG
gatctgagaagtcgatcttt

SEQ ID NO: 7860 - DNA, 20 bp, Artificial Sequence
  Description of Artificial Sequence: Synthetic oligonucleotide
  Target: DMPK; (-) strand; PAM type: NRG; PAM sequence: AAG
tgtgttgctggggatctgag

SEQ ID NO: 7861 - DNA, 20 bp, Artificial Sequence
  Description of Artificial Sequence: Synthetic oligonucleotide
  Target: DMPK; (-) strand; PAM type: NRG; PAM sequence: GAG
gtgtgtgttgctggggatct

SEQ ID NO: 7862 - DNA, 20 bp, Artificial Sequence
  Description of Artificial Sequence: Synthetic oligonucleotide
  Target: DMPK; (-) strand; PAM type: NRG; PAM sequence: GGG
taagggtgtgtgtgttgctg

SEQ ID NO: 7863 - DNA, 20 bp, Artificial Sequence
  Description of Artificial Sequence: Synthetic oligonucleotide
  Target: DMPK; (-) strand; PAM type: NRG; PAM sequence: GGG
gtaagggtgtgtgtgttgct

SEQ ID NO: 7864 - DNA, 20 bp, Artificial Sequence
  Description of Artificial Sequence: Synthetic oligonucleotide
  Target: DMPK; (-) strand; PAM type: NRG; PAM sequence: TGG
agtaagggtgtgtgtgttgc

SEQ ID NO: 7865 - DNA, 20 bp, Artificial Sequence
  Description of Artificial Sequence: Synthetic oligonucleotide
  Target: DMPK; (-) strand; PAM type: NRG; PAM sequence: GGG
tacagtggggcattaagtaa

SEQ ID NO: 7866 - DNA, 20 bp, Artificial Sequence
  Description of Artificial Sequence: Synthetic oligonucleotide
  Target: DMPK; (-) strand; PAM type: NRG; PAM sequence: AGG
ttacagtggggcattaagta

SEQ ID NO: 7867 - DNA, 20 bp, Artificial Sequence
  Description of Artificial Sequence: Synthetic oligonucleotide
  Target: DMPK; (-) strand; PAM type: NRG; PAM sequence: AAG
gttacagtggggcattaagt

SEQ ID NO: 7868 - DNA, 20 bp, Artificial Sequence
  Description of Artificial Sequence: Synthetic oligonucleotide
  Target: DMPK; (-) strand; PAM type: NRG; PAM sequence: AAG
tgtagttacagtggggcatt

SEQ ID NO: 7869 - DNA, 20 bp, Artificial Sequence
  Description of Artificial Sequence: Synthetic oligonucleotide
  Target: DMPK; (-) strand; PAM type: NRG; PAM sequence: GGG
cggtctctgtagttacagtg

SEQ ID NO: 7870 - DNA, 20 bp, Artificial Sequence
  Description of Artificial Sequence: Synthetic oligonucleotide
  Target: DMPK; (-) strand; PAM type: NRG; PAM sequence: GGG
acggtctctgtagttacagt

SEQ ID NO: 7871 - DNA, 20 bp, Artificial Sequence
  Description of Artificial Sequence: Synthetic oligonucleotide
  Target: DMPK; (-) strand; PAM type: NRG; PAM sequence: TGG
gacggtctctgtagttacag

SEQ ID NO: 7872 - DNA, 20 bp, Artificial Sequence
  Description of Artificial Sequence: Synthetic oligonucleotide
  Target: DMPK; (-) strand; PAM type: NRG; PAM sequence: CAG
tgggacggtctctgtagtta

SEQ ID NO: 7873 - DNA, 20 bp, Artificial Sequence
  Description of Artificial Sequence: Synthetic oligonucleotide
  Target: DMPK; (-) strand; PAM type: NRG; PAM sequence: TAG
cagacatgggacggtctctg

SEQ ID NO: 7874 - DNA, 20 bp, Artificial Sequence
  Description of Artificial Sequence: Synthetic oligonucleotide
  Target: DMPK; (-) strand; PAM type: NRG; PAM sequence: CGG
aggttacttcagacatggga

SEQ ID NO: 7875 - DNA, 20 bp, Artificial Sequence
  Description of Artificial Sequence: Synthetic oligonucleotide
  Target: DMPK; (-) strand; PAM type: NRG; PAM sequence: GGG
gacgaggttacttcagacat

SEQ ID NO: 7876 - DNA, 20 bp, Artificial Sequence
  Description of Artificial Sequence: Synthetic oligonucleotide
  Target: DMPK; (-) strand; PAM type: NRG; PAM sequence: TGG
agacgaggttacttcagaca

SEQ ID NO: 7877 - DNA, 20 bp, Artificial Sequence
  Description of Artificial Sequence: Synthetic oligonucleotide
  Target: DMPK; (-) strand; PAM type: NRG; PAM sequence: CAG
acggagagacgaggttactt

SEQ ID NO: 7878 - DNA, 20 bp, Artificial Sequence
  Description of Artificial Sequence: Synthetic oligonucleotide
  Target: DMPK; (-) strand; PAM type: NRG; PAM sequence: AGG
acagaaaccacggagagacg

SEQ ID NO: 7879 - DNA, 20 bp, Artificial Sequence
  Description of Artificial Sequence: Synthetic oligonucleotide
  Target: DMPK; (-) strand; PAM type: NRG; PAM sequence: GAG
gacagaaaccacggagagac

SEQ ID NO: 7880 - DNA, 20 bp, Artificial Sequence
  Description of Artificial Sequence: Synthetic oligonucleotide
  Target: DMPK; (-) strand; PAM type: NRG; PAM sequence: GAG
aagcagacagaaaccacgga

SEQ ID NO: 7881 - DNA, 20 bp, Artificial Sequence
  Description of Artificial Sequence: Synthetic oligonucleotide
  Target: DMPK; (-) strand; PAM type: NRG; PAM sequence: GAG
agaagcagacagaaaccacg

SEQ ID NO: 7882 - DNA, 20 bp, Artificial Sequence
  Description of Artificial Sequence: Synthetic oligonucleotide
  Target: DMPK; (-) strand; PAM type: NRG; PAM sequence: CGG
acagaagcagacagaaacca

SEQ ID NO: 7883 - DNA, 20 bp, Artificial Sequence
  Description of Artificial Sequence: Synthetic oligonucleotide
  Target: DMPK; (-) strand; PAM type: NRG; PAM sequence: CAG
acttcctgaacagaagcaga

SEQ ID NO: 7884 - DNA, 20 bp, Artificial Sequence
  Description of Artificial Sequence: Synthetic oligonucleotide
  Target: DMPK; (-) strand; PAM type: NRG; PAM sequence: CAG
agggacttcctgaacagaag

SEQ ID NO: 7885 - DNA, 20 bp, Artificial Sequence
  Description of Artificial Sequence: Synthetic oligonucleotide
  Target: DMPK; (-) strand; PAM type: NRG; PAM sequence: AAG
tctagggacttcctgaacag

SEQ ID NO: 7886 - DNA, 20 bp, Artificial Sequence
  Description of Artificial Sequence: Synthetic oligonucleotide
  Target: DMPK; (-) strand; PAM type: NRG; PAM sequence: CAG
ccctctagggacttcctgaa

SEQ ID NO: 7887 - DNA, 20 bp, Artificial Sequence
  Description of Artificial Sequence: Synthetic oligonucleotide
  Target: DMPK; (-) strand; PAM type: NRG; PAM sequence: GGG
gtgcactgtagagccctcta

SEQ ID NO: 7888 - DNA, 20 bp, Artificial Sequence
  Description of Artificial Sequence: Synthetic oligonucleotide
  Target: DMPK; (-) strand; PAM type: NRG; PAM sequence: AGG
cgtgcactgtagagccctct

SEQ ID NO: 7889 - DNA, 20 bp, Artificial Sequence
  Description of Artificial Sequence: Synthetic oligonucleotide
  Target: DMPK; (-) strand; PAM type: NRG; PAM sequence: TAG
gcgtgcactgtagagccctc

SEQ ID NO: 7890 - DNA, 20 bp, Artificial Sequence
  Description of Artificial Sequence: Synthetic oligonucleotide
  Target: DMPK; (-) strand; PAM type: NRG; PAM sequence: GAG
cccgggtggcgtgcactgta

SEQ ID NO: 7891 - DNA, 20 bp, Artificial Sequence
  Description of Artificial Sequence: Synthetic oligonucleotide
  Target: DMPK; (-) strand; PAM type: NRG; PAM sequence: TAG
ttcccgggtggcgtgcactg

SEQ ID NO: 7892 - DNA, 20 bp, Artificial Sequence
  Description of Artificial Sequence: Synthetic oligonucleotide
  Target: DMPK; (-) strand; PAM type: NRG; PAM sequence: TGG
aaaggtgagggcttcccggg

SEQ ID NO: 7893 - DNA, 20 bp, Artificial Sequence
  Description of Artificial Sequence: Synthetic oligonucleotide
  Target: DMPK; (-) strand; PAM type: NRG; PAM sequence: GGG
agaaaaggtgagggcttccc

SEQ ID NO: 7894 - DNA, 20 bp, Artificial Sequence
  Description of Artificial Sequence: Synthetic oligonucleotide
  Target: DMPK; (-) strand; PAM type: NRG; PAM sequence: CGG
gagaaaaggtgagggcttcc

SEQ ID NO: 7895 - DNA, 20 bp, Artificial Sequence
  Description of Artificial Sequence: Synthetic oligonucleotide
  Target: DMPK; (-) strand; PAM type: NRG; PAM sequence: GGG
aattgggagagaaaaggtga

SEQ ID NO: 7896 - DNA, 20 bp, Artificial Sequence
  Description of Artificial Sequence: Synthetic oligonucleotide
  Target: DMPK; (-) strand; PAM type: NRG; PAM sequence: AGG
caattgggagagaaaaggtg

SEQ ID NO: 7897 - DNA, 20 bp, Artificial Sequence
  Description of Artificial Sequence: Synthetic oligonucleotide
  Target: DMPK; (-) strand; PAM type: NRG; PAM sequence: GAG
acaattgggagagaaaaggt

SEQ ID NO: 7898 - DNA, 20 bp, Artificial Sequence
  Description of Artificial Sequence: Synthetic oligonucleotide
  Target: DMPK; (-) strand; PAM type: NRG; PAM sequence: AGG
agggacaattgggagagaaa

SEQ ID NO: 7899 - DNA, 20 bp, Artificial Sequence
  Description of Artificial Sequence: Synthetic oligonucleotide
  Target: DMPK; (-) strand; PAM type: NRG; PAM sequence: AAG
cagggacaattgggagagaa

SEQ ID NO: 7900 - DNA, 20 bp, Artificial Sequence
  Description of Artificial Sequence: Synthetic oligonucleotide
  Target: DMPK; (-) strand; PAM type: NRG; PAM sequence: GAG
tccgtcagggacaattggga

SEQ ID NO: 7901 - DNA, 20 bp, Artificial Sequence
  Description of Artificial Sequence: Synthetic oligonucleotide
  Target: DMPK; (-) strand; PAM type: NRG; PAM sequence: GAG
ggtccgtcagggacaattgg

SEQ ID NO: 7902 - DNA, 20 bp, Artificial Sequence
  Description of Artificial Sequence: Synthetic oligonucleotide
  Target: DMPK; (-) strand; PAM type: NRG; PAM sequence: GGG
ggggtccgtcagggacaatt

SEQ ID NO: 7903 - DNA, 20 bp, Artificial Sequence
  Description of Artificial Sequence: Synthetic oligonucleotide
  Target: DMPK; (-) strand; PAM type: NRG; PAM sequence: TGG
gggggtccgtcagggacaat

SEQ ID NO: 7904 - DNA, 20 bp, Artificial Sequence
  Description of Artificial Sequence: Synthetic oligonucleotide
  Target: DMPK; (-) strand; PAM type: NRG; PAM sequence: GGG
ggaggggagggggtccgtca

SEQ ID NO: 7905 - DNA, 20 bp, Artificial Sequence
  Description of Artificial Sequence: Synthetic oligonucleotide
  Target: DMPK; (-) strand; PAM type: NRG; PAM sequence: AGG
tggaggggagggggtccgtc

SEQ ID NO: 7906 - DNA, 20 bp, Artificial Sequence
  Description of Artificial Sequence: Synthetic oligonucleotide
  Target: DMPK; (-) strand; PAM type: NRG; PAM sequence: CAG
gtggaggggagggggtccgt

SEQ ID NO: 7907 - DNA, 20 bp, Artificial Sequence
  Description of Artificial Sequence: Synthetic oligonucleotide
  Target: DMPK; (-) strand; PAM type: NRG; PAM sequence: GGG
gtaagttggtggaggggagg

SEQ ID NO: 7908 - DNA, 20 bp, Artificial Sequence
  Description of Artificial Sequence: Synthetic oligonucleotide
  Target: DMPK; (-) strand; PAM type: NRG; PAM sequence: GGG
agtaagttggtggaggggag

SEQ ID NO: 7909 - DNA, 20 bp, Artificial Sequence
  Description of Artificial Sequence: Synthetic oligonucleotide
  Target: DMPK; (-) strand; PAM type: NRG; PAM sequence: GGG
cagtaagttggtggagggga

SEQ ID NO: 7910 - DNA, 20 bp, Artificial Sequence
  Description of Artificial Sequence: Synthetic oligonucleotide
  Target: DMPK; (-) strand; PAM type: NRG; PAM sequence: AGG
acagtaagttggtggagggg

SEQ ID NO: 7911 - DNA, 20 bp, Artificial Sequence
  Description of Artificial Sequence: Synthetic oligonucleotide
  Target: DMPK; (-) strand; PAM type: NRG; PAM sequence: GAG
aacagtaagttggtggaggg

SEQ ID NO: 7912 - DNA, 20 bp, Artificial Sequence
  Description of Artificial Sequence: Synthetic oligonucleotide
  Target: DMPK; (-) strand; PAM type: NRG; PAM sequence: GGG
gaaacagtaagttggtggag

SEQ ID NO: 7913 - DNA, 20 bp, Artificial Sequence
  Description of Artificial Sequence: Synthetic oligonucleotide
  Target: DMPK; (-) strand; PAM type: NRG; PAM sequence: GGG
tgaaacagtaagttggtgga

SEQ ID NO: 7914 - DNA, 20 bp, Artificial Sequence
  Description of Artificial Sequence: Synthetic oligonucleotide
  Target: DMPK; (-) strand; PAM type: NRG; PAM sequence: AGG
atgaaacagtaagttggtgg

SEQ ID NO: 7915 - DNA, 20 bp, Artificial Sequence
  Description of Artificial Sequence: Synthetic oligonucleotide
  Target: DMPK; (-) strand; PAM type: NRG; PAM sequence: GAG
gatgaaacagtaagttggtg

SEQ ID NO: 7916 - DNA, 20 bp, Artificial Sequence
  Description of Artificial Sequence: Synthetic oligonucleotide
  Target: DMPK; (-) strand; PAM type: NRG; PAM sequence: TGG
aggatgaaacagtaagttgg

SEQ ID NO: 7917 - DNA, 20 bp, Artificial Sequence
  Description of Artificial Sequence: Synthetic oligonucleotide
  Target: DMPK; (-) strand; PAM type: NRG; PAM sequence: TGG
cacaggatgaaacagtaagt

SEQ ID NO: 7918 - DNA, 20 bp, Artificial Sequence
  Description of Artificial Sequence: Synthetic oligonucleotide
  Target: DMPK; (-) strand; PAM type: NRG; PAM sequence: AAG
tccccacaggatgaaacagt

SEQ ID NO: 7919 - DNA, 20 bp, Artificial Sequence
  Description of Artificial Sequence: Synthetic oligonucleotide
  Target: DMPK; (-) strand; PAM type: NRG; PAM sequence: CAG
ggtgtccccacaggatgaaa

SEQ ID NO: 7920 - DNA, 20 bp, Artificial Sequence
  Description of Artificial Sequence: Synthetic oligonucleotide
  Target: DMPK; (-) strand; PAM type: NRG; PAM sequence: AGG
ggagccctcggtgtccccac

SEQ ID NO: 7921 - DNA, 20 bp, Artificial Sequence
  Description of Artificial Sequence: Synthetic oligonucleotide
  Target: DMPK; (-) strand; PAM type: NRG; PAM sequence: CAG
tggagccctcggtgtcccca

SEQ ID NO: 7922 - DNA, 20 bp, Artificial Sequence
  Description of Artificial Sequence: Synthetic oligonucleotide
  Target: DMPK; (-) strand; PAM type: NRG; PAM sequence: CGG
agcgcccagcctggagccct

SEQ ID NO: 7923 - DNA, 20 bp, Artificial Sequence
  Description of Artificial Sequence: Synthetic oligonucleotide
  Target: DMPK; (-) strand; PAM type: NRG; PAM sequence: GAG
acgtgcaagcgcccagcctg

SEQ ID NO: 7924 - DNA, 20 bp, Artificial Sequence
  Description of Artificial Sequence: Synthetic oligonucleotide
  Target: DMPK; (-) strand; PAM type: NRG; PAM sequence: TGG
acacgtgcaagcgcccagcc

SEQ ID NO: 7925 - DNA, 20 bp, Artificial Sequence
  Description of Artificial Sequence: Synthetic oligonucleotide
  Target: DMPK; (-) strand; PAM type: NRG; PAM sequence: CAG
gagccacacgtgcaagcgcc

SEQ ID NO: 7926 - DNA, 20 bp, Artificial Sequence
  Description of Artificial Sequence: Synthetic oligonucleotide
  Target: DMPK; (-) strand; PAM type: NRG; PAM sequence: AAG
gctgcttgagccacacgtgc

SEQ ID NO: 7927 - DNA, 20 bp, Artificial Sequence
  Description of Artificial Sequence: Synthetic oligonucleotide
  Target: DMPK; (-) strand; PAM type: NRG; PAM sequence: GAG
tggaggccgagcagctgctt

SEQ ID NO: 7928 - DNA, 20 bp, Artificial Sequence
  Description of Artificial Sequence: Synthetic oligonucleotide
  Target: DMPK; (-) strand; PAM type: NRG; PAM sequence: CAG
ccatggaactggaggccgag

SEQ ID NO: 7929 - DNA, 20 bp, Artificial Sequence
  Description of Artificial Sequence: Synthetic oligonucleotide
  Target: DMPK; (-) strand; PAM type: NRG; PAM sequence: GAG
cacccatggaactggaggcc

SEQ ID NO: 7930 - DNA, 20 bp, Artificial Sequence
  Description of Artificial Sequence: Synthetic oligonucleotide
  Target: DMPK; (-) strand; PAM type: NRG; PAM sequence: AGG
ccccacacccatggaactgg

SEQ ID NO: 7931 - DNA, 20 bp, Artificial Sequence
  Description of Artificial Sequence: Synthetic oligonucleotide
  Target: DMPK; (-) strand; PAM type: NRG; PAM sequence: GAG
gccccacacccatggaactg

SEQ ID NO: 7932 - DNA, 20 bp, Artificial Sequence
  Description of Artificial Sequence: Synthetic oligonucleotide
  Target: DMPK; (-) strand; PAM type: NRG; PAM sequence: TGG
aggccccacacccatggaac

SEQ ID NO: 7933 - DNA, 20 bp, Artificial Sequence
  Description of Artificial Sequence: Synthetic oligonucleotide
  Target: DMPK; (-) strand; PAM type: NRG; PAM sequence: TGG
ggtcccaggccccacaccca

SEQ ID NO: 7934 - DNA, 20 bp, Artificial Sequence
  Description of Artificial Sequence: Synthetic oligonucleotide
  Target: DMPK; (-) strand; PAM type: NRG; PAM sequence: AGG
cccagggacagtgaggtccc

SEQ ID NO: 7935 - DNA, 20 bp, Artificial Sequence
  Description of Artificial Sequence: Synthetic oligonucleotide
  Target: DMPK; (-) strand; PAM type: NRG; PAM sequence: CAG
ccccagggacagtgaggtcc

SEQ ID NO: 7936 - DNA, 20 bp, Artificial Sequence
  Description of Artificial Sequence: Synthetic oligonucleotide
  Target: DMPK; (-) strand; PAM type: NRG; PAM sequence: AGG
tcctctccccagggacagtg

SEQ ID NO: 7937 - DNA, 20 bp, Artificial Sequence
  Description of Artificial Sequence: Synthetic oligonucleotide
  Target: DMPK; (-) strand; PAM type: NRG; PAM sequence: GAG
ctcctctccccagggacagt

SEQ ID NO: 7938 - DNA, 20 bp, Artificial Sequence
  Description of Artificial Sequence: Synthetic oligonucleotide
  Target: DMPK; (-) strand; PAM type: NRG; PAM sequence: CAG
cctcctcctctccccaggga

SEQ ID NO: 7939 - DNA, 20 bp, Artificial Sequence
  Description of Artificial Sequence: Synthetic oligonucleotide
  Target: DMPK; (-) strand; PAM type: NRG; PAM sequence: GGG
actccctcctcctctcccca

SEQ ID NO: 7940 - DNA, 20 bp, Artificial Sequence
  Description of Artificial Sequence: Synthetic oligonucleotide
  Target: DMPK; (-) strand; PAM type: NRG; PAM sequence: AGG
cactccctcctcctctcccc

SEQ ID NO: 7941 - DNA, 20 bp, Artificial Sequence
  Description of Artificial Sequence: Synthetic oligonucleotide
  Target: DMPK; (-) strand; PAM type: NRG; PAM sequence: CAG
ccactccctcctcctctccc

SEQ ID NO: 7942 - DNA, 20 bp, Artificial Sequence
  Description of Artificial Sequence: Synthetic oligonucleotide
  Target: DMPK; (-) strand; PAM type: NRG; PAM sequence: CAG
ctggttctccaccagagaat

SEQ ID NO: 7943 - DNA, 20 bp, Artificial Sequence
  Description of Artificial Sequence: Synthetic oligonucleotide
  Target: DMPK; (-) strand; PAM type: NRG; PAM sequence: GAG
gaagttctggttctccacca

SEQ ID NO: 7944 - DNA, 20 bp, Artificial Sequence
  Description of Artificial Sequence: Synthetic oligonucleotide
  Target: DMPK; (-) strand; PAM type: NRG; PAM sequence: CAG
cagaagttctggttctccac

SEQ ID NO: 7945 - DNA, 20 bp, Artificial Sequence
  Description of Artificial Sequence: Synthetic oligonucleotide
  Target: DMPK; (-) strand; PAM type: NRG; PAM sequence: TGG
tacccacaggccagaagttc

SEQ ID NO: 7946 - DNA, 20 bp, Artificial Sequence
  Description of Artificial Sequence: Synthetic oligonucleotide
  Target: DMPK; (-) strand; PAM type: NRG; PAM sequence: AAG
tgcccctacccacaggccag

SEQ ID NO: 7947 - DNA, 20 bp, Artificial Sequence
  Description of Artificial Sequence: Synthetic oligonucleotide
  Target: DMPK; (-) strand; PAM type: NRG; PAM sequence: CAG
agctgcccctacccacaggc

SEQ ID NO: 7948 - DNA, 20 bp, Artificial Sequence
  Description of Artificial Sequence: Synthetic oligonucleotide
  Target: DMPK; (-) strand; PAM type: NRG; PAM sequence: AGG
aagcagctgcccctacccac

SEQ ID NO: 7949 - DNA, 20 bp, Artificial Sequence
  Description of Artificial Sequence: Synthetic oligonucleotide
  Target: DMPK; (-) strand; PAM type: NRG; PAM sequence: CAG
gaagcagctgcccctaccca

SEQ ID NO: 7950 - DNA, 20 bp, Artificial Sequence
  Description of Artificial Sequence: Synthetic oligonucleotide
  Target: DMPK; (-) strand; PAM type: NRG; PAM sequence: CAG
aaatcaggaggtcttggaag

SEQ ID NO: 7951 - DNA, 20 bp, Artificial Sequence
  Description of Artificial Sequence: Synthetic oligonucleotide
  Target: DMPK; (-) strand; PAM type: NRG; PAM sequence: AAG
ctcaaatcaggaggtcttgg

SEQ ID NO: 7952 - DNA, 20 bp, Artificial Sequence
  Description of Artificial Sequence: Synthetic oligonucleotide
  Target: DMPK; (-) strand; PAM type: NRG; PAM sequence: TGG
ttcctcaaatcaggaggtct

SEQ ID NO: 7953 - DNA, 20 bp, Artificial Sequence
  Description of Artificial Sequence: Synthetic oligonucleotide
  Target: DMPK; (-) strand; PAM type: NRG; PAM sequence: AGG
ctccccttcctcaaatcagg

SEQ ID NO: 7954 - DNA, 20 bp, Artificial Sequence
  Description of Artificial Sequence: Synthetic oligonucleotide
  Target: DMPK; (-) strand; PAM type: NRG; PAM sequence: GAG
gctccccttcctcaaatcag

SEQ ID NO: 7955 - DNA, 20 bp, Artificial Sequence
  Description of Artificial Sequence: Synthetic oligonucleotide
  Target: DMPK; (-) strand; PAM type: NRG; PAM sequence: AGG
ctgctccccttcctcaaatc

SEQ ID NO: 7956 - DNA, 20 bp, Artificial Sequence
  Description of Artificial Sequence: Synthetic oligonucleotide
  Target: DMPK; (-) strand; PAM type: NRG; PAM sequence: CAG
gctgctccccttcctcaaat

SEQ ID NO: 7957 - DNA, 20 bp, Artificial Sequence
  Description of Artificial Sequence: Synthetic oligonucleotide
  Target: DMPK; (-) strand; PAM type: NRG; PAM sequence: GGG
gaggggctattggcctacct

SEQ ID NO: 7958 - DNA, 20 bp, Artificial Sequence
  Description of Artificial Sequence: Synthetic oligonucleotide
  Target: DMPK; (-) strand; PAM type: NRG; PAM sequence: TGG
ggaggggctattggcctacc

SEQ ID NO: 7959 - DNA, 20 bp, Artificial Sequence
  Description of Artificial Sequence: Synthetic oligonucleotide
  Target: DMPK; (-) strand; PAM type: NRG; PAM sequence: TGG
ctaagcagaggaggggctat

SEQ ID NO: 7960 - DNA, 20 bp, Artificial Sequence
  Description of Artificial Sequence: Synthetic oligonucleotide
  Target: DMPK; (-) strand; PAM type: NRG; PAM sequence: GGG
gcttttcctaagcagaggag

SEQ ID NO: 7961 - DNA, 20 bp, Artificial Sequence
  Description of Artificial Sequence: Synthetic oligonucleotide
  Target: DMPK; (-) strand; PAM type: NRG; PAM sequence: GGG
ggcttttcctaagcagagga

SEQ ID NO: 7962 - DNA, 20 bp, Artificial Sequence
  Description of Artificial Sequence: Synthetic oligonucleotide
  Target: DMPK; (-) strand; PAM type: NRG; PAM sequence: AGG
gggcttttcctaagcagagg

SEQ ID NO: 7963 - DNA, 20 bp, Artificial Sequence
  Description of Artificial Sequence: Synthetic oligonucleotide
  Target: DMPK; (-) strand; PAM type: NRG; PAM sequence: GAG
agggcttttcctaagcagag

SEQ ID NO: 7964 - DNA, 20 bp, Artificial Sequence
  Description of Artificial Sequence: Synthetic oligonucleotide
  Target: DMPK; (-) strand; PAM type: NRG; PAM sequence: AGG
gcagggcttttcctaagcag

SEQ ID NO: 7965 - DNA, 20 bp, Artificial Sequence
  Description of Artificial Sequence: Synthetic oligonucleotide
  Target: DMPK; (-) strand; PAM type: NRG; PAM sequence: GAG
ggcagggcttttcctaagca

SEQ ID NO: 7966 - DNA, 20 bp, Artificial Sequence
  Description of Artificial Sequence: Synthetic oligonucleotide
  Target: DMPK; (-) strand; PAM type: NRG; PAM sequence: CAG
ggggcagggcttttcctaag

SEQ ID NO: 7967 - DNA, 20 bp, Artificial Sequence
  Description of Artificial Sequence: Synthetic oligonucleotide
  Target: DMPK; (-) strand; PAM type: NRG; PAM sequence: AAG
agaggggcagggcttttcct

SEQ ID NO: 7968 - DNA, 20 bp, Artificial Sequence
  Description of Artificial Sequence: Synthetic oligonucleotide
  Target: DMPK; (-) strand; PAM type: NRG; PAM sequence: GGG
ccaaggccaggagaggggca

SEQ ID NO: 7969 - DNA, 20 bp, Artificial Sequence
  Description of Artificial Sequence: Synthetic oligonucleotide
  Target: DMPK; (-) strand; PAM type: NRG; PAM sequence: AGG
cccaaggccaggagaggggc

SEQ ID NO: 7970 - DNA, 20 bp, Artificial Sequence
  Description of Artificial Sequence: Synthetic oligonucleotide
  Target: DMPK; (-) strand; PAM type: NRG; PAM sequence: CAG
gcccaaggccaggagagggg

SEQ ID NO: 7971 - DNA, 20 bp, Artificial Sequence
  Description of Artificial Sequence: Synthetic oligonucleotide
  Target: DMPK; (-) strand; PAM type: NRG; PAM sequence: GGG
ggggcccaaggccaggagag

SEQ ID NO: 7972 - DNA, 20 bp, Artificial Sequence
  Description of Artificial Sequence: Synthetic oligonucleotide
  Target: DMPK; (-) strand; PAM type: NRG; PAM sequence: GGG
aggggcccaaggccaggaga

SEQ ID NO: 7973 - DNA, 20 bp, Artificial Sequence
  Description of Artificial Sequence: Synthetic oligonucleotide
  Target: DMPK; (-) strand; PAM type: NRG; PAM sequence: AGG
caggggcccaaggccaggag

SEQ ID NO: 7974 - DNA, 20 bp, Artificial Sequence
  Description of Artificial Sequence: Synthetic oligonucleotide
  Target: DMPK; (-) strand; PAM type: NRG; PAM sequence: GAG
ccaggggcccaaggccagga

SEQ ID NO: 7975 - DNA, 20 bp, Artificial Sequence
  Description of Artificial Sequence: Synthetic oligonucleotide
  Target: DMPK; (-) strand; PAM type: NRG; PAM sequence: GAG
tcccaggggcccaaggccag

SEQ ID NO: 7976 - DNA, 20 bp, Artificial Sequence
  Description of Artificial Sequence: Synthetic oligonucleotide
  Target: DMPK; (-) strand; PAM type: NRG; PAM sequence: AGG
gctcccaggggcccaaggcc

SEQ ID NO: 7977 - DNA, 20 bp, Artificial Sequence
  Description of Artificial Sequence: Synthetic oligonucleotide
  Target: DMPK; (-) strand; PAM type: NRG; PAM sequence: CAG
agctcccaggggcccaaggc

SEQ ID NO: 7978 - DNA, 20 bp, Artificial Sequence
  Description of Artificial Sequence: Synthetic oligonucleotide
  Target: DMPK; (-) strand; PAM type: NRG; PAM sequence: AGG
gagcagctcccaggggccca

SEQ ID NO: 7979 - DNA, 20 bp, Artificial Sequence
  Description of Artificial Sequence: Synthetic oligonucleotide
  Target: DMPK; (-) strand; PAM type: NRG; PAM sequence: AAG
agagcagctcccaggggccc

SEQ ID NO: 7980 - DNA, 20 bp, Artificial Sequence
  Description of Artificial Sequence: Synthetic oligonucleotide
  Target: DMPK; (-) strand; PAM type: NRG; PAM sequence: GGG
ttagaaagagcagctcccag

SEQ ID NO: 7981 - DNA, 20 bp, Artificial Sequence
  Description of Artificial Sequence: Synthetic oligonucleotide
  Target: DMPK; (-) strand; PAM type: NRG; PAM sequence: GGG
tttagaaagagcagctccca

SEQ ID NO: 7982 - DNA, 20 bp, Artificial Sequence
  Description of Artificial Sequence: Synthetic oligonucleotide
  Target: DMPK; (-) strand; PAM type: NRG; PAM sequence: AGG
gtttagaaagagcagctccc

SEQ ID NO: 7983 - DNA, 20 bp, Artificial Sequence
  Description of Artificial Sequence: Synthetic oligonucleotide
  Target: DMPK; (-) strand; PAM type: NRG; PAM sequence: CAG
ggtttagaaagagcagctcc

SEQ ID NO: 7984 - DNA, 20 bp, Artificial Sequence
  Description of Artificial Sequence: Synthetic oligonucleotide
  Target: DMPK; (-) strand; PAM type: NRG; PAM sequence: CAG
tgcagaaggtttagaaagag

SEQ ID NO: 7985 - DNA, 20 bp, Artificial Sequence
  Description of Artificial Sequence: Synthetic oligonucleotide
  Target: DMPK; (-) strand; PAM type: NRG; PAM sequence: GAG
ccctgcagaaggtttagaaa

SEQ ID NO: 7986 - DNA, 20 bp, Artificial Sequence
  Description of Artificial Sequence: Synthetic oligonucleotide
  Target: DMPK; (-) strand; PAM type: NRG; PAM sequence: AAG
gtccctgcagaaggtttaga

SEQ ID NO: 7987 - DNA, 20 bp, Artificial Sequence
  Description of Artificial Sequence: Synthetic oligonucleotide
  Target: DMPK; (-) strand; PAM type: NRG; PAM sequence: TAG
ccaagtccctgcagaaggtt

SEQ ID NO: 7988 - DNA, 20 bp, Artificial Sequence
  Description of Artificial Sequence: Synthetic oligonucleotide
  Target: DMPK; (-) strand; PAM type: NRG; PAM sequence: AGG
ggaccccaagtccctgcaga

SEQ ID NO: 7989 - DNA, 20 bp, Artificial Sequence
  Description of Artificial Sequence: Synthetic oligonucleotide
  Target: DMPK; (-) strand; PAM type: NRG; PAM sequence: AAG
tggaccccaagtccctgcag

SEQ ID NO: 7990 - DNA, 20 bp, Artificial Sequence
  Description of Artificial Sequence: Synthetic oligonucleotide
  Target: DMPK; (-) strand; PAM type: NRG; PAM sequence: CAG
gtctggaccccaagtccctg

SEQ ID NO: 7991 - DNA, 20 bp, Artificial Sequence
  Description of Artificial Sequence: Synthetic oligonucleotide
  Target: DMPK; (-) strand; PAM type: NRG; PAM sequence: AAG
aacatgggggtctggacccc

SEQ ID NO: 7992 - DNA, 20 bp, Artificial Sequence
  Description of Artificial Sequence: Synthetic oligonucleotide
  Target: DMPK; (-) strand; PAM type: NRG; PAM sequence: TGG
gaccctagaacatgggggtc

SEQ ID NO: 7993 - DNA, 20 bp, Artificial Sequence
  Description of Artificial Sequence: Synthetic oligonucleotide
  Target: DMPK; (-) strand; PAM type: NRG; PAM sequence: GGG
gagctgaccctagaacatgg

SEQ ID NO: 7994 - DNA, 20 bp, Artificial Sequence
  Description of Artificial Sequence: Synthetic oligonucleotide
  Target: DMPK; (-) strand; PAM type: NRG; PAM sequence: GGG
tgagctgaccctagaacatg

SEQ ID NO: 7995 - DNA, 20 bp, Artificial Sequence
  Description of Artificial Sequence: Synthetic oligonucleotide
  Target: DMPK; (-) strand; PAM type: NRG; PAM sequence: GGG
atgagctgaccctagaacat

SEQ ID NO: 7996 - DNA, 20 bp, Artificial Sequence
  Description of Artificial Sequence: Synthetic oligonucleotide
  Target: DMPK; (-) strand; PAM type: NRG; PAM sequence: TGG
gatgagctgaccctagaaca

SEQ ID NO: 7997 - DNA, 20 bp, Artificial Sequence
  Description of Artificial Sequence: Synthetic oligonucleotide
  Target: DMPK; (-) strand; PAM type: NRG; PAM sequence: TAG
gggaggagatgagctgaccc

SEQ ID NO: 7998 - DNA, 20 bp, Artificial Sequence
  Description of Artificial Sequence: Synthetic oligonucleotide
  Target: DMPK; (-) strand; PAM type: NRG; PAM sequence: GAG
cacatgtcaagggaggagat

SEQ ID NO: 7999 - DNA, 20 bp, Artificial Sequence
  Description of Artificial Sequence: Synthetic oligonucleotide
  Target: DMPK; (-) strand; PAM type: NRG; PAM sequence: GAG
gcggtcacatgtcaagggag

SEQ ID NO: 8000 - DNA, 20 bp, Artificial Sequence
  Description of Artificial Sequence: Synthetic oligonucleotide
  Target: DMPK; (-) strand; PAM type: NRG; PAM sequence: AGG
cagcggtcacatgtcaaggg

SEQ ID NO: 8001 - DNA, 20 bp, Artificial Sequence
  Description of Artificial Sequence: Synthetic oligonucleotide
  Target: DMPK; (-) strand; PAM type: NRG; PAM sequence: GAG
gcagcggtcacatgtcaagg

SEQ ID NO: 8002 - DNA, 20 bp, Artificial Sequence
  Description of Artificial Sequence: Synthetic oligonucleotide
  Target: DMPK; (-) strand; PAM type: NRG; PAM sequence: GGG
ctgcagcggtcacatgtcaa

SEQ ID NO: 8003 - DNA, 20 bp, Artificial Sequence
  Description of Artificial Sequence: Synthetic oligonucleotide
  Target: DMPK; (-) strand; PAM type: NRG; PAM sequence: AGG
tctgcagcggtcacatgtca

SEQ ID NO: 8004 - DNA, 20 bp, Artificial Sequence
  Description of Artificial Sequence: Synthetic oligonucleotide
  Target: DMPK; (-) strand; PAM type: NRG; PAM sequence: AAG
gtctgcagcggtcacatgtc

SEQ ID NO: 8005 - DNA, 20 bp, Artificial Sequence
  Description of Artificial Sequence: Synthetic oligonucleotide
  Target: DMPK; (-) strand; PAM type: NRG; PAM sequence: CGG
ctgagaagaggggtctgcag

SEQ ID NO: 8006 - DNA, 20 bp, Artificial Sequence
  Description of Artificial Sequence: Synthetic oligonucleotide
  Target: DMPK; (-) strand; PAM type: NRG; PAM sequence: CAG
gccctgagaagaggggtctg

SEQ ID NO: 8007 - DNA, 20 bp, Artificial Sequence
  Description of Artificial Sequence: Synthetic oligonucleotide
  Target: DMPK; (-) strand; PAM type: NRG; PAM sequence: GGG
tcctgaggccctgagaagag

SEQ ID NO: 8008 - DNA, 20 bp, Artificial Sequence
  Description of Artificial Sequence: Synthetic oligonucleotide
  Target: DMPK; (-) strand; PAM type: NRG; PAM sequence: GGG
gtcctgaggccctgagaaga

SEQ ID NO: 8009 - DNA, 20 bp, Artificial Sequence
  Description of Artificial Sequence: Synthetic oligonucleotide
  Target: DMPK; (-) strand; PAM type: NRG; PAM sequence: AGG
tgtcctgaggccctgagaag

SEQ ID NO: 8010 - DNA, 20 bp, Artificial Sequence
  Description of Artificial Sequence: Synthetic oligonucleotide
  Target: DMPK; (-) strand; PAM type: NRG; PAM sequence: GAG
ctgtcctgaggccctgagaa

SEQ ID NO: 8011 - DNA, 20 bp, Artificial Sequence
  Description of Artificial Sequence: Synthetic oligonucleotide
  Target: DMPK; (-) strand; PAM type: NRG; PAM sequence: AAG
ccctgtcctgaggccctgag

SEQ ID NO: 8012 - DNA, 20 bp, Artificial Sequence
  Description of Artificial Sequence: Synthetic oligonucleotide
  Target: DMPK; (-) strand; PAM type: NRG; PAM sequence: GAG
cctccctgtcctgaggccct

SEQ ID NO: 8013 - DNA, 20 bp, Artificial Sequence
  Description of Artificial Sequence: Synthetic oligonucleotide
  Target: DMPK; (-) strand; PAM type: NRG; PAM sequence: AGG
aggtcggcctccctgtcctg

SEQ ID NO: 8014 - DNA, 20 bp, Artificial Sequence
  Description of Artificial Sequence: Synthetic oligonucleotide
  Target: DMPK; (-) strand; PAM type: NRG; PAM sequence: GAG
caggtcggcctccctgtcct

SEQ ID NO: 8015 - DNA, 20 bp, Artificial Sequence
  Description of Artificial Sequence: Synthetic oligonucleotide
  Target: DMPK; (-) strand; PAM type: NRG; PAM sequence: CGG
aagcagtctccccatcaggt

SEQ ID NO: 8016 - DNA, 20 bp, Artificial Sequence
  Description of Artificial Sequence: Synthetic oligonucleotide
  Target: DMPK; (-) strand; PAM type: NRG; PAM sequence: AGG
agccaagcagtctccccatc

SEQ ID NO: 8017 - DNA, 20 bp, Artificial Sequence
  Description of Artificial Sequence: Synthetic oligonucleotide
  Target: DMPK; (-) strand; PAM type: NRG; PAM sequence: CAG
gagccaagcagtctccccat

SEQ ID NO: 8018 - DNA, 20 bp, Artificial Sequence
  Description of Artificial Sequence: Synthetic oligonucleotide
  Target: DMPK; (-) strand; PAM type: NRG; PAM sequence: CAG
tggaggtggccagagccaag

SEQ ID NO: 8019 - DNA, 20 bp, Artificial Sequence
  Description of Artificial Sequence: Synthetic oligonucleotide
  Target: DMPK; (-) strand; PAM type: NRG; PAM sequence: AAG
ctgtggaggtggccagagcc

SEQ ID NO: 8020 - DNA, 20 bp, Artificial Sequence
  Description of Artificial Sequence: Synthetic oligonucleotide
  Target: DMPK; (-) strand; PAM type: NRG; PAM sequence: GAG
cacatctgtggaggtggcca

SEQ ID NO: 8021 - DNA, 20 bp, Artificial Sequence
  Description of Artificial Sequence: Synthetic oligonucleotide
  Target: DMPK; (-) strand; PAM type: NRG; PAM sequence: CAG
accacatctgtggaggtggc

SEQ ID NO: 8022 - DNA, 20 bp, Artificial Sequence
  Description of Artificial Sequence: Synthetic oligonucleotide
  Target: DMPK; (-) strand; PAM type: NRG; PAM sequence: TGG
taggaccacatctgtggagg

SEQ ID NO: 8023 - DNA, 20 bp, Artificial Sequence
  Description of Artificial Sequence: Synthetic oligonucleotide
  Target: DMPK; (-) strand; PAM type: NRG; PAM sequence: AGG
tcttaggaccacatctgtgg

SEQ ID NO: 8024 - DNA, 20 bp, Artificial Sequence
  Description of Artificial Sequence: Synthetic oligonucleotide
  Target: DMPK; (-) strand; PAM type: NRG; PAM sequence: GAG
gtcttaggaccacatctgtg

SEQ ID NO: 8025 - DNA, 20 bp, Artificial Sequence
  Description of Artificial Sequence: Synthetic oligonucleotide
  Target: DMPK; (-) strand; PAM type: NRG; PAM sequence: TGG
cagtcttaggaccacatctg

SEQ ID NO: 8026 - DNA, 20 bp, Artificial Sequence
  Description of Artificial Sequence: Synthetic oligonucleotide
  Target: DMPK; (-) strand; PAM type: NRG; PAM sequence: AGG
ggggtcccatgcccagtctt

SEQ ID NO: 8027 - DNA, 20 bp, Artificial Sequence
  Description of Artificial Sequence: Synthetic oligonucleotide
  Target: DMPK; (-) strand; PAM type: NRG; PAM sequence: TAG
tggggtcccatgcccagtct

SEQ ID NO: 8028 - DNA, 20 bp, Artificial Sequence
  Description of Artificial Sequence: Synthetic oligonucleotide
  Target: DMPK; (-) strand; PAM type: NRG; PAM sequence: CAG
ccatcttggggtcccatgcc

SEQ ID NO: 8029 - DNA, 20 bp, Artificial Sequence
  Description of Artificial Sequence: Synthetic oligonucleotide
  Target: DMPK; (-) strand; PAM type: NRG; PAM sequence: GGG
gacctcaagttgccatcttg

SEQ ID NO: 8030 - DNA, 20 bp, Artificial Sequence
  Description of Artificial Sequence: Synthetic oligonucleotide
  Target: DMPK; (-) strand; PAM type: NRG; PAM sequence: GGG
tgacctcaagttgccatctt

SEQ ID NO: 8031 - DNA, 20 bp, Artificial Sequence
  Description of Artificial Sequence: Synthetic oligonucleotide
  Target: DMPK; (-) strand; PAM type: NRG; PAM sequence: TGG
ctgacctcaagttgccatct

SEQ ID NO: 8032 - DNA, 20 bp, Artificial Sequence
  Description of Artificial Sequence: Synthetic oligonucleotide
  Target: DMPK; (-) strand; PAM type: NRG; PAM sequence: AAG
gagtggggtgtgctgacctc

SEQ ID NO: 8033 - DNA, 20 bp, Artificial Sequence
  Description of Artificial Sequence: Synthetic oligonucleotide
  Target: DMPK; (-) strand; PAM type: NRG; PAM sequence: GGG
ccccttcccacagctgagtg

SEQ ID NO: 8034 - DNA, 20 bp, Artificial Sequence
  Description of Artificial Sequence: Synthetic oligonucleotide
  Target: DMPK; (-) strand; PAM type: NRG; PAM sequence: GGG
tccccttcccacagctgagt

SEQ ID NO: 8035 - DNA, 20 bp, Artificial Sequence
  Description of Artificial Sequence: Synthetic oligonucleotide
  Target: DMPK; (-) strand; PAM type: NRG; PAM sequence: TGG
gtccccttcccacagctgag

SEQ ID NO: 8036 - DNA, 20 bp, Artificial Sequence
  Description of Artificial Sequence: Synthetic oligonucleotide
  Target: DMPK; (-) strand; PAM type: NRG; PAM sequence: GAG
gctgtccccttcccacagct

SEQ ID NO: 8037 - DNA, 20 bp, Artificial Sequence
  Description of Artificial Sequence: Synthetic oligonucleotide
  Target: DMPK; (-) strand; PAM type: NRG; PAM sequence: CAG
gaggagctgtccccttccca

SEQ ID NO: 8038 - DNA, 20 bp, Artificial Sequence
  Description of Artificial Sequence: Synthetic oligonucleotide
  Target: DMPK; (-) strand; PAM type: NRG; PAM sequence: GAG
ccacttcataccccagggag

SEQ ID NO: 8039 - DNA, 20 bp, Artificial Sequence
  Description of Artificial Sequence: Synthetic oligonucleotide
  Target: DMPK; (-) strand; PAM type: NRG; PAM sequence: AGG
agccacttcataccccaggg

SEQ ID NO: 8040 - DNA, 20 bp, Artificial Sequence
  Description of Artificial Sequence: Synthetic oligonucleotide
  Target: DMPK; (-) strand; PAM type: NRG; PAM sequence: GAG
cagccacttcataccccagg

SEQ ID NO: 8041 - DNA, 20 bp, Artificial Sequence
  Description of Artificial Sequence: Synthetic oligonucleotide
  Target: DMPK; (-) strand; PAM type: NRG; PAM sequence: GGG
gacagccacttcatacccca

SEQ ID NO: 8042 - DNA, 20 bp, Artificial Sequence
  Description of Artificial Sequence: Synthetic oligonucleotide
  Target: DMPK; (-) strand; PAM type: NRG; PAM sequence: AGG
ggacagccacttcatacccc

SEQ ID NO: 8043 - DNA, 20 bp, Artificial Sequence
  Description of Artificial Sequence: Synthetic oligonucleotide
  Target: DMPK; (-) strand; PAM type: NRG; PAM sequence: CAG
gggacagccacttcataccc

SEQ ID NO: 8044 - DNA, 20 bp, Artificial Sequence
  Description of Artificial Sequence: Synthetic oligonucleotide
  Target: DMPK; (-) strand; PAM type: NRG; PAM sequence: CAG
gactgctgggttggagggga

SEQ ID NO: 8045 - DNA, 20 bp, Artificial Sequence
  Description of Artificial Sequence: Synthetic oligonucleotide
  Target: DMPK; (-) strand; PAM type: NRG; PAM sequence: GGG
gagggactgctgggttggag

SEQ ID NO: 8046 - DNA, 20 bp, Artificial Sequence
  Description of Artificial Sequence: Synthetic oligonucleotide
  Target: DMPK; (-) strand; PAM type: NRG; PAM sequence: GGG
ggagggactgctgggttgga

SEQ ID NO: 8047 - DNA, 20 bp, Artificial Sequence
  Description of Artificial Sequence: Synthetic oligonucleotide
  Target: DMPK; (-) strand; PAM type: NRG; PAM sequence: AGG
aggagggactgctgggttgg

SEQ ID NO: 8048 - DNA, 20 bp, Artificial Sequence
  Description of Artificial Sequence: Synthetic oligonucleotide
  Target: DMPK; (-) strand; PAM type: NRG; PAM sequence: GAG
caggagggactgctgggttg

SEQ ID NO: 8049 - DNA, 20 bp, Artificial Sequence
  Description of Artificial Sequence: Synthetic oligonucleotide
  Target: DMPK; (-) strand; PAM type: NRG; PAM sequence: TGG
cacaggagggactgctgggt

SEQ ID NO: 8050 - DNA, 20 bp, Artificial Sequence
  Description of Artificial Sequence: Synthetic oligonucleotide
  Target: DMPK; (-) strand; PAM type: NRG; PAM sequence: GGG
ttcccacaggagggactgct

SEQ ID NO: 8051 - DNA, 20 bp, Artificial Sequence
  Description of Artificial Sequence: Synthetic oligonucleotide
  Target: DMPK; (-) strand; PAM type: NRG; PAM sequence: TGG
gttcccacaggagggactgc

SEQ ID NO: 8052 - DNA, 20 bp, Artificial Sequence
  Description of Artificial Sequence: Synthetic oligonucleotide
  Target: DMPK; (-) strand; PAM type: NRG; PAM sequence: GGG
tgagccgtgttcccacagga

SEQ ID NO: 8053 - DNA, 20 bp, Artificial Sequence
  Description of Artificial Sequence: Synthetic oligonucleotide
  Target: DMPK; (-) strand; PAM type: NRG; PAM sequence: AGG
ctgagccgtgttcccacagg

SEQ ID NO: 8054 - DNA, 20 bp, Artificial Sequence
  Description of Artificial Sequence: Synthetic oligonucleotide
  Target: DMPK; (-) strand; PAM type: NRG; PAM sequence: GAG
cctgagccgtgttcccacag

SEQ ID NO: 8055 - DNA, 20 bp, Artificial Sequence
  Description of Artificial Sequence: Synthetic oligonucleotide
  Target: DMPK; (-) strand; PAM type: NRG; PAM sequence: AGG
gtcctgagccgtgttcccac

SEQ ID NO: 8056 - DNA, 20 bp, Artificial Sequence
  Description of Artificial Sequence: Synthetic oligonucleotide
  Target: DMPK; (-) strand; PAM type: NRG; PAM sequence: CAG
ggtcctgagccgtgttccca

SEQ ID NO: 8057 - DNA, 20 bp, Artificial Sequence
  Description of Artificial Sequence: Synthetic oligonucleotide
  Target: DMPK; (-) strand; PAM type: NRG; PAM sequence: GAG
gtccaggatagctaggtcct

SEQ ID NO: 8058 - DNA, 20 bp, Artificial Sequence
  Description of Artificial Sequence: Synthetic oligonucleotide
  Target: DMPK; (-) strand; PAM type: NRG; PAM sequence: AGG
ggcgcatgtccaggatagct

SEQ ID NO: 8059 - DNA, 20 bp, Artificial Sequence
  Description of Artificial Sequence: Synthetic oligonucleotide
  Target: DMPK; (-) strand; PAM type: NRG; PAM sequence: TAG
aggcgcatgtccaggatagc

SEQ ID NO: 8060 - DNA, 20 bp, Artificial Sequence
  Description of Artificial Sequence: Synthetic oligonucleotide
  Target: DMPK; (-) strand; PAM type: NRG; PAM sequence: TAG
acccaggcgcatgtccagga

SEQ ID NO: 8061 - DNA, 20 bp, Artificial Sequence
  Description of Artificial Sequence: Synthetic oligonucleotide
  Target: DMPK; (-) strand; PAM type: NRG; PAM sequence: AGG
tagaacccaggcgcatgtcc

SEQ ID NO: 8062 - DNA, 20 bp, Artificial Sequence
  Description of Artificial Sequence: Synthetic oligonucleotide
  Target: DMPK; (-) strand; PAM type: NRG; PAM sequence: CAG
ttagaacccaggcgcatgtc

SEQ ID NO: 8063 - DNA, 20 bp, Artificial Sequence
  Description of Artificial Sequence: Synthetic oligonucleotide
  Target: DMPK; (-) strand; PAM type: NRG; PAM sequence: AGG
cccatcctctattagaaccc

SEQ ID NO: 8064 - DNA, 20 bp, Artificial Sequence
  Description of Artificial Sequence: Synthetic oligonucleotide
  Target: DMPK; (-) strand; PAM type: NRG; PAM sequence: CAG
acccatcctctattagaacc

SEQ ID NO: 8065 - DNA, 20 bp, Artificial Sequence
  Description of Artificial Sequence: Synthetic oligonucleotide
  Target: DMPK; (-) strand; PAM type: NRG; PAM sequence: TAG
ggattgaacccatcctctat

SEQ ID NO: 8066 - DNA, 20 bp, Artificial Sequence
  Description of Artificial Sequence: Synthetic oligonucleotide
  Target: DMPK; (-) strand; PAM type: NRG; PAM sequence: AGG
cggggcctgaacggtgggtc

SEQ ID NO: 8067 - DNA, 20 bp, Artificial Sequence
  Description of Artificial Sequence: Synthetic oligonucleotide
  Target: DMPK; (-) strand; PAM type: NRG; PAM sequence: CAG
gcggggcctgaacggtgggt

SEQ ID NO: 8068 - DNA, 20 bp, Artificial Sequence
  Description of Artificial Sequence: Synthetic oligonucleotide
  Target: DMPK; (-) strand; PAM type: NRG; PAM sequence: GGG
cgctgcggggcctgaacggt

SEQ ID NO: 8069 - DNA, 20 bp, Artificial Sequence
  Description of Artificial Sequence: Synthetic oligonucleotide
  Target: DMPK; (-) strand; PAM type: NRG; PAM sequence: TGG
ccgctgcggggcctgaacgg

SEQ ID NO: 8070 - DNA, 20 bp, Artificial Sequence
  Description of Artificial Sequence: Synthetic oligonucleotide
  Target: DMPK; (-) strand; PAM type: NRG; PAM sequence: CGG
gaaccgctgcggggcctgaa

SEQ ID NO: 8071 - DNA, 20 bp, Artificial Sequence
  Description of Artificial Sequence: Synthetic oligonucleotide
  Target: DMPK; (-) strand; PAM type: NRG; PAM sequence: GGG
cttgattctgaaccgctgcg

SEQ ID NO: 8072 - DNA, 20 bp, Artificial Sequence
  Description of Artificial Sequence: Synthetic oligonucleotide
  Target: DMPK; (-) strand; PAM type: NRG; PAM sequence: GGG
gcttgattctgaaccgctgc

SEQ ID NO: 8073 - DNA, 20 bp, Artificial Sequence
  Description of Artificial Sequence: Synthetic oligonucleotide
  Target: DMPK; (-) strand; PAM type: NRG; PAM sequence: CGG
agcttgattctgaaccgctg

SEQ ID NO: 8074 - DNA, 20 bp, Artificial Sequence
  Description of Artificial Sequence: Synthetic oligonucleotide
  Target: DMPK; (-) strand; PAM type: NRG; PAM sequence: CAG
accttatcattaatgaactc

SEQ ID NO: 8075 - DNA, 20 bp, Artificial Sequence
  Description of Artificial Sequence: Synthetic oligonucleotide
  Target: DMPK; (-) strand; PAM type: NRG; PAM sequence: TGG
ttctagtcagcttttattac

SEQ ID NO: 8076 - DNA, 20 bp, Artificial Sequence
  Description of Artificial Sequence: Synthetic oligonucleotide
  Target: DMPK; (-) strand; PAM type: NRG; PAM sequence: CAG
agaacagttggttttctagt

SEQ ID NO: 8077 - DNA, 20 bp, Artificial Sequence
  Description of Artificial Sequence: Synthetic oligonucleotide
  Target: DMPK; (-) strand; PAM type: NRG; PAM sequence: TAG
taagagaacagttggttttc

SEQ ID NO: 8078 - DNA, 20 bp, Artificial Sequence
  Description of Artificial Sequence: Synthetic oligonucleotide
  Target: DMPK; (-) strand; PAM type: NRG; PAM sequence: TGG
actttgtctaagagaacagt

SEQ ID NO: 8079 - DNA, 20 bp, Artificial Sequence
  Description of Artificial Sequence: Synthetic oligonucleotide
  Target: DMPK; (-) strand; PAM type: NRG; PAM sequence: CAG
tgctactttgtctaagagaa

SEQ ID NO: 8080 - DNA, 20 bp, Artificial Sequence
  Description of Artificial Sequence: Synthetic oligonucleotide
  Target: DMPK; (-) strand; PAM type: NRG; PAM sequence: GAG
cctcatgctactttgtctaa

SEQ ID NO: 8081 - DNA, 20 bp, Artificial Sequence
  Description of Artificial Sequence: Synthetic oligonucleotide
  Target: DMPK; (-) strand; PAM type: NRG; PAM sequence: AAG
ttcctcatgctactttgtct

SEQ ID NO: 8082 - DNA, 20 bp, Artificial Sequence
  Description of Artificial Sequence: Synthetic oligonucleotide
  Target: DMPK; (-) strand; PAM type: NRG; PAM sequence: TGG
gtggagaacaggtgtttttt

SEQ ID NO: 8083 - DNA, 20 bp, Artificial Sequence
  Description of Artificial Sequence: Synthetic oligonucleotide
  Target: DMPK; (-) strand; PAM type: NRG; PAM sequence: AGG
atgtttaaatagtggagaac

SEQ ID NO: 8084 - DNA, 20 bp, Artificial Sequence
  Description of Artificial Sequence: Synthetic oligonucleotide
  Target: DMPK; (-) strand; PAM type: NRG; PAM sequence: CAG
catgtttaaatagtggagaa

SEQ ID NO: 8085 - DNA, 20 bp, Artificial Sequence
  Description of Artificial Sequence: Synthetic oligonucleotide
  Target: DMPK; (-) strand; PAM type: NRG; PAM sequence: GAG
tgacacatgtttaaatagtg

SEQ ID NO: 8086 - DNA, 20 bp, Artificial Sequence
  Description of Artificial Sequence: Synthetic oligonucleotide
  Target: DMPK; (-) strand; PAM type: NRG; PAM sequence: TGG
actgacacatgtttaaatag

SEQ ID NO: 8087 - DNA, 20 bp, Artificial Sequence
  Description of Artificial Sequence: Synthetic oligonucleotide
  Target: DMPK; (-) strand; PAM type: NRG; PAM sequence: TAG
tgtactgacacatgtttaaa

SEQ ID NO: 8088 - DNA, 20 bp, Artificial Sequence
  Description of Artificial Sequence: Synthetic oligonucleotide
  Target: DMPK; (-) strand; PAM type: NRG; PAM sequence: TGG
caccagatggcagtggtccc

SEQ ID NO: 8089 - DNA, 20 bp, Artificial Sequence
  Description of Artificial Sequence: Synthetic oligonucleotide
  Target: DMPK; (-) strand; PAM type: NRG; PAM sequence: TGG
gtgagctcaccagatggcag

SEQ ID NO: 8090 - DNA, 20 bp, Artificial Sequence
  Description of Artificial Sequence: Synthetic oligonucleotide
  Target: DMPK; (-) strand; PAM type: NRG; PAM sequence: CAG
ctcgtgagctcaccagatgg

SEQ ID NO: 8091 - DNA, 20 bp, Artificial Sequence
  Description of Artificial Sequence: Synthetic oligonucleotide
  Target: DMPK; (-) strand; PAM type: NRG; PAM sequence: TGG
tatctcgtgagctcaccaga

SEQ ID NO: 8092 - DNA, 20 bp, Artificial Sequence
  Description of Artificial Sequence: Synthetic oligonucleotide
  Target: DMPK; (-) strand; PAM type: NRG; PAM sequence: CAG
ttgatatctcgtgagctcac

SEQ ID NO: 8093 - DNA, 20 bp, Artificial Sequence
  Description of Artificial Sequence: Synthetic oligonucleotide
  Target: DMPK; (-) strand; PAM type: NRG; PAM sequence: GAG
aaaggaagttgatatctcgt

SEQ ID NO: 8094 - DNA, 20 bp, Artificial Sequence
  Description of Artificial Sequence: Synthetic oligonucleotide
  Target: DMPK; (-) strand; PAM type: NRG; PAM sequence: AAG
aaatacagataaggaaaagg

SEQ ID NO: 8095 - DNA, 20 bp, Artificial Sequence
  Description of Artificial Sequence: Synthetic oligonucleotide
  Target: DMPK; (-) strand; PAM type: NRG; PAM sequence: AGG
agaaaatacagataaggaaa

SEQ ID NO: 8096 - DNA, 20 bp, Artificial Sequence
  Description of Artificial Sequence: Synthetic oligonucleotide
  Target: DMPK; (-) strand; PAM type: NRG; PAM sequence: AAG
tagaaaatacagataaggaa

SEQ ID NO: 8097 - DNA, 20 bp, Artificial Sequence
  Description of Artificial Sequence: Synthetic oligonucleotide
  Target: DMPK; (-) strand; PAM type: NRG; PAM sequence: AGG
taaattagaaaatacagata

SEQ ID NO: 8098 - DNA, 20 bp, Artificial Sequence
  Description of Artificial Sequence: Synthetic oligonucleotide
  Target: DMPK; (-) strand; PAM type: NRG; PAM sequence: AAG
gtaaattagaaaatacagat

SEQ ID NO: 8099 - DNA, 20 bp, Artificial Sequence
  Description of Artificial Sequence: Synthetic oligonucleotide
  Target: DMPK; (-) strand; PAM type: NRG; PAM sequence: CAG
cacaagtaaattagaaaata

SEQ ID NO: 8100 - DNA, 20 bp, Artificial Sequence
  Description of Artificial Sequence: Synthetic oligonucleotide
  Target: DMPK; (-) strand; PAM type: NRG; PAM sequence: TAG
attgcttatcacaagtaaat

SEQ ID NO: 8101 - DNA, 20 bp, Artificial Sequence
  Description of Artificial Sequence: Synthetic oligonucleotide
  Target: DMPK; (-) strand; PAM type: NRG; PAM sequence: AAG
aataatgcattgcttatcac

SEQ ID NO: 8102 - DNA, 20 bp, Artificial Sequence
  Description of Artificial Sequence: Synthetic oligonucleotide
  Target: DMPK; (-) strand; PAM type: NRG; PAM sequence: AAG
gtgagacctggtctcaacaa

SEQ ID NO: 8103 - DNA, 20 bp, Artificial Sequence
  Description of Artificial Sequence: Synthetic oligonucleotide
  Target: DMPK; (-) strand; PAM type: NRG; PAM sequence: TGG
ctaggcaacaaagtgagacc

SEQ ID NO: 8104 - DNA, 20 bp, Artificial Sequence
  Description of Artificial Sequence: Synthetic oligonucleotide
  Target: DMPK; (-) strand; PAM type: NRG; PAM sequence: GAG
tccagcctaggcaacaaagt

SEQ ID NO: 8105 - DNA, 20 bp, Artificial Sequence
  Description of Artificial Sequence: Synthetic oligonucleotide
  Target: DMPK; (-) strand; PAM type: NRG; PAM sequence: AAG
agattccagcctaggcaaca

SEQ ID NO: 8106 - DNA, 20 bp, Artificial Sequence
  Description of Artificial Sequence: Synthetic oligonucleotide
  Target: DMPK; (-) strand; PAM type: NRG; PAM sequence: AGG
gccatgatagattccagcct

SEQ ID NO: 8107 - DNA, 20 bp, Artificial Sequence
  Description of Artificial Sequence: Synthetic oligonucleotide
  Target: DMPK; (-) strand; PAM type: NRG; PAM sequence: TAG
agccatgatagattccagcc

SEQ ID NO: 8108 - DNA, 20 bp, Artificial Sequence
  Description of Artificial Sequence: Synthetic oligonucleotide
  Target: DMPK; (-) strand; PAM type: NRG; PAM sequence: CAG
cagtgagccatgatagattc

SEQ ID NO: 8109 - DNA, 20 bp, Artificial Sequence
  Description of Artificial Sequence: Synthetic oligonucleotide
  Target: DMPK; (-) strand; PAM type: NRG; PAM sequence: TAG
gaggcttcagtgagccatga

SEQ ID NO: 8110 - DNA, 20 bp, Artificial Sequence
  Description of Artificial Sequence: Synthetic oligonucleotide
  Target: DMPK; (-) strand; PAM type: NRG; PAM sequence: GAG
ctggagtttgaggcttcagt

SEQ ID NO: 8111 - DNA, 20 bp, Artificial Sequence
  Description of Artificial Sequence: Synthetic oligonucleotide
  Target: DMPK; (-) strand; PAM type: NRG; PAM sequence: CAG
gagcctggagtttgaggctt

SEQ ID NO: 8112 - DNA, 20 bp, Artificial Sequence
  Description of Artificial Sequence: Synthetic oligonucleotide
  Target: DMPK; (-) strand; PAM type: NRG; PAM sequence: AGG
tcacttgagcctggagtttg

SEQ ID NO: 8113 - DNA, 20 bp, Artificial Sequence
  Description of Artificial Sequence: Synthetic oligonucleotide
  Target: DMPK; (-) strand; PAM type: NRG; PAM sequence: GAG
atcacttgagcctggagttt

SEQ ID NO: 8114 - DNA, 20 bp, Artificial Sequence
  Description of Artificial Sequence: Synthetic oligonucleotide
  Target: DMPK; (-) strand; PAM type: NRG; PAM sequence: GAG
aggagaatcacttgagcctg

SEQ ID NO: 8115 - DNA, 20 bp, Artificial Sequence
  Description of Artificial Sequence: Synthetic oligonucleotide
  Target: DMPK; (-) strand; PAM type: NRG; PAM sequence: TGG
gtaggagaatcacttgagcc

SEQ ID NO: 8116 - DNA, 20 bp, Artificial Sequence
  Description of Artificial Sequence: Synthetic oligonucleotide
  Target: DMPK; (-) strand; PAM type: NRG; PAM sequence: GAG
ctgaagtaggagaatcactt

SEQ ID NO: 8117 - DNA, 20 bp, Artificial Sequence
  Description of Artificial Sequence: Synthetic oligonucleotide
  Target: DMPK; (-) strand; PAM type: NRG; PAM sequence: GAG
tactcaggagtctgaagtag

SEQ ID NO: 8118 - DNA, 20 bp, Artificial Sequence
  Description of Artificial Sequence: Synthetic oligonucleotide
  Target: DMPK; (-) strand; PAM type: NRG; PAM sequence: AGG
gctactcaggagtctgaagt

SEQ ID NO: 8119 - DNA, 20 bp, Artificial Sequence
  Description of Artificial Sequence: Synthetic oligonucleotide
  Target: DMPK; (-) strand; PAM type: NRG; PAM sequence: TAG
agctactcaggagtctgaag

SEQ ID NO: 8120 - DNA, 20 bp, Artificial Sequence
  Description of Artificial Sequence: Synthetic oligonucleotide
  Target: DMPK; (-) strand; PAM type: NRG; PAM sequence: AAG
cctagctactcaggagtctg

SEQ ID NO: 8121 - DNA, 20 bp, Artificial Sequence
  Description of Artificial Sequence: Synthetic oligonucleotide
  Target: DMPK; (-) strand; PAM type: NRG; PAM sequence: GAG
ctgcagtcctagctactcag

SEQ ID NO: 8122 - DNA, 20 bp, Artificial Sequence
  Description of Artificial Sequence: Synthetic oligonucleotide
  Target: DMPK; (-) strand; PAM type: NRG; PAM sequence: AGG
gcctgcagtcctagctactc

SEQ ID NO: 8123 - DNA, 20 bp, Artificial Sequence
  Description of Artificial Sequence: Synthetic oligonucleotide
  Target: DMPK; (-) strand; PAM type: NRG; PAM sequence: CAG
tgcctgcagtcctagctact

SEQ ID NO: 8124 - DNA, 20 bp, Artificial Sequence
  Description of Artificial Sequence: Synthetic oligonucleotide
  Target: DMPK; (-) strand; PAM type: NRG; PAM sequence: TAG
gtggtctgtgcctgcagtcc

SEQ ID NO: 8125 - DNA, 20 bp, Artificial Sequence
  Description of Artificial Sequence: Synthetic oligonucleotide
  Target: DMPK; (-) strand; PAM type: NRG; PAM sequence: CAG
ggcatggtggtctgtgcctg

SEQ ID NO: 8126 - DNA, 20 bp, Artificial Sequence
  Description of Artificial Sequence: Synthetic oligonucleotide
  Target: DMPK; (-) strand; PAM type: NRG; PAM sequence: TGG
aaaaatcgtgccaggcatgg

SEQ ID NO: 8127 - DNA, 20 bp, Artificial Sequence
  Description of Artificial Sequence: Synthetic oligonucleotide
  Target: DMPK; (-) strand; PAM type: NRG; PAM sequence: TGG
tgaaaaaatcgtgccaggca

SEQ ID NO: 8128 - DNA, 20 bp, Artificial Sequence
  Description of Artificial Sequence: Synthetic oligonucleotide
  Target: DMPK; (-) strand; PAM type: NRG; PAM sequence: AGG
aaaattgaaaaaatcgtgcc

SEQ ID NO: 8129 - DNA, 20 bp, Artificial Sequence
  Description of Artificial Sequence: Synthetic oligonucleotide
  Target: DMPK; (-) strand; PAM type: NRG; PAM sequence: CAG
aaaaattgaaaaaatcgtgc

SEQ ID NO: 8130 - DNA, 20 bp, Artificial Sequence
  Description of Artificial Sequence: Synthetic oligonucleotide
  Target: DMPK; (-) strand; PAM type: NRG; PAM sequence: GAG
accagcctgagcaacataat

SEQ ID NO: 8131 - DNA, 20 bp, Artificial Sequence
  Description of Artificial Sequence: Synthetic oligonucleotide
  Target: DMPK; (-) strand; PAM type: NRG; PAM sequence: GAG
caggagttcaagaccagcct

SEQ ID NO: 8132 - DNA, 20 bp, Artificial Sequence
  Description of Artificial Sequence: Synthetic oligonucleotide
  Target: DMPK; (-) strand; PAM type: NRG; PAM sequence: CAG
tcagcccaggagttcaagac

SEQ ID NO: 8133 - DNA, 20 bp, Artificial Sequence
  Description of Artificial Sequence: Synthetic oligonucleotide
  Target: DMPK; (-) strand; PAM type: NRG; PAM sequence: AAG
ttgcttcagcccaggagttc

SEQ ID NO: 8134 - DNA, 20 bp, Artificial Sequence
  Description of Artificial Sequence: Synthetic oligonucleotide
  Target: DMPK; (-) strand; PAM type: NRG; PAM sequence: GAG
gacggattgcttcagcccag

SEQ ID NO: 8135 - DNA, 20 bp, Artificial Sequence
  Description of Artificial Sequence: Synthetic oligonucleotide
  Target: DMPK; (-) strand; PAM type: NRG; PAM sequence: AGG
tggacggattgcttcagccc

SEQ ID NO: 8136 - DNA, 20 bp, Artificial Sequence
  Description of Artificial Sequence: Synthetic oligonucleotide
  Target: DMPK; (-) strand; PAM type: NRG; PAM sequence: CAG
gtggacggattgcttcagcc

SEQ ID NO: 8137 - DNA, 20 bp, Artificial Sequence
  Description of Artificial Sequence: Synthetic oligonucleotide
  Target: DMPK; (-) strand; PAM type: NRG; PAM sequence: CAG
ctgaagtggacggattgctt

SEQ ID NO: 8138 - DNA, 20 bp, Artificial Sequence
  Description of Artificial Sequence: Synthetic oligonucleotide
  Target: DMPK; (-) strand; PAM type: NRG; PAM sequence: CGG
ctttgggaggctgaagtgga

SEQ ID NO: 8139 - DNA, 20 bp, Artificial Sequence
  Description of Artificial Sequence: Synthetic oligonucleotide
  Target: DMPK; (-) strand; PAM type: NRG; PAM sequence: TGG
agcactttgggaggctgaag

SEQ ID NO: 8140 - DNA, 20 bp, Artificial Sequence
  Description of Artificial Sequence: Synthetic oligonucleotide
  Target: DMPK; (-) strand; PAM type: NRG; PAM sequence: AAG
cccagcactttgggaggctg

SEQ ID NO: 8141 - DNA, 20 bp, Artificial Sequence
  Description of Artificial Sequence: Synthetic oligonucleotide
  Target: DMPK; (-) strand; PAM type: NRG; PAM sequence: AGG
tggaatcccagcactttggg

SEQ ID NO: 8142 - DNA, 20 bp, Artificial Sequence
  Description of Artificial Sequence: Synthetic oligonucleotide
  Target: DMPK; (-) strand; PAM type: NRG; PAM sequence: GAG
ttggaatcccagcactttgg

SEQ ID NO: 8143 - DNA, 20 bp, Artificial Sequence
  Description of Artificial Sequence: Synthetic oligonucleotide
  Target: DMPK; (-) strand; PAM type: NRG; PAM sequence: GGG
gcttggaatcccagcacttt

SEQ ID NO: 8144 - DNA, 20 bp, Artificial Sequence
  Description of Artificial Sequence: Synthetic oligonucleotide
  Target: DMPK; (-) strand; PAM type: NRG; PAM sequence: TGG
cgcttggaatcccagcactt

SEQ ID NO: 8145 - DNA, 20 bp, Artificial Sequence
  Description of Artificial Sequence: Synthetic oligonucleotide
  Target: DMPK; (-) strand; PAM type: NRG; PAM sequence: CAG
gtggctcacgcttggaatcc

SEQ ID NO: 8146 - DNA, 20 bp, Artificial Sequence
  Description of Artificial Sequence: Synthetic oligonucleotide
  Target: DMPK; (-) strand; PAM type: NRG; PAM sequence: TGG
tgggcatggtggctcacgct

SEQ ID NO: 8147 - DNA, 20 bp, Artificial Sequence
  Description of Artificial Sequence: Synthetic oligonucleotide
  Target: DMPK; (-) strand; PAM type: NRG; PAM sequence: TGG
aatttacaggctgggcatgg

SEQ ID NO: 8148 - DNA, 20 bp, Artificial Sequence
  Description of Artificial Sequence: Synthetic oligonucleotide
  Target: DMPK; (-) strand; PAM type: NRG; PAM sequence: TGG
actaatttacaggctgggca

SEQ ID NO: 8149 - DNA, 20 bp, Artificial Sequence
  Description of Artificial Sequence: Synthetic oligonucleotide
  Target: DMPK; (-) strand; PAM type: NRG; PAM sequence: GGG
aaagtactaatttacaggct

SEQ ID NO: 8150 - DNA, 20 bp, Artificial Sequence
  Description of Artificial Sequence: Synthetic oligonucleotide
  Target: DMPK; (-) strand; PAM type: NRG; PAM sequence: TGG
aaaagtactaatttacaggc

SEQ ID NO: 8151 - DNA, 20 bp, Artificial Sequence
  Description of Artificial Sequence: Synthetic oligonucleotide
  Target: DMPK; (-) strand; PAM type: NRG; PAM sequence: AGG
aaaaaaaagtactaatttac

SEQ ID NO: 8152 - DNA, 20 bp, Artificial Sequence
  Description of Artificial Sequence: Synthetic oligonucleotide
  Target: DMPK; (-) strand; PAM type: NRG; PAM sequence: CAG
aaaaaaaaagtactaattta

SEQ ID NO: 8153 - DNA, 20 bp, Artificial Sequence
  Description of Artificial Sequence: Synthetic oligonucleotide
  Target: DMPK; (-) strand; PAM type: NRG; PAM sequence: AAG
tctcaaaaaaaaaaaaaaaa

SEQ ID NO: 8154 - DNA, 20 bp, Artificial Sequence
  Description of Artificial Sequence: Synthetic oligonucleotide
  Target: DMPK; (-) strand; PAM type: NRG; PAM sequence: GAG
cattccagcctgggcaacaa

SEQ ID NO: 8155 - DNA, 20 bp, Artificial Sequence
  Description of Artificial Sequence: Synthetic oligonucleotide
  Target: DMPK; (-) strand; PAM type: NRG; PAM sequence: AAG
tgcattccagcctgggcaac

SEQ ID NO: 8156 - DNA, 20 bp, Artificial Sequence
  Description of Artificial Sequence: Synthetic oligonucleotide
  Target: DMPK; (-) strand; PAM type: NRG; PAM sequence: GGG
gtgccattgcattccagcct

SEQ ID NO: 8157 - DNA, 20 bp, Artificial Sequence
  Description of Artificial Sequence: Synthetic oligonucleotide
  Target: DMPK; (-) strand; PAM type: NRG; PAM sequence: TGG
cgtgccattgcattccagcc

SEQ ID NO: 8158 - DNA, 20 bp, Artificial Sequence
  Description of Artificial Sequence: Synthetic oligonucleotide
  Target: DMPK; (-) strand; PAM type: NRG; PAM sequence: CAG
gagatcgtgccattgcattc

SEQ ID NO: 8159 - DNA, 20 bp, Artificial Sequence
  Description of Artificial Sequence: Synthetic oligonucleotide
  Target: DMPK; (-) strand; PAM type: NRG; PAM sequence: GAG
gggggaggttgtggtgagct

SEQ ID NO: 8160 - DNA, 20 bp, Artificial Sequence
  Description of Artificial Sequence: Synthetic oligonucleotide
  Target: DMPK; (-) strand; PAM type: NRG; PAM sequence: GAG
caggagggggaggttgtggt

SEQ ID NO: 8161 - DNA, 20 bp, Artificial Sequence
  Description of Artificial Sequence: Synthetic oligonucleotide
  Target: DMPK; (-) strand; PAM type: NRG; PAM sequence: TGG
aacccaggagggggaggttg

SEQ ID NO: 8162 - DNA, 20 bp, Artificial Sequence
  Description of Artificial Sequence: Synthetic oligonucleotide
  Target: DMPK; (-) strand; PAM type: NRG; PAM sequence: AGG
aatcagaacccaggaggggg

SEQ ID NO: 8163 - DNA, 20 bp, Artificial Sequence
  Description of Artificial Sequence: Synthetic oligonucleotide
  Target: DMPK; (-) strand; PAM type: NRG; PAM sequence: GAG
gaatcagaacccaggagggg

SEQ ID NO: 8164 - DNA, 20 bp, Artificial Sequence
  Description of Artificial Sequence: Synthetic oligonucleotide
  Target: DMPK; (-) strand; PAM type: NRG; PAM sequence: GGG
gagaatcagaacccaggagg

SEQ ID NO: 8165 - DNA, 20 bp, Artificial Sequence
  Description of Artificial Sequence: Synthetic oligonucleotide
  Target: DMPK; (-) strand; PAM type: NRG; PAM sequence: GGG
ggagaatcagaacccaggag

SEQ ID NO: 8166 - DNA, 20 bp, Artificial Sequence
  Description of Artificial Sequence: Synthetic oligonucleotide
  Target: DMPK; (-) strand; PAM type: NRG; PAM sequence: GGG
aggagaatcagaacccagga

SEQ ID NO: 8167 - DNA, 20 bp, Artificial Sequence
  Description of Artificial Sequence: Synthetic oligonucleotide
  Target: DMPK; (-) strand; PAM type: NRG; PAM sequence: AGG
caggagaatcagaacccagg

SEQ ID NO: 8168 - DNA, 20 bp, Artificial Sequence
  Description of Artificial Sequence: Synthetic oligonucleotide
  Target: DMPK; (-) strand; PAM type: NRG; PAM sequence: GAG
gcaggagaatcagaacccag

SEQ ID NO: 8169 - DNA, 20 bp, Artificial Sequence
  Description of Artificial Sequence: Synthetic oligonucleotide
  Target: DMPK; (-) strand; PAM type: NRG; PAM sequence: AGG
aggcaggagaatcagaaccc

SEQ ID NO: 8170 - DNA, 20 bp, Artificial Sequence
  Description of Artificial Sequence: Synthetic oligonucleotide
  Target: DMPK; (-) strand; PAM type: NRG; PAM sequence: CAG
gaggcaggagaatcagaacc

SEQ ID NO: 8171 - DNA, 20 bp, Artificial Sequence
  Description of Artificial Sequence: Synthetic oligonucleotide
  Target: DMPK; (-) strand; PAM type: NRG; PAM sequence: CAG
ggaggctgaggcaggagaat

SEQ ID NO: 8172 - DNA, 20 bp, Artificial Sequence
  Description of Artificial Sequence: Synthetic oligonucleotide
  Target: DMPK; (-) strand; PAM type: NRG; PAM sequence: GAG
tactcaggaggctgaggcag

SEQ ID NO: 8173 - DNA, 20 bp, Artificial Sequence
  Description of Artificial Sequence: Synthetic oligonucleotide
  Target: DMPK; (-) strand; PAM type: NRG; PAM sequence: AGG
gctactcaggaggctgaggc

SEQ ID NO: 8174 - DNA, 20 bp, Artificial Sequence
  Description of Artificial Sequence: Synthetic oligonucleotide
  Target: DMPK; (-) strand; PAM type: NRG; PAM sequence: CAG
agctactcaggaggctgagg

SEQ ID NO: 8175 - DNA, 20 bp, Artificial Sequence
  Description of Artificial Sequence: Synthetic oligonucleotide
  Target: DMPK; (-) strand; PAM type: NRG; PAM sequence: AGG
cccagctactcaggaggctg

SEQ ID NO: 8176 - DNA, 20 bp, Artificial Sequence
  Description of Artificial Sequence: Synthetic oligonucleotide
  Target: DMPK; (-) strand; PAM type: NRG; PAM sequence: GAG
tcccagctactcaggaggct

SEQ ID NO: 8177 - DNA, 20 bp, Artificial Sequence
  Description of Artificial Sequence: Synthetic oligonucleotide
  Target: DMPK; (-) strand; PAM type: NRG; PAM sequence: AGG
tgtaatcccagctactcagg

SEQ ID NO: 8178 - DNA, 20 bp, Artificial Sequence
  Description of Artificial Sequence: Synthetic oligonucleotide
  Target: DMPK; (-) strand; PAM type: NRG; PAM sequence: GAG
ctgtaatcccagctactcag

SEQ ID NO: 8179 - DNA, 20 bp, Artificial Sequence
  Description of Artificial Sequence: Synthetic oligonucleotide
  Target: DMPK; (-) strand; PAM type: NRG; PAM sequence: AGG
acctgtaatcccagctactc

SEQ ID NO: 8180 - DNA, 20 bp, Artificial Sequence
  Description of Artificial Sequence: Synthetic oligonucleotide
  Target: DMPK; (-) strand; PAM type: NRG; PAM sequence: CAG
tacctgtaatcccagctact

SEQ ID NO: 8181 - DNA, 20 bp, Artificial Sequence
  Description of Artificial Sequence: Synthetic oligonucleotide
  Target: DMPK; (-) strand; PAM type: NRG; PAM sequence: CAG
gtggcatatacctgtaatcc

SEQ ID NO: 8182 - DNA, 20 bp, Artificial Sequence
  Description of Artificial Sequence: Synthetic oligonucleotide
  Target: DMPK; (-) strand; PAM type: NRG; PAM sequence: TGG
acaaaattagccaggcgtgg

SEQ ID NO: 8183 - DNA, 20 bp, Artificial Sequence
  Description of Artificial Sequence: Synthetic oligonucleotide
  Target: DMPK; (-) strand; PAM type: NRG; PAM sequence: TGG
aaaacaaaattagccaggcg

SEQ ID NO: 8184 - DNA, 20 bp, Artificial Sequence
  Description of Artificial Sequence: Synthetic oligonucleotide
  Target: DMPK; (-) strand; PAM type: NRG; PAM sequence: AGG
actaaaaaacaaaattagcc

SEQ ID NO: 8185 - DNA, 20 bp, Artificial Sequence
  Description of Artificial Sequence: Synthetic oligonucleotide
  Target: DMPK; (-) strand; PAM type: NRG; PAM sequence: CAG
tactaaaaaacaaaattagc

SEQ ID NO: 8186 - DNA, 20 bp, Artificial Sequence
  Description of Artificial Sequence: Synthetic oligonucleotide
  Target: DMPK; (-) strand; PAM type: NRG; PAM sequence: TAG
tctctactaaaaaacaaaat

SEQ ID NO: 8187 - DNA, 20 bp, Artificial Sequence
  Description of Artificial Sequence: Synthetic oligonucleotide
  Target: DMPK; (-) strand; PAM type: NRG; PAM sequence: GAG
agaccagcctgaccaacgtg

SEQ ID NO: 8188 - DNA, 20 bp, Artificial Sequence
  Description of Artificial Sequence: Synthetic oligonucleotide
  Target: DMPK; (-) strand; PAM type: NRG; PAM sequence: TGG
cgagaccagcctgaccaacg

SEQ ID NO: 8189 - DNA, 20 bp, Artificial Sequence
  Description of Artificial Sequence: Synthetic oligonucleotide
  Target: DMPK; (-) strand; PAM type: NRG; PAM sequence: CAG
tgaggtcaggagttcgagac

SEQ ID NO: 8190 - DNA, 20 bp, Artificial Sequence
  Description of Artificial Sequence: Synthetic oligonucleotide
  Target: DMPK; (-) strand; PAM type: NRG; PAM sequence: GAG
tcacctgaggtcaggagttc

SEQ ID NO: 8191 - DNA, 20 bp, Artificial Sequence
  Description of Artificial Sequence: Synthetic oligonucleotide
  Target: DMPK; (-) strand; PAM type: NRG; PAM sequence: GAG
ggtggatcacctgaggtcag

SEQ ID NO: 8192 - DNA, 20 bp, Artificial Sequence
  Description of Artificial Sequence: Synthetic oligonucleotide
  Target: DMPK; (-) strand; PAM type: NRG; PAM sequence: AGG
tgggtggatcacctgaggtc

SEQ ID NO: 8193 - DNA, 20 bp, Artificial Sequence
  Description of Artificial Sequence: Synthetic oligonucleotide
  Target: DMPK; (-) strand; PAM type: NRG; PAM sequence: CAG
gtgggtggatcacctgaggt

SEQ ID NO: 8194 - DNA, 20 bp, Artificial Sequence
  Description of Artificial Sequence: Synthetic oligonucleotide
  Target: DMPK; (-) strand; PAM type: NRG; PAM sequence: AGG
tgaggtgggtggatcacctg

SEQ ID NO: 8195 - DNA, 20 bp, Artificial Sequence
  Description of Artificial Sequence: Synthetic oligonucleotide
  Target: DMPK; (-) strand; PAM type: NRG; PAM sequence: GAG
atgaggtgggtggatcacct

SEQ ID NO: 8196 - DNA, 20 bp, Artificial Sequence
  Description of Artificial Sequence: Synthetic oligonucleotide
  Target: DMPK; (-) strand; PAM type: NRG; PAM sequence: TGG
ctttgggaggatgaggtggg

SEQ ID NO: 8197 - DNA, 20 bp, Artificial Sequence
  Description of Artificial Sequence: Synthetic oligonucleotide
  Target: DMPK; (-) strand; PAM type: NRG; PAM sequence: GGG
gtgctttgggaggatgaggt

SEQ ID NO: 8198 - DNA, 20 bp, Artificial Sequence
  Description of Artificial Sequence: Synthetic oligonucleotide
  Target: DMPK; (-) strand; PAM type: NRG; PAM sequence: TGG
agtgctttgggaggatgagg

SEQ ID NO: 8199 - DNA, 20 bp, Artificial Sequence
  Description of Artificial Sequence: Synthetic oligonucleotide
  Target: DMPK; (-) strand; PAM type: NRG; PAM sequence: AGG
tccagtgctttgggaggatg

SEQ ID NO: 8200 - DNA, 20 bp, Artificial Sequence
  Description of Artificial Sequence: Synthetic oligonucleotide
  Target: DMPK; (-) strand; PAM type: NRG; PAM sequence: GAG
ttccagtgctttgggaggat

SEQ ID NO: 8201 - DNA, 20 bp, Artificial Sequence
  Description of Artificial Sequence: Synthetic oligonucleotide
  Target: DMPK; (-) strand; PAM type: NRG; PAM sequence: AGG
tgtaattccagtgctttggg

SEQ ID NO: 8202 - DNA, 20 bp, Artificial Sequence
  Description of Artificial Sequence: Synthetic oligonucleotide
  Target: DMPK; (-) strand; PAM type: NRG; PAM sequence: GAG
ctgtaattccagtgctttgg

SEQ ID NO: 8203 - DNA, 20 bp, Artificial Sequence
  Description of Artificial Sequence: Synthetic oligonucleotide
  Target: DMPK; (-) strand; PAM type: NRG; PAM sequence: GGG
gcctgtaattccagtgcttt

SEQ ID NO: 8204 - DNA, 20 bp, Artificial Sequence
  Description of Artificial Sequence: Synthetic oligonucleotide
  Target: DMPK; (-) strand; PAM type: NRG; PAM sequence: TGG
cgcctgtaattccagtgctt

SEQ ID NO: 8205 - DNA, 20 bp, Artificial Sequence
  Description of Artificial Sequence: Synthetic oligonucleotide
  Target: DMPK; (-) strand; PAM type: NRG; PAM sequence: CAG
gtggctcacgcctgtaattc

SEQ ID NO: 8206 - DNA, 20 bp, Artificial Sequence
  Description of Artificial Sequence: Synthetic oligonucleotide
  Target: DMPK; (-) strand; PAM type: NRG; PAM sequence: TGG
tttatttaggccgggtgtgg

SEQ ID NO: 8207 - DNA, 20 bp, Artificial Sequence
  Description of Artificial Sequence: Synthetic oligonucleotide
  Target: DMPK; (-) strand; PAM type: NRG; PAM sequence: TGG
gtatttatttaggccgggtg

SEQ ID NO: 8208 - DNA, 20 bp, Artificial Sequence
  Description of Artificial Sequence: Synthetic oligonucleotide
  Target: DMPK; (-) strand; PAM type: NRG; PAM sequence: GGG
aaaaagtatttatttaggcc

SEQ ID NO: 8209 - DNA, 20 bp, Artificial Sequence
  Description of Artificial Sequence: Synthetic oligonucleotide
  Target: DMPK; (-) strand; PAM type: NRG; PAM sequence: CGG
aaaaaagtatttatttaggc

SEQ ID NO: 8210 - DNA, 20 bp, Artificial Sequence
  Description of Artificial Sequence: Synthetic oligonucleotide
  Target: DMPK; (-) strand; PAM type: NRG; PAM sequence: AGG
aaaaaaaaaagtatttattt

SEQ ID NO: 8211 - DNA, 20 bp, Artificial Sequence
  Description of Artificial Sequence: Synthetic oligonucleotide
  Target: DMPK; (-) strand; PAM type: NRG; PAM sequence: TAG
aaaaaaaaaaagtatttatt

SEQ ID NO: 8212 - DNA, 20 bp, Artificial Sequence
  Description of Artificial Sequence: Synthetic oligonucleotide
  Target: DMPK; (-) strand; PAM type: NRG; PAM sequence: AAG
tctcaaaaaaaaaaaaaaaa

SEQ ID NO: 8213 - DNA, 20 bp, Artificial Sequence
  Description of Artificial Sequence: Synthetic oligonucleotide
  Target: DMPK; (-) strand; PAM type: NRG; PAM sequence: AAG
tccagcctgggcgacagagc

SEQ ID NO: 8214 - DNA, 20 bp, Artificial Sequence
  Description of Artificial Sequence: Synthetic oligonucleotide
  Target: DMPK; (-) strand; PAM type: NRG; PAM sequence: GAG
gcactccagcctgggcgaca

SEQ ID NO: 8215 - DNA, 20 bp, Artificial Sequence
  Description of Artificial Sequence: Synthetic oligonucleotide
  Target: DMPK; (-) strand; PAM type: NRG; PAM sequence: CAG
ctgcactccagcctgggcga

SEQ ID NO: 8216 - DNA, 20 bp, Artificial Sequence
  Description of Artificial Sequence: Synthetic oligonucleotide
  Target: DMPK; (-) strand; PAM type: NRG; PAM sequence: GGG
atgccactgcactccagcct

SEQ ID NO: 8217 - DNA, 20 bp, Artificial Sequence
  Description of Artificial Sequence: Synthetic oligonucleotide
  Target: DMPK; (-) strand; PAM type: NRG; PAM sequence: TGG
catgccactgcactccagcc

SEQ ID NO: 8218 - DNA, 20 bp, Artificial Sequence
  Description of Artificial Sequence: Synthetic oligonucleotide
  Target: DMPK; (-) strand; PAM type: NRG; PAM sequence: CAG
gagatcatgccactgcactc

SEQ ID NO: 8219 - DNA, 20 bp, Artificial Sequence
  Description of Artificial Sequence: Synthetic oligonucleotide
  Target: DMPK; (-) strand; PAM type: NRG; PAM sequence: GAG
ggcggagcttgcagtgagcc

SEQ ID NO: 8220 - DNA, 20 bp, Artificial Sequence
  Description of Artificial Sequence: Synthetic oligonucleotide
  Target: DMPK; (-) strand; PAM type: NRG; PAM sequence: GAG
cgggaggcggagcttgcagt

SEQ ID NO: 8221 - DNA, 20 bp, Artificial Sequence
  Description of Artificial Sequence: Synthetic oligonucleotide
  Target: DMPK; (-) strand; PAM type: NRG; PAM sequence: CAG
aacccgggaggcggagcttg

SEQ ID NO: 8222 - DNA, 20 bp, Artificial Sequence
  Description of Artificial Sequence: Synthetic oligonucleotide
  Target: DMPK; (-) strand; PAM type: NRG; PAM sequence: GAG
tggcatgaacccgggaggcg

SEQ ID NO: 8223 - DNA, 20 bp, Artificial Sequence
  Description of Artificial Sequence: Synthetic oligonucleotide
  Target: DMPK; (-) strand; PAM type: NRG; PAM sequence: CGG
aatggcatgaacccgggagg

SEQ ID NO: 8224 - DNA, 20 bp, Artificial Sequence
  Description of Artificial Sequence: Synthetic oligonucleotide
  Target: DMPK; (-) strand; PAM type: NRG; PAM sequence: AGG
gagaatggcatgaacccggg

SEQ ID NO: 8225 - DNA, 20 bp, Artificial Sequence
  Description of Artificial Sequence: Synthetic oligonucleotide
  Target: DMPK; (-) strand; PAM type: NRG; PAM sequence: GAG
ggagaatggcatgaacccgg

SEQ ID NO: 8226 - DNA, 20 bp, Artificial Sequence
  Description of Artificial Sequence: Synthetic oligonucleotide
  Target: DMPK; (-) strand; PAM type: NRG; PAM sequence: GGG
caggagaatggcatgaaccc

SEQ ID NO: 8227 - DNA, 20 bp, Artificial Sequence
  Description of Artificial Sequence: Synthetic oligonucleotide
  Target: DMPK; (-) strand; PAM type: NRG; PAM sequence: CGG
gcaggagaatggcatgaacc

SEQ ID NO: 8228 - DNA, 20 bp, Artificial Sequence
  Description of Artificial Sequence: Synthetic oligonucleotide
  Target: DMPK; (-) strand; PAM type: NRG; PAM sequence: TGG
tgggaggcgaggcaggagaa

SEQ ID NO: 8229 - DNA, 20 bp, Artificial Sequence
  Description of Artificial Sequence: Synthetic oligonucleotide
  Target: DMPK; (-) strand; PAM type: NRG; PAM sequence: GAG
ctacttgggaggcgaggcag

SEQ ID NO: 8230 - DNA, 20 bp, Artificial Sequence
  Description of Artificial Sequence: Synthetic oligonucleotide
  Target: DMPK; (-) strand; PAM type: NRG; PAM sequence: AGG
agctacttgggaggcgaggc

SEQ ID NO: 8231 - DNA, 20 bp, Artificial Sequence
  Description of Artificial Sequence: Synthetic oligonucleotide
  Target: DMPK; (-) strand; PAM type: NRG; PAM sequence: CAG
cagctacttgggaggcgagg

SEQ ID NO: 8232 - DNA, 20 bp, Artificial Sequence
  Description of Artificial Sequence: Synthetic oligonucleotide
  Target: DMPK; (-) strand; PAM type: NRG; PAM sequence: AGG
tcccagctacttgggaggcg

SEQ ID NO: 8233 - DNA, 20 bp, Artificial Sequence
  Description of Artificial Sequence: Synthetic oligonucleotide
  Target: DMPK; (-) strand; PAM type: NRG; PAM sequence: GAG
gtcccagctacttgggaggc

SEQ ID NO: 8234 - DNA, 20 bp, Artificial Sequence
  Description of Artificial Sequence: Synthetic oligonucleotide
  Target: DMPK; (-) strand; PAM type: NRG; PAM sequence: AGG
tgcggtcccagctacttggg

SEQ ID NO: 8235 - DNA, 20 bp, Artificial Sequence
  Description of Artificial Sequence: Synthetic oligonucleotide
  Target: DMPK; (-) strand; PAM type: NRG; PAM sequence: GAG
ttgcggtcccagctacttgg

SEQ ID NO: 8236 - DNA, 20 bp, Artificial Sequence
  Description of Artificial Sequence: Synthetic oligonucleotide
  Target: DMPK; (-) strand; PAM type: NRG; PAM sequence: GGG
gcttgcggtcccagctactt

SEQ ID NO: 8237 - DNA, 20 bp, Artificial Sequence
  Description of Artificial Sequence: Synthetic oligonucleotide
  Target: DMPK; (-) strand; PAM type: NRG; PAM sequence: TGG
cgcttgcggtcccagctact

SEQ ID NO: 8238 - DNA, 20 bp, Artificial Sequence
  Description of Artificial Sequence: Synthetic oligonucleotide
  Target: DMPK; (-) strand; PAM type: NRG; PAM sequence: CAG
gtggcgggcgcttgcggtcc

SEQ ID NO: 8239 - DNA, 20 bp, Artificial Sequence
  Description of Artificial Sequence: Synthetic oligonucleotide
  Target: DMPK; (-) strand; PAM type: NRG; PAM sequence: CGG
ggcatggtggcgggcgcttg

SEQ ID NO: 8240 - DNA, 20 bp, Artificial Sequence
  Description of Artificial Sequence: Synthetic oligonucleotide
  Target: DMPK; (-) strand; PAM type: NRG; PAM sequence: GGG
aattagccgggcatggtggc

SEQ ID NO: 8241 - DNA, 20 bp, Artificial Sequence
  Description of Artificial Sequence: Synthetic oligonucleotide
  Target: DMPK; (-) strand; PAM type: NRG; PAM sequence: CGG
aaattagccgggcatggtgg

SEQ ID NO: 8242 - DNA, 20 bp, Artificial Sequence
  Description of Artificial Sequence: Synthetic oligonucleotide
  Target: DMPK; (-) strand; PAM type: NRG; PAM sequence: TGG
aaaaaattagccgggcatgg

SEQ ID NO: 8243 - DNA, 20 bp, Artificial Sequence
  Description of Artificial Sequence: Synthetic oligonucleotide
  Target: DMPK; (-) strand; PAM type: NRG; PAM sequence: TGG
acaaaaaaattagccgggca

SEQ ID NO: 8244 - DNA, 20 bp, Artificial Sequence
  Description of Artificial Sequence: Synthetic oligonucleotide
  Target: DMPK; (-) strand; PAM type: NRG; PAM sequence: GGG
aaaatacaaaaaaattagcc

SEQ ID NO: 8245 - DNA, 20 bp, Artificial Sequence
  Description of Artificial Sequence: Synthetic oligonucleotide
  Target: DMPK; (-) strand; PAM type: NRG; PAM sequence: CGG
aaaaatacaaaaaaattagc

SEQ ID NO: 8246 - DNA, 20 bp, Artificial Sequence
  Description of Artificial Sequence: Synthetic oligonucleotide
  Target: DMPK; (-) strand; PAM type: NRG; PAM sequence: TAG
tactaaaaatacaaaaaaat

SEQ ID NO: 8247 - DNA, 20 bp, Artificial Sequence
  Description of Artificial Sequence: Synthetic oligonucleotide
  Target: DMPK; (-) strand; PAM type: NRG; PAM sequence: CGG
cgagaccatcctggctaaca

SEQ ID NO: 8248 - DNA, 20 bp, Artificial Sequence
  Description of Artificial Sequence: Synthetic oligonucleotide
  Target: DMPK; (-) strand; PAM type: NRG; PAM sequence: TGG
tcaggagatcgagaccatcc

SEQ ID NO: 8249 - DNA, 20 bp, Artificial Sequence
  Description of Artificial Sequence: Synthetic oligonucleotide
  Target: DMPK; (-) strand; PAM type: NRG; PAM sequence: GAG
gatcatgaggtcaggagatc

SEQ ID NO: 8250 - DNA, 20 bp, Artificial Sequence
  Description of Artificial Sequence: Synthetic oligonucleotide
  Target: DMPK; (-) strand; PAM type: NRG; PAM sequence: GAG
caggtggatcatgaggtcag

SEQ ID NO: 8251 - DNA, 20 bp, Artificial Sequence
  Description of Artificial Sequence: Synthetic oligonucleotide
  Target: DMPK; (-) strand; PAM type: NRG; PAM sequence: AGG
ggcaggtggatcatgaggtc

SEQ ID NO: 8252 - DNA, 20 bp, Artificial Sequence
  Description of Artificial Sequence: Synthetic oligonucleotide
  Target: DMPK; (-) strand; PAM type: NRG; PAM sequence: CAG
aggcaggtggatcatgaggt

SEQ ID NO: 8253 - DNA, 20 bp, Artificial Sequence
  Description of Artificial Sequence: Synthetic oligonucleotide
  Target: DMPK; (-) strand; PAM type: NRG; PAM sequence: AGG
gccaaggcaggtggatcatg

SEQ ID NO: 8254 - DNA, 20 bp, Artificial Sequence
  Description of Artificial Sequence: Synthetic oligonucleotide
  Target: DMPK; (-) strand; PAM type: NRG; PAM sequence: GAG
ggccaaggcaggtggatcat

SEQ ID NO: 8255 - DNA, 20 bp, Artificial Sequence
  Description of Artificial Sequence: Synthetic oligonucleotide
  Target: DMPK; (-) strand; PAM type: NRG; PAM sequence: TGG
ctttgggaggccaaggcagg

SEQ ID NO: 8256 - DNA, 20 bp, Artificial Sequence
  Description of Artificial Sequence: Synthetic oligonucleotide
  Target: DMPK; (-) strand; PAM type: NRG; PAM sequence: AGG
gcactttgggaggccaaggc

SEQ ID NO: 8257 - DNA, 20 bp, Artificial Sequence
  Description of Artificial Sequence: Synthetic oligonucleotide
  Target: DMPK; (-) strand; PAM type: NRG; PAM sequence: CAG
agcactttgggaggccaagg

SEQ ID NO: 8258 - DNA, 20 bp, Artificial Sequence
  Description of Artificial Sequence: Synthetic oligonucleotide
  Target: DMPK; (-) strand; PAM type: NRG; PAM sequence: AGG
cctagcactttgggaggcca

SEQ ID NO: 8259 - DNA, 20 bp, Artificial Sequence
  Description of Artificial Sequence: Synthetic oligonucleotide
  Target: DMPK; (-) strand; PAM type: NRG; PAM sequence: AAG
tcctagcactttgggaggcc

SEQ ID NO: 8260 - DNA, 20 bp, Artificial Sequence
  Description of Artificial Sequence: Synthetic oligonucleotide
  Target: DMPK; (-) strand; PAM type: NRG; PAM sequence: AGG
tgtaatcctagcactttggg

SEQ ID NO: 8261 - DNA, 20 bp, Artificial Sequence
  Description of Artificial Sequence: Synthetic oligonucleotide
  Target: DMPK; (-) strand; PAM type: NRG; PAM sequence: GAG
ctgtaatcctagcactttgg

SEQ ID NO: 8262 - DNA, 20 bp, Artificial Sequence
  Description of Artificial Sequence: Synthetic oligonucleotide
  Target: DMPK; (-) strand; PAM type: NRG; PAM sequence: GGG
gcctgtaatcctagcacttt

SEQ ID NO: 8263 - DNA, 20 bp, Artificial Sequence
  Description of Artificial Sequence: Synthetic oligonucleotide
  Target: DMPK; (-) strand; PAM type: NRG; PAM sequence: TGG
cgcctgtaatcctagcactt

SEQ ID NO: 8264 - DNA, 20 bp, Artificial Sequence
  Description of Artificial Sequence: Synthetic oligonucleotide
  Target: DMPK; (-) strand; PAM type: NRG; PAM sequence: TAG
gtggctcacgcctgtaatcc

SEQ ID NO: 8265 - DNA, 20 bp, Artificial Sequence
  Description of Artificial Sequence: Synthetic oligonucleotide
  Target: DMPK; (-) strand; PAM type: NRG; PAM sequence: TGG
ttaatttaggcgggccgcgg

SEQ ID NO: 8266 - DNA, 20 bp, Artificial Sequence
  Description of Artificial Sequence: Synthetic oligonucleotide
  Target: DMPK; (-) strand; PAM type: NRG; PAM sequence: CGG
gtattaatttaggcgggccg

SEQ ID NO: 8267 - DNA, 20 bp, Artificial Sequence
  Description of Artificial Sequence: Synthetic oligonucleotide
  Target: DMPK; (-) strand; PAM type: NRG; PAM sequence: GGG
ttaaaagtattaatttaggc

SEQ ID NO: 8268 - DNA, 20 bp, Artificial Sequence
  Description of Artificial Sequence: Synthetic oligonucleotide
  Target: DMPK; (-) strand; PAM type: NRG; PAM sequence: CGG
tttaaaagtattaatttagg

SEQ ID NO: 8269 - DNA, 20 bp, Artificial Sequence
  Description of Artificial Sequence: Synthetic oligonucleotide
  Target: DMPK; (-) strand; PAM type: NRG; PAM sequence: AGG
ccatttaaaagtattaattt

SEQ ID NO: 8270 - DNA, 20 bp, Artificial Sequence
  Description of Artificial Sequence: Synthetic oligonucleotide
  Target: DMPK; (-) strand; PAM type: NRG; PAM sequence: TAG
gccatttaaaagtattaatt

SEQ ID NO: 8271 - DNA, 20 bp, Artificial Sequence
  Description of Artificial Sequence: Synthetic oligonucleotide
  Target: DMPK; (-) strand; PAM type: NRG; PAM sequence: AAG
ataacaataaggccatttaa

SEQ ID NO: 8272 - DNA, 20 bp, Artificial Sequence
  Description of Artificial Sequence: Synthetic oligonucleotide
  Target: DMPK; (-) strand; PAM type: NRG; PAM sequence: AGG
gaatcagccatataacaata

SEQ ID NO: 8273 - DNA, 20 bp, Artificial Sequence
  Description of Artificial Sequence: Synthetic oligonucleotide
  Target: DMPK; (-) strand; PAM type: NRG; PAM sequence: AAG
tgaatcagccatataacaat

SEQ ID NO: 8274 - DNA, 20 bp, Artificial Sequence
  Description of Artificial Sequence: Synthetic oligonucleotide
  Target: DMPK; (-) strand; PAM type: NRG; PAM sequence: CAG
agaatgcaaattctttgaat

SEQ ID NO: 8275 - DNA, 20 bp, Artificial Sequence
  Description of Artificial Sequence: Synthetic oligonucleotide
  Target: DMPK; (-) strand; PAM type: NRG; PAM sequence: AAG
acttttacaatcagttgtaa

SEQ ID NO: 8276 - DNA, 20 bp, Artificial Sequence
  Description of Artificial Sequence: Synthetic oligonucleotide
  Target: DMPK; (-) strand; PAM type: NRG; PAM sequence: CAG
gaagtttagacttttacaat

SEQ ID NO: 8277 - DNA, 20 bp, Artificial Sequence
  Description of Artificial Sequence: Synthetic oligonucleotide
  Target: DMPK; (-) strand; PAM type: NRG; PAM sequence: TAG
aacttggaaaatatgaagtt

SEQ ID NO: 8278 - DNA, 20 bp, Artificial Sequence
  Description of Artificial Sequence: Synthetic oligonucleotide
  Target: DMPK; (-) strand; PAM type: NRG; PAM sequence: AAG
ttcagaacttggaaaatatg

SEQ ID NO: 8279 - DNA, 20 bp, Artificial Sequence
  Description of Artificial Sequence: Synthetic oligonucleotide
  Target: DMPK; (-) strand; PAM type: NRG; PAM sequence: TGG
agccacaggacttcagaact

SEQ ID NO: 8280 - DNA, 20 bp, Artificial Sequence
  Description of Artificial Sequence: Synthetic oligonucleotide
  Target: DMPK; (-) strand; PAM type: NRG; PAM sequence: CAG
tacacagagccacaggactt

SEQ ID NO: 8281 - DNA, 20 bp, Artificial Sequence
  Description of Artificial Sequence: Synthetic oligonucleotide
  Target: DMPK; (-) strand; PAM type: NRG; PAM sequence: AGG
tctgtagtacacagagccac

SEQ ID NO: 8282 - DNA, 20 bp, Artificial Sequence
  Description of Artificial Sequence: Synthetic oligonucleotide
  Target: DMPK; (-) strand; PAM type: NRG; PAM sequence: CAG
gtctgtagtacacagagcca

SEQ ID NO: 8283 - DNA, 20 bp, Artificial Sequence
  Description of Artificial Sequence: Synthetic oligonucleotide
  Target: DMPK; (-) strand; PAM type: NRG; PAM sequence: GAG
ttttacgtctgtagtacaca

SEQ ID NO: 8284 - DNA, 20 bp, Artificial Sequence
  Description of Artificial Sequence: Synthetic oligonucleotide
  Target: DMPK; (-) strand; PAM type: NRG; PAM sequence: CAG
acttttacgtctgtagtaca

SEQ ID NO: 8285 - DNA, 20 bp, Artificial Sequence
  Description of Artificial Sequence: Synthetic oligonucleotide
  Target: DMPK; (-) strand; PAM type: NRG; PAM sequence: TAG
accattaacttttacgtctg

SEQ ID NO: 8286 - DNA, 20 bp, Artificial Sequence
  Description of Artificial Sequence: Synthetic oligonucleotide
  Target: DMPK; (-) strand; PAM type: NRG; PAM sequence: CAG
gagtcacagactgggcttcc

SEQ ID NO: 8287 - DNA, 20 bp, Artificial Sequence
  Description of Artificial Sequence: Synthetic oligonucleotide
  Target: DMPK; (-) strand; PAM type: NRG; PAM sequence: GGG
aaacctcagagtcacagact

SEQ ID NO: 8288 - DNA, 20 bp, Artificial Sequence
  Description of Artificial Sequence: Synthetic oligonucleotide
  Target: DMPK; (-) strand; PAM type: NRG; PAM sequence: TGG
aaaacctcagagtcacagac

SEQ ID NO: 8289 - DNA, 20 bp, Artificial Sequence
  Description of Artificial Sequence: Synthetic oligonucleotide
  Target: DMPK; (-) strand; PAM type: NRG; PAM sequence: CAG
attttaaaacctcagagtca

SEQ ID NO: 8290 - DNA, 20 bp, Artificial Sequence
  Description of Artificial Sequence: Synthetic oligonucleotide
  Target: DMPK; (-) strand; PAM type: NRG; PAM sequence: GAG
gattgaattttaaaacctca

SEQ ID NO: 8291 - DNA, 20 bp, Artificial Sequence
  Description of Artificial Sequence: Synthetic oligonucleotide
  Target: DMPK; (-) strand; PAM type: NRG; PAM sequence: CAG
tagattgaattttaaaacct

SEQ ID NO: 8292 - DNA, 20 bp, Artificial Sequence
  Description of Artificial Sequence: Synthetic oligonucleotide
  Target: DMPK; (-) strand; PAM type: NRG; PAM sequence: TAG
atctatgtacttcaaaatgt

SEQ ID NO: 8293 - DNA, 20 bp, Artificial Sequence
  Description of Artificial Sequence: Synthetic oligonucleotide
  Target: DMPK; (-) strand; PAM type: NRG; PAM sequence: CAG
gttggaggaccttaaatttt

SEQ ID NO: 8294 - DNA, 20 bp, Artificial Sequence
  Description of Artificial Sequence: Synthetic oligonucleotide
  Target: DMPK; (-) strand; PAM type: NRG; PAM sequence: AGG
tcctaagaggccagagttgg

SEQ ID NO: 8295 - DNA, 20 bp, Artificial Sequence
  Description of Artificial Sequence: Synthetic oligonucleotide
  Target: DMPK; (-) strand; PAM type: NRG; PAM sequence: GAG
ctcctaagaggccagagttg

SEQ ID NO: 8296 - DNA, 20 bp, Artificial Sequence
  Description of Artificial Sequence: Synthetic oligonucleotide
  Target: DMPK; (-) strand; PAM type: NRG; PAM sequence: TGG
gactcctaagaggccagagt

SEQ ID NO: 8297 - DNA, 20 bp, Artificial Sequence
  Description of Artificial Sequence: Synthetic oligonucleotide
  Target: DMPK; (-) strand; PAM type: NRG; PAM sequence: GAG
caaagactcctaagaggcca

SEQ ID NO: 8298 - DNA, 20 bp, Artificial Sequence
  Description of Artificial Sequence: Synthetic oligonucleotide
  Target: DMPK; (-) strand; PAM type: NRG; PAM sequence: CAG
cccaaagactcctaagaggc

SEQ ID NO: 8299 - DNA, 20 bp, Artificial Sequence
  Description of Artificial Sequence: Synthetic oligonucleotide
  Target: DMPK; (-) strand; PAM type: NRG; PAM sequence: AGG
tgggcccaaagactcctaag

SEQ ID NO: 8300 - DNA, 20 bp, Artificial Sequence
  Description of Artificial Sequence: Synthetic oligonucleotide
  Target: DMPK; (-) strand; PAM type: NRG; PAM sequence: GAG
ttgggcccaaagactcctaa

SEQ ID NO: 8301 - DNA, 20 bp, Artificial Sequence
  Description of Artificial Sequence: Synthetic oligonucleotide
  Target: DMPK; (-) strand; PAM type: NRG; PAM sequence: AAG
ttttgggcccaaagactcct

SEQ ID NO: 8302 - DNA, 20 bp, Artificial Sequence
  Description of Artificial Sequence: Synthetic oligonucleotide
  Target: DMPK; (-) strand; PAM type: NRG; PAM sequence: AAG
accttactgttttgggccca

SEQ ID NO: 8303 - DNA, 20 bp, Artificial Sequence
  Description of Artificial Sequence: Synthetic oligonucleotide
  Target: DMPK; (-) strand; PAM type: NRG; PAM sequence: GGG
tcttggaaccttactgtttt

SEQ ID NO: 8304 - DNA, 20 bp, Artificial Sequence
  Description of Artificial Sequence: Synthetic oligonucleotide
  Target: DMPK; (-) strand; PAM type: NRG; PAM sequence: TGG
gtcttggaaccttactgttt

SEQ ID NO: 8305 - DNA, 20 bp, Artificial Sequence
  Description of Artificial Sequence: Synthetic oligonucleotide
  Target: DMPK; (-) strand; PAM type: NRG; PAM sequence: TGG
tggagttgcaggatcagtct

SEQ ID NO: 8306 - DNA, 20 bp, Artificial Sequence
  Description of Artificial Sequence: Synthetic oligonucleotide
  Target: DMPK; (-) strand; PAM type: NRG; PAM sequence: CAG
agccaatggagttgcaggat

SEQ ID NO: 8307 - DNA, 20 bp, Artificial Sequence
  Description of Artificial Sequence: Synthetic oligonucleotide
  Target: DMPK; (-) strand; PAM type: NRG; PAM sequence: AGG
ttggcagccaatggagttgc

SEQ ID NO: 8308 - DNA, 20 bp, Artificial Sequence
  Description of Artificial Sequence: Synthetic oligonucleotide
  Target: DMPK; (-) strand; PAM type: NRG; PAM sequence: CAG
cttggcagccaatggagttg

SEQ ID NO: 8309 - DNA, 20 bp, Artificial Sequence
  Description of Artificial Sequence: Synthetic oligonucleotide
  Target: DMPK; (-) strand; PAM type: NRG; PAM sequence: GAG
ctgctccttggcagccaatg

SEQ ID NO: 8310 - DNA, 20 bp, Artificial Sequence
  Description of Artificial Sequence: Synthetic oligonucleotide
  Target: DMPK; (-) strand; PAM type: NRG; PAM sequence: TGG
tcctgctccttggcagccaa

SEQ ID NO: 8311 - DNA, 20 bp, Artificial Sequence
  Description of Artificial Sequence: Synthetic oligonucleotide
  Target: DMPK; (-) strand; PAM type: NRG; PAM sequence: CAG
tcctgggtcctgctccttgg

SEQ ID NO: 8312 - DNA, 20 bp, Artificial Sequence
  Description of Artificial Sequence: Synthetic oligonucleotide
  Target: DMPK; (-) strand; PAM type: NRG; PAM sequence: TGG
gcttcctgggtcctgctcct

SEQ ID NO: 8313 - DNA, 20 bp, Artificial Sequence
  Description of Artificial Sequence: Synthetic oligonucleotide
  Target: DMPK; (-) strand; PAM type: NRG; PAM sequence: GGG
cgaggctgcttgagcttcct

SEQ ID NO: 8314 - DNA, 20 bp, Artificial Sequence
  Description of Artificial Sequence: Synthetic oligonucleotide
  Target: DMPK; (-) strand; PAM type: NRG; PAM sequence: TGG
acgaggctgcttgagcttcc

SEQ ID NO: 8315 - DNA, 20 bp, Artificial Sequence
  Description of Artificial Sequence: Synthetic oligonucleotide
  Target: DMPK; (-) strand; PAM type: NRG; PAM sequence: GAG
caggggccacgaggctgctt

SEQ ID NO: 8316 - DNA, 20 bp, Artificial Sequence
  Description of Artificial Sequence: Synthetic oligonucleotide
  Target: DMPK; (-) strand; PAM type: NRG; PAM sequence: AGG
gacggcctccaggggccacg

SEQ ID NO: 8317 - DNA, 20 bp, Artificial Sequence
  Description of Artificial Sequence: Synthetic oligonucleotide
  Target: DMPK; (-) strand; PAM type: NRG; PAM sequence: GAG
ggacggcctccaggggccac

SEQ ID NO: 8318 - DNA, 20 bp, Artificial Sequence
  Description of Artificial Sequence: Synthetic oligonucleotide
  Target: DMPK; (-) strand; PAM type: NRG; PAM sequence: GGG
ctgccctggacggcctccag

SEQ ID NO: 8319 - DNA, 20 bp, Artificial Sequence
  Description of Artificial Sequence: Synthetic oligonucleotide
  Target: DMPK; (-) strand; PAM type: NRG; PAM sequence: GGG
actgccctggacggcctcca

SEQ ID NO: 8320 - DNA, 20 bp, Artificial Sequence
  Description of Artificial Sequence: Synthetic oligonucleotide
  Target: DMPK; (-) strand; PAM type: NRG; PAM sequence: AGG
cactgccctggacggcctcc

SEQ ID NO: 8321 - DNA, 20 bp, Artificial Sequence
  Description of Artificial Sequence: Synthetic oligonucleotide
  Target: DMPK; (-) strand; PAM type: NRG; PAM sequence: CAG
gcactgccctggacggcctc

SEQ ID NO: 8322 - DNA, 20 bp, Artificial Sequence
  Description of Artificial Sequence: Synthetic oligonucleotide
  Target: DMPK; (-) strand; PAM type: NRG; PAM sequence: CGG
caggtaagcactgccctgga

SEQ ID NO: 8323 - DNA, 20 bp, Artificial Sequence
  Description of Artificial Sequence: Synthetic oligonucleotide
  Target: DMPK; (-) strand; PAM type: NRG; PAM sequence: TGG
ccctcaggtaagcactgccc

SEQ ID NO: 8324 - DNA, 20 bp, Artificial Sequence
  Description of Artificial Sequence: Synthetic oligonucleotide
  Target: DMPK; (-) strand; PAM type: NRG; PAM sequence: AAG
ctcctgcatggccctcaggt

SEQ ID NO: 8325 - DNA, 20 bp, Artificial Sequence
  Description of Artificial Sequence: Synthetic oligonucleotide
  Target: DMPK; (-) strand; PAM type: NRG; PAM sequence: AGG
cctactcctgcatggccctc

SEQ ID NO: 8326 - DNA, 20 bp, Artificial Sequence
  Description of Artificial Sequence: Synthetic oligonucleotide
  Target: DMPK; (-) strand; PAM type: NRG; PAM sequence: CAG
tcctactcctgcatggccct

SEQ ID NO: 8327 - DNA, 20 bp, Artificial Sequence
  Description of Artificial Sequence: Synthetic oligonucleotide
  Target: DMPK; (-) strand; PAM type: NRG; PAM sequence: TGG
gggctactcctactcctgca

SEQ ID NO: 8328 - DNA, 20 bp, Artificial Sequence
  Description of Artificial Sequence: Synthetic oligonucleotide
  Target: DMPK; (-) strand; PAM type: NRG; PAM sequence: GGG
ggggtccacctgccttttgt

SEQ ID NO: 8329 - DNA, 20 bp, Artificial Sequence
  Description of Artificial Sequence: Synthetic oligonucleotide
  Target: DMPK; (-) strand; PAM type: NRG; PAM sequence: TGG
aggggtccacctgccttttg

SEQ ID NO: 8330 - DNA, 20 bp, Artificial Sequence
  Description of Artificial Sequence: Synthetic oligonucleotide
  Target: DMPK; (-) strand; PAM type: NRG; PAM sequence: GGG
tcgggaaggtgcgccgctag

SEQ ID NO: 8331 - DNA, 20 bp, Artificial Sequence
  Description of Artificial Sequence: Synthetic oligonucleotide
  Target: DMPK; (-) strand; PAM type: NRG; PAM sequence: GGG
ttcgggaaggtgcgccgcta

SEQ ID NO: 8332 - DNA, 20 bp, Artificial Sequence
  Description of Artificial Sequence: Synthetic oligonucleotide
  Target: DMPK; (-) strand; PAM type: NRG; PAM sequence: AGG
attcgggaaggtgcgccgct

SEQ ID NO: 8333 - DNA, 20 bp, Artificial Sequence
  Description of Artificial Sequence: Synthetic oligonucleotide
  Target: DMPK; (-) strand; PAM type: NRG; PAM sequence: TAG
cattcgggaaggtgcgccgc

SEQ ID NO: 8334 - DNA, 20 bp, Artificial Sequence
  Description of Artificial Sequence: Synthetic oligonucleotide
  Target: DMPK; (-) strand; PAM type: NRG; PAM sequence: AGG
acactgtcggacattcggga

SEQ ID NO: 8335 - DNA, 20 bp, Artificial Sequence
  Description of Artificial Sequence: Synthetic oligonucleotide
  Target: DMPK; (-) strand; PAM type: NRG; PAM sequence: AAG
gacactgtcggacattcggg

SEQ ID NO: 8336 - DNA, 20 bp, Artificial Sequence
  Description of Artificial Sequence: Synthetic oligonucleotide
  Target: DMPK; (-) strand; PAM type: NRG; PAM sequence: GGG
ggagacactgtcggacattc

SEQ ID NO: 8337 - DNA, 20 bp, Artificial Sequence
  Description of Artificial Sequence: Synthetic oligonucleotide
  Target: DMPK; (-) strand; PAM type: NRG; PAM sequence: CGG
aggagacactgtcggacatt

SEQ ID NO: 8338 - DNA, 20 bp, Artificial Sequence
  Description of Artificial Sequence: Synthetic oligonucleotide
  Target: DMPK; (-) strand; PAM type: NRG; PAM sequence: CGG
tcttgcgcaggagacactgt

SEQ ID NO: 8339 - DNA, 20 bp, Artificial Sequence
  Description of Artificial Sequence: Synthetic oligonucleotide
  Target: DMPK; (-) strand; PAM type: NRG; PAM sequence: GAG
catctgtgtgtcttgcgcag

SEQ ID NO: 8340 - DNA, 20 bp, Artificial Sequence
  Description of Artificial Sequence: Synthetic oligonucleotide
  Target: DMPK; (-) strand; PAM type: NRG; PAM sequence: AGG
cacatctgtgtgtcttgcgc

SEQ ID NO: 8341 - DNA, 20 bp, Artificial Sequence
  Description of Artificial Sequence: Synthetic oligonucleotide
  Target: DMPK; (-) strand; PAM type: NRG; PAM sequence: CAG
tcacatctgtgtgtcttgcg

SEQ ID NO: 8342 - DNA, 20 bp, Artificial Sequence
  Description of Artificial Sequence: Synthetic oligonucleotide
  Target: DMPK; (-) strand; PAM type: NRG; PAM sequence: GGG
caagatcaaaaagcagtgag

SEQ ID NO: 8343 - DNA, 20 bp, Artificial Sequence
  Description of Artificial Sequence: Synthetic oligonucleotide
  Target: DMPK; (-) strand; PAM type: NRG; PAM sequence: GGG
ccaagatcaaaaagcagtga

SEQ ID NO: 8344 - DNA, 20 bp, Artificial Sequence
  Description of Artificial Sequence: Synthetic oligonucleotide
  Target: DMPK; (-) strand; PAM type: NRG; PAM sequence: AGG
gccaagatcaaaaagcagtg

SEQ ID NO: 8345 - DNA, 20 bp, Artificial Sequence
  Description of Artificial Sequence: Synthetic oligonucleotide
  Target: DMPK; (-) strand; PAM type: NRG; PAM sequence: GAG
agccaagatcaaaaagcagt

SEQ ID NO: 8346 - DNA, 20 bp, Artificial Sequence
  Description of Artificial Sequence: Synthetic oligonucleotide
  Target: DMPK; (-) strand; PAM type: NRG; PAM sequence: CAG
tgtaagccaagatcaaaaag

SEQ ID NO: 8347 - DNA, 20 bp, Artificial Sequence
  Description of Artificial Sequence: Synthetic oligonucleotide
  Target: DMPK; (-) strand; PAM type: NRG; PAM sequence: AAG
acatgtaagccaagatcaaa

SEQ ID NO: 8348 - DNA, 20 bp, Artificial Sequence
  Description of Artificial Sequence: Synthetic oligonucleotide
  Target: DMPK; (-) strand; PAM type: NRG; PAM sequence: AAG
ttggggggaacatgtaagcc

SEQ ID NO: 8349 - DNA, 20 bp, Artificial Sequence
  Description of Artificial Sequence: Synthetic oligonucleotide
  Target: DMPK; (-) strand; PAM type: NRG; PAM sequence: AAG
ctggtttggggggaacatgt

SEQ ID NO: 8350 - DNA, 20 bp, Artificial Sequence
  Description of Artificial Sequence: Synthetic oligonucleotide
  Target: DMPK; (-) strand; PAM type: NRG; PAM sequence: GGG
tgagttggggctggtttggg

SEQ ID NO: 8351 - DNA, 20 bp, Artificial Sequence
  Description of Artificial Sequence: Synthetic oligonucleotide
  Target: DMPK; (-) strand; PAM type: NRG; PAM sequence: GGG
ctgagttggggctggtttgg

SEQ ID NO: 8352 - DNA, 20 bp, Artificial Sequence
  Description of Artificial Sequence: Synthetic oligonucleotide
  Target: DMPK; (-) strand; PAM type: NRG; PAM sequence: GGG
cctgagttggggctggtttg

SEQ ID NO: 8353 - DNA, 20 bp, Artificial Sequence
  Description of Artificial Sequence: Synthetic oligonucleotide
  Target: DMPK; (-) strand; PAM type: NRG; PAM sequence: GGG
ccctgagttggggctggttt

SEQ ID NO: 8354 - DNA, 20 bp, Artificial Sequence
  Description of Artificial Sequence: Synthetic oligonucleotide
  Target: DMPK; (-) strand; PAM type: NRG; PAM sequence: TGG
gccctgagttggggctggtt

SEQ ID NO: 8355 - DNA, 20 bp, Artificial Sequence
  Description of Artificial Sequence: Synthetic oligonucleotide
  Target: DMPK; (-) strand; PAM type: NRG; PAM sequence: TGG
gataagccctgagttggggc

SEQ ID NO: 8356 - DNA, 20 bp, Artificial Sequence
  Description of Artificial Sequence: Synthetic oligonucleotide
  Target: DMPK; (-) strand; PAM type: NRG; PAM sequence: GGG
tttagataagccctgagttg

SEQ ID NO: 8357 - DNA, 20 bp, Artificial Sequence
  Description of Artificial Sequence: Synthetic oligonucleotide
  Target: DMPK; (-) strand; PAM type: NRG; PAM sequence: GGG
ctttagataagccctgagtt

SEQ ID NO: 8358 - DNA, 20 bp, Artificial Sequence
  Description of Artificial Sequence: Synthetic oligonucleotide
  Target: DMPK; (-) strand; PAM type: NRG; PAM sequence: TGG
actttagataagccctgagt

SEQ ID NO: 8359 - DNA, 20 bp, Artificial Sequence
  Description of Artificial Sequence: Synthetic oligonucleotide
  Target: DMPK; (-) strand; PAM type: NRG; PAM sequence: GAG
ggccactttagataagccct

SEQ ID NO: 8360 - DNA, 20 bp, Artificial Sequence
  Description of Artificial Sequence: Synthetic oligonucleotide
  Target: DMPK; (-) strand; PAM type: NRG; PAM sequence: AAG
ctggaggggccactttagat

SEQ ID NO: 8361 - DNA, 20 bp, Artificial Sequence
  Description of Artificial Sequence: Synthetic oligonucleotide
  Target: DMPK; (-) strand; PAM type: NRG; PAM sequence: TAG
aaatgctggaggggccactt

SEQ ID NO: 8362 - DNA, 20 bp, Artificial Sequence
  Description of Artificial Sequence: Synthetic oligonucleotide
  Target: DMPK; (-) strand; PAM type: NRG; PAM sequence: GGG
aaaaagaaaaaatgctggag

SEQ ID NO: 8363 - DNA, 20 bp, Artificial Sequence
  Description of Artificial Sequence: Synthetic oligonucleotide
  Target: DMPK; (-) strand; PAM type: NRG; PAM sequence: GGG
aaaaaagaaaaaatgctgga

SEQ ID NO: 8364 - DNA, 20 bp, Artificial Sequence
  Description of Artificial Sequence: Synthetic oligonucleotide
  Target: DMPK; (-) strand; PAM type: NRG; PAM sequence: AGG
gaaaaaagaaaaaatgctgg

SEQ ID NO: 8365 - DNA, 20 bp, Artificial Sequence
  Description of Artificial Sequence: Synthetic oligonucleotide
  Target: DMPK; (-) strand; PAM type: NRG; PAM sequence: GAG
agaaaaaagaaaaaatgctg

SEQ ID NO: 8366 - DNA, 20 bp, Artificial Sequence
  Description of Artificial Sequence: Synthetic oligonucleotide
  Target: DMPK; (-) strand; PAM type: NRG; PAM sequence: TGG
aaagaaaaaagaaaaaatgc

SEQ ID NO: 8367 - DNA, 20 bp, Artificial Sequence
  Description of Artificial Sequence: Synthetic oligonucleotide
  Target: DMPK; (-) strand; PAM type: NRG; PAM sequence: AAG
cgtatcaaagaaaaagaaaa

SEQ ID NO: 8368 - DNA, 20 bp, Artificial Sequence
  Description of Artificial Sequence: Synthetic oligonucleotide
  Target: DMPK; (-) strand; PAM type: NRG; PAM sequence: AAG
gagactccgtatcaaagaaa

SEQ ID NO: 8369 - DNA, 20 bp, Artificial Sequence
  Description of Artificial Sequence: Synthetic oligonucleotide
  Target: DMPK; (-) strand; PAM type: NRG; PAM sequence: AAG
cagagcgagactccgtatca

SEQ ID NO: 8370 - DNA, 20 bp, Artificial Sequence
  Description of Artificial Sequence: Synthetic oligonucleotide
  Target: DMPK; (-) strand; PAM type: NRG; PAM sequence: GAG
tccagcctgggtaacagagc

SEQ ID NO: 8371 - DNA, 20 bp, Artificial Sequence
  Description of Artificial Sequence: Synthetic oligonucleotide
  Target: DMPK; (-) strand; PAM type: NRG; PAM sequence: GAG
gcactccagcctgggtaaca

SEQ ID NO: 8372 - DNA, 20 bp, Artificial Sequence
  Description of Artificial Sequence: Synthetic oligonucleotide
  Target: DMPK; (-) strand; PAM type: NRG; PAM sequence: CAG
ctgcactccagcctgggtaa

SEQ ID NO: 8373 - DNA, 20 bp, Artificial Sequence
  Description of Artificial Sequence: Synthetic oligonucleotide
  Target: DMPK; (-) strand; PAM type: NRG; PAM sequence: GGG
gcaccactgcactccagcct

SEQ ID NO: 8374 - DNA, 20 bp, Artificial Sequence
  Description of Artificial Sequence: Synthetic oligonucleotide
  Target: DMPK; (-) strand; PAM type: NRG; PAM sequence: TGG
tgcaccactgcactccagcc

SEQ ID NO: 8375 - DNA, 20 bp, Artificial Sequence
  Description of Artificial Sequence: Synthetic oligonucleotide
  Target: DMPK; (-) strand; PAM type: NRG; PAM sequence: CAG
gagattgcaccactgcactc

SEQ ID NO: 8376 - DNA, 20 bp, Artificial Sequence
  Description of Artificial Sequence: Synthetic oligonucleotide
  Target: DMPK; (-) strand; PAM type: NRG; PAM sequence: GAG
ggcggaggttgcagtgagct

SEQ ID NO: 8377 - DNA, 20 bp, Artificial Sequence
  Description of Artificial Sequence: Synthetic oligonucleotide
  Target: DMPK; (-) strand; PAM type: NRG; PAM sequence: GAG
tgggaggcggaggttgcagt

SEQ ID NO: 8378 - DNA, 20 bp, Artificial Sequence
  Description of Artificial Sequence: Synthetic oligonucleotide
  Target: DMPK; (-) strand; PAM type: NRG; PAM sequence: CAG
aacctgggaggcggaggttg

SEQ ID NO: 8379 - DNA, 20 bp, Artificial Sequence
  Description of Artificial Sequence: Synthetic oligonucleotide
  Target: DMPK; (-) strand; PAM type: NRG; PAM sequence: AGG
cgcctgaacctgggaggcgg

SEQ ID NO: 8380 - DNA, 20 bp, Artificial Sequence
  Description of Artificial Sequence: Synthetic oligonucleotide
  Target: DMPK; (-) strand; PAM type: NRG; PAM sequence: GAG
tcgcctgaacctgggaggcg

SEQ ID NO: 8381 - DNA, 20 bp, Artificial Sequence
  Description of Artificial Sequence: Synthetic oligonucleotide
  Target: DMPK; (-) strand; PAM type: NRG; PAM sequence: CGG
aatcgcctgaacctgggagg

SEQ ID NO: 8382 - DNA, 20 bp, Artificial Sequence
  Description of Artificial Sequence: Synthetic oligonucleotide
  Target: DMPK; (-) strand; PAM type: NRG; PAM sequence: AGG
gagaatcgcctgaacctggg

SEQ ID NO: 8383 - DNA, 20 bp, Artificial Sequence
  Description of Artificial Sequence: Synthetic oligonucleotide
  Target: DMPK; (-) strand; PAM type: NRG; PAM sequence: GAG
ggagaatcgcctgaacctgg

SEQ ID NO: 8384 - DNA, 20 bp, Artificial Sequence
  Description of Artificial Sequence: Synthetic oligonucleotide
  Target: DMPK; (-) strand; PAM type: NRG; PAM sequence: GGG
caggagaatcgcctgaacct

SEQ ID NO: 8385 - DNA, 20 bp, Artificial Sequence
  Description of Artificial Sequence: Synthetic oligonucleotide
  Target: DMPK; (-) strand; PAM type: NRG; PAM sequence: TGG
gcaggagaatcgcctgaacc

SEQ ID NO: 8386 - DNA, 20 bp, Artificial Sequence
  Description of Artificial Sequence: Synthetic oligonucleotide
  Target: DMPK; (-) strand; PAM type: NRG; PAM sequence: GAG
tactcaggacgctgaggcag

SEQ ID NO: 8387 - DNA, 20 bp, Artificial Sequence
  Description of Artificial Sequence: Synthetic oligonucleotide
  Target: DMPK; (-) strand; PAM type: NRG; PAM sequence: AGG
gctactcaggacgctgaggc

SEQ ID NO: 8388 - DNA, 20 bp, Artificial Sequence
  Description of Artificial Sequence: Synthetic oligonucleotide
  Target: DMPK; (-) strand; PAM type: NRG; PAM sequence: CAG
agctactcaggacgctgagg

SEQ ID NO: 8389 - DNA, 20 bp, Artificial Sequence
  Description of Artificial Sequence: Synthetic oligonucleotide
  Target: DMPK; (-) strand; PAM type: NRG; PAM sequence: AGG
ctcagctactcaggacgctg

SEQ ID NO: 8390 - DNA, 20 bp, Artificial Sequence
  Description of Artificial Sequence: Synthetic oligonucleotide
  Target: DMPK; (-) strand; PAM type: NRG; PAM sequence: GAG
tctcagctactcaggacgct

SEQ ID NO: 8391 - DNA, 20 bp, Artificial Sequence
  Description of Artificial Sequence: Synthetic oligonucleotide
  Target: DMPK; (-) strand; PAM type: NRG; PAM sequence: AGG
gcctgtaatctcagctactc

SEQ ID NO: 8392 - DNA, 20 bp, Artificial Sequence
  Description of Artificial Sequence: Synthetic oligonucleotide
  Target: DMPK; (-) strand; PAM type: NRG; PAM sequence: CAG
cgcctgtaatctcagctact

SEQ ID NO: 8393 - DNA, 20 bp, Artificial Sequence
  Description of Artificial Sequence: Synthetic oligonucleotide
  Target: DMPK; (-) strand; PAM type: NRG; PAM sequence: CAG
gtagagggcgcctgtaatct

SEQ ID NO: 8394 - DNA, 20 bp, Artificial Sequence
  Description of Artificial Sequence: Synthetic oligonucleotide
  Target: DMPK; (-) strand; PAM type: NRG; PAM sequence: GGG
aattagccaggcgtggtaga

SEQ ID NO: 8395 - DNA, 20 bp, Artificial Sequence
  Description of Artificial Sequence: Synthetic oligonucleotide
  Target: DMPK; (-) strand; PAM type: NRG; PAM sequence: AGG
aaattagccaggcgtggtag

SEQ ID NO: 8396 - DNA, 20 bp, Artificial Sequence
  Description of Artificial Sequence: Synthetic oligonucleotide
  Target: DMPK; (-) strand; PAM type: NRG; PAM sequence: GAG
aaaattagccaggcgtggta

SEQ ID NO: 8397 - DNA, 20 bp, Artificial Sequence
  Description of Artificial Sequence: Synthetic oligonucleotide
  Target: DMPK; (-) strand; PAM type: NRG; PAM sequence: TAG
aaaaaattagccaggcgtgg

SEQ ID NO: 8398 - DNA, 20 bp, Artificial Sequence
  Description of Artificial Sequence: Synthetic oligonucleotide
  Target: DMPK; (-) strand; PAM type: NRG; PAM sequence: TGG
tataaaaaattagccaggcg

SEQ ID NO: 8399 - DNA, 20 bp, Artificial Sequence
  Description of Artificial Sequence: Synthetic oligonucleotide
  Target: DMPK; (-) strand; PAM type: NRG; PAM sequence: AGG
aaaaatataaaaaattagcc

SEQ ID NO: 8400 - DNA, 20 bp, Artificial Sequence
  Description of Artificial Sequence: Synthetic oligonucleotide
  Target: DMPK; (-) strand; PAM type: NRG; PAM sequence: CAG
caaaaatataaaaaattagc

SEQ ID NO: 8401 - DNA, 20 bp, Artificial Sequence
  Description of Artificial Sequence: Synthetic oligonucleotide
  Target: DMPK; (-) strand; PAM type: NRG; PAM sequence: TAG
ctaccaaaaatataaaaaat

SEQ ID NO: 8402 - DNA, 20 bp, Artificial Sequence
  Description of Artificial Sequence: Synthetic oligonucleotide
  Target: DMPK; (-) strand; PAM type: NRG; PAM sequence: TGG
ggagaccagcctggccagcg

SEQ ID NO: 8403 - DNA, 20 bp, Artificial Sequence
  Description of Artificial Sequence: Synthetic oligonucleotide
  Target: DMPK; (-) strand; PAM type: NRG; PAM sequence: CAG
aagatggagaccagcctggc

SEQ ID NO: 8404 - DNA, 20 bp, Artificial Sequence
  Description of Artificial Sequence: Synthetic oligonucleotide
  Target: DMPK; (-) strand; PAM type: NRG; PAM sequence: TGG
tcagaagatggagaccagcc

SEQ ID NO: 8405 - DNA, 20 bp, Artificial Sequence
  Description of Artificial Sequence: Synthetic oligonucleotide
  Target: DMPK; (-) strand; PAM type: NRG; PAM sequence: CAG
tgaggtcagaagatggagac

SEQ ID NO: 8406 - DNA, 20 bp, Artificial Sequence
  Description of Artificial Sequence: Synthetic oligonucleotide
  Target: DMPK; (-) strand; PAM type: NRG; PAM sequence: GAG
tcacttgaggtcagaagatg

SEQ ID NO: 8407 - DNA, 20 bp, Artificial Sequence
  Description of Artificial Sequence: Synthetic oligonucleotide
  Target: DMPK; (-) strand; PAM type: NRG; PAM sequence: TGG
gatcacttgaggtcagaaga

SEQ ID NO: 8408 - DNA, 20 bp, Artificial Sequence
  Description of Artificial Sequence: Synthetic oligonucleotide
  Target: DMPK; (-) strand; PAM type: NRG; PAM sequence: AAG
ggcggatcacttgaggtcag

SEQ ID NO: 8409 - DNA, 20 bp, Artificial Sequence
  Description of Artificial Sequence: Synthetic oligonucleotide
  Target: DMPK; (-) strand; PAM type: NRG; PAM sequence: CAG
gtaggcggatcacttgaggt

SEQ ID NO: 8410 - DNA, 20 bp, Artificial Sequence
  Description of Artificial Sequence: Synthetic oligonucleotide
  Target: DMPK; (-) strand; PAM type: NRG; PAM sequence: AGG
tgaggtaggcggatcacttg

SEQ ID NO: 8411 - DNA, 20 bp, Artificial Sequence
  Description of Artificial Sequence: Synthetic oligonucleotide
  Target: DMPK; (-) strand; PAM type: NRG; PAM sequence: GAG
ctgaggtaggcggatcactt

SEQ ID NO: 8412 - DNA, 20 bp, Artificial Sequence
  Description of Artificial Sequence: Synthetic oligonucleotide
  Target: DMPK; (-) strand; PAM type: NRG; PAM sequence: CGG
actacaacagctgaggtagg

SEQ ID NO: 8413 - DNA, 20 bp, Artificial Sequence
  Description of Artificial Sequence: Synthetic oligonucleotide
  Target: DMPK; (-) strand; PAM type: NRG; PAM sequence: AGG
gggactacaacagctgaggt

SEQ ID NO: 8414 - DNA, 20 bp, Artificial Sequence
  Description of Artificial Sequence: Synthetic oligonucleotide
  Target: DMPK; (-) strand; PAM type: NRG; PAM sequence: TAG
tgggactacaacagctgagg

SEQ ID NO: 8415 - DNA, 20 bp, Artificial Sequence
  Description of Artificial Sequence: Synthetic oligonucleotide
  Target: DMPK; (-) strand; PAM type: NRG; PAM sequence: AGG
gtttgggactacaacagctg

SEQ ID NO: 8416 - DNA, 20 bp, Artificial Sequence
  Description of Artificial Sequence: Synthetic oligonucleotide
  Target: DMPK; (-) strand; PAM type: NRG; PAM sequence: GAG
agtttgggactacaacagct

SEQ ID NO: 8417 - DNA, 20 bp, Artificial Sequence
  Description of Artificial Sequence: Synthetic oligonucleotide
  Target: DMPK; (-) strand; PAM type: NRG; PAM sequence: CAG
cccagagtttgggactacaa

SEQ ID NO: 8418 - DNA, 20 bp, Artificial Sequence
  Description of Artificial Sequence: Synthetic oligonucleotide
  Target: DMPK; (-) strand; PAM type: NRG; PAM sequence: GGG
actgcttgagcccagagttt

SEQ ID NO: 8419 - DNA, 20 bp, Artificial Sequence
  Description of Artificial Sequence: Synthetic oligonucleotide
  Target: DMPK; (-) strand; PAM type: NRG; PAM sequence: TGG
gactgcttgagcccagagtt

SEQ ID NO: 8420 - DNA, 20 bp, Artificial Sequence
  Description of Artificial Sequence: Synthetic oligonucleotide
  Target: DMPK; (-) strand; PAM type: NRG; PAM sequence: GAG
tggaggactgcttgagccca

SEQ ID NO: 8421 - DNA, 20 bp, Artificial Sequence
  Description of Artificial Sequence: Synthetic oligonucleotide
  Target: DMPK; (-) strand; PAM type: NRG; PAM sequence: CAG
gttggaggactgcttgagcc

SEQ ID NO: 8422 - DNA, 20 bp, Artificial Sequence
  Description of Artificial Sequence: Synthetic oligonucleotide
  Target: DMPK; (-) strand; PAM type: NRG; PAM sequence: GAG
ctgaggttggaggactgctt

SEQ ID NO: 8423 - DNA, 20 bp, Artificial Sequence
  Description of Artificial Sequence: Synthetic oligonucleotide
  Target: DMPK; (-) strand; PAM type: NRG; PAM sequence: AGG
ctttgggaggctgaggttgg

SEQ ID NO: 8424 - DNA, 20 bp, Artificial Sequence
  Description of Artificial Sequence: Synthetic oligonucleotide
  Target: DMPK; (-) strand; PAM type: NRG; PAM sequence: GAG
actttgggaggctgaggttg

SEQ ID NO: 8425 - DNA, 20 bp, Artificial Sequence
  Description of Artificial Sequence: Synthetic oligonucleotide
  Target: DMPK; (-) strand; PAM type: NRG; PAM sequence: TGG
gcactttgggaggctgaggt

SEQ ID NO: 8426 - DNA, 20 bp, Artificial Sequence
  Description of Artificial Sequence: Synthetic oligonucleotide
  Target: DMPK; (-) strand; PAM type: NRG; PAM sequence: AGG
cccagcactttgggaggctg

SEQ ID NO: 8427 - DNA, 20 bp, Artificial Sequence
  Description of Artificial Sequence: Synthetic oligonucleotide
  Target: DMPK; (-) strand; PAM type: NRG; PAM sequence: GAG
tcccagcactttgggaggct

SEQ ID NO: 8428 - DNA, 20 bp, Artificial Sequence
  Description of Artificial Sequence: Synthetic oligonucleotide
  Target: DMPK; (-) strand; PAM type: NRG; PAM sequence: AGG
tgtaatcccagcactttggg

SEQ ID NO: 8429 - DNA, 20 bp, Artificial Sequence
  Description of Artificial Sequence: Synthetic oligonucleotide
  Target: DMPK; (-) strand; PAM type: NRG; PAM sequence: GAG
ttgtaatcccagcactttgg

SEQ ID NO: 8430 - DNA, 20 bp, Artificial Sequence
  Description of Artificial Sequence: Synthetic oligonucleotide
  Target: DMPK; (-) strand; PAM type: NRG; PAM sequence: GGG
atttgtaatcccagcacttt

SEQ ID NO: 8431 - DNA, 20 bp, Artificial Sequence
  Description of Artificial Sequence: Synthetic oligonucleotide
  Target: DMPK; (-) strand; PAM type: NRG; PAM sequence: TGG
tatttgtaatcccagcactt

SEQ ID NO: 8432 - DNA, 20 bp, Artificial Sequence
  Description of Artificial Sequence: Synthetic oligonucleotide
  Target: DMPK; (-) strand; PAM type: NRG; PAM sequence: CAG
gtggcttatatttgtaatcc

SEQ ID NO: 8433 - DNA, 20 bp, Artificial Sequence
  Description of Artificial Sequence: Synthetic oligonucleotide
  Target: DMPK; (-) strand; PAM type: NRG; PAM sequence: TGG
cagaactgggctgggcacag

SEQ ID NO: 8434 - DNA, 20 bp, Artificial Sequence
  Description of Artificial Sequence: Synthetic oligonucleotide
  Target: DMPK; (-) strand; PAM type: NRG; PAM sequence: CAG
aaacagaactgggctgggca

SEQ ID NO: 8435 - DNA, 20 bp, Artificial Sequence
  Description of Artificial Sequence: Synthetic oligonucleotide
  Target: DMPK; (-) strand; PAM type: NRG; PAM sequence: GGG
aaaaaaaacagaactgggct

SEQ ID NO: 8436 - DNA, 20 bp, Artificial Sequence
  Description of Artificial Sequence: Synthetic oligonucleotide
  Target: DMPK; (-) strand; PAM type: NRG; PAM sequence: TGG
aaaaaaaaacagaactgggc

SEQ ID NO: 8437 - DNA, 20 bp, Artificial Sequence
  Description of Artificial Sequence: Synthetic oligonucleotide
  Target: DMPK; (-) strand; PAM type: NRG; PAM sequence: GGG
taaaaaaaaaaaacagaact

SEQ ID NO: 8438 - DNA, 20 bp, Artificial Sequence
  Description of Artificial Sequence: Synthetic oligonucleotide
  Target: DMPK; (-) strand; PAM type: NRG; PAM sequence: TGG
ctaaaaaaaaaaaacagaac

SEQ ID NO: 8439 - DNA, 20 bp, Artificial Sequence
  Description of Artificial Sequence: Synthetic oligonucleotide
  Target: DMPK; (-) strand; PAM type: NRG; PAM sequence: CAG
ctccatctaaaaaaaaaaaa

SEQ ID NO: 8440 - DNA, 20 bp, Artificial Sequence
  Description of Artificial Sequence: Synthetic oligonucleotide
  Target: DMPK; (-) strand; PAM type: NRG; PAM sequence: AAG
actctaggctgggagacagc

SEQ ID NO: 8441 - DNA, 20 bp, Artificial Sequence
  Description of Artificial Sequence: Synthetic oligonucleotide
  Target: DMPK; (-) strand; PAM type: NRG; PAM sequence: CAG
ctgcactctaggctgggaga

SEQ ID NO: 8442 - DNA, 20 bp, Artificial Sequence
  Description of Artificial Sequence: Synthetic oligonucleotide
  Target: DMPK; (-) strand; PAM type: NRG; PAM sequence: GAG
gccactgcactctaggctgg

SEQ ID NO: 8443 - DNA, 20 bp, Artificial Sequence
  Description of Artificial Sequence: Synthetic oligonucleotide
  Target: DMPK; (-) strand; PAM type: NRG; PAM sequence: GGG
gtgccactgcactctaggct

SEQ ID NO: 8444 - DNA, 20 bp, Artificial Sequence
  Description of Artificial Sequence: Synthetic oligonucleotide
  Target: DMPK; (-) strand; PAM type: NRG; PAM sequence: TGG
tgtgccactgcactctaggc

SEQ ID NO: 8445 - DNA, 20 bp, Artificial Sequence
  Description of Artificial Sequence: Synthetic oligonucleotide
  Target: DMPK; (-) strand; PAM type: NRG; PAM sequence: AGG
gggttgtgccactgcactct

SEQ ID NO: 8446 - DNA, 20 bp, Artificial Sequence
  Description of Artificial Sequence: Synthetic oligonucleotide
  Target: DMPK; (-) strand; PAM type: NRG; PAM sequence: TAG
ggggttgtgccactgcactc

SEQ ID NO: 8447 - DNA, 20 bp, Artificial Sequence
  Description of Artificial Sequence: Synthetic oligonucleotide
  Target: DMPK; (-) strand; PAM type: NRG; PAM sequence: GGG
gcagagtttgcagtgggctg

SEQ ID NO: 8448 - DNA, 20 bp, Artificial Sequence
  Description of Artificial Sequence: Synthetic oligonucleotide
  Target: DMPK; (-) strand; PAM type: NRG; PAM sequence: GGG
ggcagagtttgcagtgggct

SEQ ID NO: 8449 - DNA, 20 bp, Artificial Sequence
  Description of Artificial Sequence: Synthetic oligonucleotide
  Target: DMPK; (-) strand; PAM type: NRG; PAM sequence: TGG
aggcagagtttgcagtgggc

SEQ ID NO: 8450 - DNA, 20 bp, Artificial Sequence
  Description of Artificial Sequence: Synthetic oligonucleotide
  Target: DMPK; (-) strand; PAM type: NRG; PAM sequence: GGG
tgggaggcagagtttgcagt

SEQ ID NO: 8451 - DNA, 20 bp, Artificial Sequence
  Description of Artificial Sequence: Synthetic oligonucleotide
  Target: DMPK; (-) strand; PAM type: NRG; PAM sequence: TGG
ctgggaggcagagtttgcag

SEQ ID NO: 8452 - DNA, 20 bp, Artificial Sequence
  Description of Artificial Sequence: Synthetic oligonucleotide
  Target: DMPK; (-) strand; PAM type: NRG; PAM sequence: CAG
aacctgggaggcagagtttg

SEQ ID NO: 8453 - DNA, 20 bp, Artificial Sequence
  Description of Artificial Sequence: Synthetic oligonucleotide
  Target: DMPK; (-) strand; PAM type: NRG; PAM sequence: GAG
ttgattgaacctgggaggca

SEQ ID NO: 8454 - DNA, 20 bp, Artificial Sequence
  Description of Artificial Sequence: Synthetic oligonucleotide
  Target: DMPK; (-) strand; PAM type: NRG; PAM sequence: CAG
gcttgattgaacctgggagg

SEQ ID NO: 8455 - DNA, 20 bp, Artificial Sequence
  Description of Artificial Sequence: Synthetic oligonucleotide
  Target: DMPK; (-) strand; PAM type: NRG; PAM sequence: AGG
atcgcttgattgaacctggg

SEQ ID NO: 8456 - DNA, 20 bp, Artificial Sequence
  Description of Artificial Sequence: Synthetic oligonucleotide
  Target: DMPK; (-) strand; PAM type: NRG; PAM sequence: GAG
aatcgcttgattgaacctgg

SEQ ID NO: 8457 - DNA, 20 bp, Artificial Sequence
  Description of Artificial Sequence: Synthetic oligonucleotide
  Target: DMPK; (-) strand; PAM type: NRG; PAM sequence: GGG
agaatcgcttgattgaacct

SEQ ID NO: 8458 - DNA, 20 bp, Artificial Sequence
  Description of Artificial Sequence: Synthetic oligonucleotide
  Target: DMPK; (-) strand; PAM type: NRG; PAM sequence: TGG
gagaatcgcttgattgaacc

SEQ ID NO: 8459 - DNA, 20 bp, Artificial Sequence
  Description of Artificial Sequence: Synthetic oligonucleotide
  Target: DMPK; (-) strand; PAM type: NRG; PAM sequence: GAG
tactcaggaggctgaggcag

SEQ ID NO: 8460 - DNA, 20 bp, Artificial Sequence
  Description of Artificial Sequence: Synthetic oligonucleotide
  Target: DMPK; (-) strand; PAM type: NRG; PAM sequence: AGG
gctactcaggaggctgaggc

SEQ ID NO: 8461 - DNA, 20 bp, Artificial Sequence
  Description of Artificial Sequence: Synthetic oligonucleotide
  Target: DMPK; (-) strand; PAM type: NRG; PAM sequence: CAG
agctactcaggaggctgagg

SEQ ID NO: 8462 - DNA, 20 bp, Artificial Sequence
  Description of Artificial Sequence: Synthetic oligonucleotide
  Target: DMPK; (-) strand; PAM type: NRG; PAM sequence: AGG
gccagctactcaggaggctg

SEQ ID NO: 8463 - DNA, 20 bp, Artificial Sequence
  Description of Artificial Sequence: Synthetic oligonucleotide
  Target: DMPK; (-) strand; PAM type: NRG; PAM sequence: GAG
tgccagctactcaggaggct

SEQ ID NO: 8464 - DNA, 20 bp, Artificial Sequence
  Description of Artificial Sequence: Synthetic oligonucleotide
  Target: DMPK; (-) strand; PAM type: NRG; PAM sequence: AGG
tgtaatgccagctactcagg

SEQ ID NO: 8465 - DNA, 20 bp, Artificial Sequence
  Description of Artificial Sequence: Synthetic oligonucleotide
  Target: DMPK; (-) strand; PAM type: NRG; PAM sequence: GAG
ctgtaatgccagctactcag

SEQ ID NO: 8466 - DNA, 20 bp, Artificial Sequence
  Description of Artificial Sequence: Synthetic oligonucleotide
  Target: DMPK; (-) strand; PAM type: NRG; PAM sequence: AGG
gcctgtaatgccagctactc

SEQ ID NO: 8467 - DNA, 20 bp, Artificial Sequence
  Description of Artificial Sequence: Synthetic oligonucleotide
  Target: DMPK; (-) strand; PAM type: NRG; PAM sequence: CAG
tgcctgtaatgccagctact

SEQ ID NO: 8468 - DNA, 20 bp, Artificial Sequence
  Description of Artificial Sequence: Synthetic oligonucleotide
  Target: DMPK; (-) strand; PAM type: NRG; PAM sequence: CAG
gtggcgtatgcctgtaatgc

SEQ ID NO: 8469 - DNA, 20 bp, Artificial Sequence
  Description of Artificial Sequence: Synthetic oligonucleotide
  Target: DMPK; (-) strand; PAM type: NRG; PAM sequence: TGG
caaaatttagccaggcttgg

SEQ ID NO: 8470 - DNA, 20 bp, Artificial Sequence
  Description of Artificial Sequence: Synthetic oligonucleotide
  Target: DMPK; (-) strand; PAM type: NRG; PAM sequence: TGG
atacaaaatttagccaggct

SEQ ID NO: 8471 - DNA, 20 bp, Artificial Sequence
  Description of Artificial Sequence: Synthetic oligonucleotide
  Target: DMPK; (-) strand; PAM type: NRG; PAM sequence: AGG
taaaaatacaaaatttagcc

SEQ ID NO: 8472 - DNA, 20 bp, Artificial Sequence
  Description of Artificial Sequence: Synthetic oligonucleotide
  Target: DMPK; (-) strand; PAM type: NRG; PAM sequence: CAG
ctaaaaatacaaaatttagc

SEQ ID NO: 8473 - DNA, 20 bp, Artificial Sequence
  Description of Artificial Sequence: Synthetic oligonucleotide
  Target: DMPK; (-) strand; PAM type: NRG; PAM sequence: TAG
tctactaaaaatacaaaatt

SEQ ID NO: 8474 - DNA, 20 bp, Artificial Sequence
  Description of Artificial Sequence: Synthetic oligonucleotide
  Target: DMPK; (-) strand; PAM type: NRG; PAM sequence: TGG
caagaccagcctggccaaca

SEQ ID NO: 8475 - DNA, 20 bp, Artificial Sequence
  Description of Artificial Sequence: Synthetic oligonucleotide
  Target: DMPK; (-) strand; PAM type: NRG; PAM sequence: TGG
tcaggagttcaagaccagcc

SEQ ID NO: 8476 - DNA, 20 bp, Artificial Sequence
  Description of Artificial Sequence: Synthetic oligonucleotide
  Target: DMPK; (-) strand; PAM type: NRG; PAM sequence: CAG
ggaagtcaggagttcaagac

SEQ ID NO: 8477 - DNA, 20 bp, Artificial Sequence
  Description of Artificial Sequence: Synthetic oligonucleotide
  Target: DMPK; (-) strand; PAM type: NRG; PAM sequence: AAG
tcactggaagtcaggagttc

SEQ ID NO: 8478 - DNA, 20 bp, Artificial Sequence
  Description of Artificial Sequence: Synthetic oligonucleotide
  Target: DMPK; (-) strand; PAM type: NRG; PAM sequence: GAG
ggcagatcactggaagtcag

SEQ ID NO: 8479 - DNA, 20 bp, Artificial Sequence
  Description of Artificial Sequence: Synthetic oligonucleotide
  Target: DMPK; (-) strand; PAM type: NRG; PAM sequence: AGG
caggcagatcactggaagtc

SEQ ID NO: 8480 - DNA, 20 bp, Artificial Sequence
  Description of Artificial Sequence: Synthetic oligonucleotide
  Target: DMPK; (-) strand; PAM type: NRG; PAM sequence: CAG
gcaggcagatcactggaagt

SEQ ID NO: 8481 - DNA, 20 bp, Artificial Sequence
  Description of Artificial Sequence: Synthetic oligonucleotide
  Target: DMPK; (-) strand; PAM type: NRG; PAM sequence: AAG
tgaggcaggcagatcactgg

SEQ ID NO: 8482 - DNA, 20 bp, Artificial Sequence
  Description of Artificial Sequence: Synthetic oligonucleotide
  Target: DMPK; (-) strand; PAM type: NRG; PAM sequence: TGG
ggctgaggcaggcagatcac

SEQ ID NO: 8483 - DNA, 20 bp, Artificial Sequence
  Description of Artificial Sequence: Synthetic oligonucleotide
  Target: DMPK; (-) strand; PAM type: NRG; PAM sequence: CAG
ctttgggaggctgaggcagg

SEQ ID NO: 8484 - DNA, 20 bp, Artificial Sequence
  Description of Artificial Sequence: Synthetic oligonucleotide
  Target: DMPK; (-) strand; PAM type: NRG; PAM sequence: AGG
gaactttgggaggctgaggc

SEQ ID NO: 8485 - DNA, 20 bp, Artificial Sequence
  Description of Artificial Sequence: Synthetic oligonucleotide
  Target: DMPK; (-) strand; PAM type: NRG; PAM sequence: CAG
agaactttgggaggctgagg

SEQ ID NO: 8486 - DNA, 20 bp, Artificial Sequence
  Description of Artificial Sequence: Synthetic oligonucleotide
  Target: DMPK; (-) strand; PAM type: NRG; PAM sequence: AGG
cccagaactttgggaggctg

SEQ ID NO: 8487 - DNA, 20 bp, Artificial Sequence
  Description of Artificial Sequence: Synthetic oligonucleotide
  Target: DMPK; (-) strand; PAM type: NRG; PAM sequence: GAG
tcccagaactttgggaggct

SEQ ID NO: 8488 - DNA, 20 bp, Artificial Sequence
  Description of Artificial Sequence: Synthetic oligonucleotide
  Target: DMPK; (-) strand; PAM type: NRG; PAM sequence: AGG
tgtaatcccagaactttggg

SEQ ID NO: 8489 - DNA, 20 bp, Artificial Sequence
  Description of Artificial Sequence: Synthetic oligonucleotide
  Target: DMPK; (-) strand; PAM type: NRG; PAM sequence: GAG
ctgtaatcccagaactttgg

SEQ ID NO: 8490 - DNA, 20 bp, Artificial Sequence
  Description of Artificial Sequence: Synthetic oligonucleotide
  Target: DMPK; (-) strand; PAM type: NRG; PAM sequence: GGG
gcctgtaatcccagaacttt

SEQ ID NO: 8491 - DNA, 20 bp, Artificial Sequence
  Description of Artificial Sequence: Synthetic oligonucleotide
  Target: DMPK; (-) strand; PAM type: NRG; PAM sequence: TGG
cgcctgtaatcccagaactt

SEQ ID NO: 8492 - DNA, 20 bp, Artificial Sequence
  Description of Artificial Sequence: Synthetic oligonucleotide
  Target: DMPK; (-) strand; PAM type: NRG; PAM sequence: CAG
gtggttcacgcctgtaatcc

SEQ ID NO: 8493 - DNA, 20 bp, Artificial Sequence
  Description of Artificial Sequence: Synthetic oligonucleotide
  Target: DMPK; (-) strand; PAM type: NRG; PAM sequence: TGG
aaaaaaagggttgggcaagg

SEQ ID NO: 8494 - DNA, 20 bp, Artificial Sequence
  Description of Artificial Sequence: Synthetic oligonucleotide
  Target: DMPK; (-) strand; PAM type: NRG; PAM sequence: AGG
aaaaaaaaaagggttgggca

SEQ ID NO: 8495 - DNA, 20 bp, Artificial Sequence
  Description of Artificial Sequence: Synthetic oligonucleotide
  Target: DMPK; (-) strand; PAM type: NRG; PAM sequence: AAG
aaaaaaaaaaagggttgggc

SEQ ID NO: 8496 - DNA, 20 bp, Artificial Sequence
  Description of Artificial Sequence: Synthetic oligonucleotide
  Target: DMPK; (-) strand; PAM type: NRG; PAM sequence: GGG
aaaaaaaaaaaaaaagggtt

SEQ ID NO: 8497 - DNA, 20 bp, Artificial Sequence
  Description of Artificial Sequence: Synthetic oligonucleotide
  Target: DMPK; (-) strand; PAM type: NRG; PAM sequence: TGG
aaaaaaaaaaaaaaaagggt

SEQ ID NO: 8498 - DNA, 20 bp, Artificial Sequence
  Description of Artificial Sequence: Synthetic oligonucleotide
  Target: DMPK; (-) strand; PAM type: NRG; PAM sequence: GGG
aaaaaaaaaaaaaaaaaaaa

SEQ ID NO: 8499 - DNA, 20 bp, Artificial Sequence
  Description of Artificial Sequence: Synthetic oligonucleotide
  Target: DMPK; (-) strand; PAM type: NRG; PAM sequence: AGG
caaaaaaaaaaaaaaaaaaa

SEQ ID NO: 8500 - DNA, 20 bp, Artificial Sequence
  Description of Artificial Sequence: Synthetic oligonucleotide
  Target: DMPK; (-) strand; PAM type: NRG; PAM sequence: AAG
tcaaaaaaaaaaaaaaaaaa

SEQ ID NO: 8501 - DNA, 20 bp, Artificial Sequence
  Description of Artificial Sequence: Synthetic oligonucleotide
  Target: DMPK; (-) strand; PAM type: NRG; PAM sequence: GAG
tccagtctgggtgacagagt

SEQ ID NO: 8502 - DNA, 20 bp, Artificial Sequence
  Description of Artificial Sequence: Synthetic oligonucleotide
  Target: DMPK; (-) strand; PAM type: NRG; PAM sequence: GAG
acactccagtctgggtgaca

SEQ ID NO: 8503 - DNA, 20 bp, Artificial Sequence
  Description of Artificial Sequence: Synthetic oligonucleotide
  Target: DMPK; (-) strand; PAM type: NRG; PAM sequence: CAG
ctacactccagtctgggtga

SEQ ID NO: 8504 - DNA, 20 bp, Artificial Sequence
  Description of Artificial Sequence: Synthetic oligonucleotide
  Target: DMPK; (-) strand; PAM type: NRG; PAM sequence: GGG
atgccactacactccagtct

SEQ ID NO: 8505 - DNA, 20 bp, Artificial Sequence
  Description of Artificial Sequence: Synthetic oligonucleotide
  Target: DMPK; (-) strand; PAM type: NRG; PAM sequence: TGG
catgccactacactccagtc

SEQ ID NO: 8506 - DNA, 20 bp, Artificial Sequence
  Description of Artificial Sequence: Synthetic oligonucleotide
  Target: DMPK; (-) strand; PAM type: NRG; PAM sequence: CAG
aagatcatgccactacactc

SEQ ID NO: 8507 - DNA, 20 bp, Artificial Sequence
  Description of Artificial Sequence: Synthetic oligonucleotide
  Target: DMPK; (-) strand; PAM type: NRG; PAM sequence: AAG
ggcagagtttgcagtgagcc

SEQ ID NO: 8508 - DNA, 20 bp, Artificial Sequence
  Description of Artificial Sequence: Synthetic oligonucleotide
  Target: DMPK; (-) strand; PAM type: NRG; PAM sequence: GAG
tgggaggcagagtttgcagt

SEQ ID NO: 8509 - DNA, 20 bp, Artificial Sequence
  Description of Artificial Sequence: Synthetic oligonucleotide
  Target: DMPK; (-) strand; PAM type: NRG; PAM sequence: CAG
aacctgggaggcagagtttg

SEQ ID NO: 8510 - DNA, 20 bp, Artificial Sequence
  Description of Artificial Sequence: Synthetic oligonucleotide
  Target: DMPK; (-) strand; PAM type: NRG; PAM sequence: GAG
ttgcttgaacctgggaggca

SEQ ID NO: 8511 - DNA, 20 bp, Artificial Sequence
  Description of Artificial Sequence: Synthetic oligonucleotide
  Target: DMPK; (-) strand; PAM type: NRG; PAM sequence: CAG
aattgcttgaacctgggagg

SEQ ID NO: 8512 - DNA, 20 bp, Artificial Sequence
  Description of Artificial Sequence: Synthetic oligonucleotide
  Target: DMPK; (-) strand; PAM type: NRG; PAM sequence: AGG
gagaattgcttgaacctggg

SEQ ID NO: 8513 - DNA, 20 bp, Artificial Sequence
  Description of Artificial Sequence: Synthetic oligonucleotide
  Target: DMPK; (-) strand; PAM type: NRG; PAM sequence: GAG
ggagaattgcttgaacctgg

SEQ ID NO: 8514 - DNA, 20 bp, Artificial Sequence
  Description of Artificial Sequence: Synthetic oligonucleotide
  Target: DMPK; (-) strand; PAM type: NRG; PAM sequence: GGG
caggagaattgcttgaacct

SEQ ID NO: 8515 - DNA, 20 bp, Artificial Sequence
  Description of Artificial Sequence: Synthetic oligonucleotide
  Target: DMPK; (-) strand; PAM type: NRG; PAM sequence: TGG
gcaggagaattgcttgaacc

SEQ ID NO: 8516 - DNA, 20 bp, Artificial Sequence
  Description of Artificial Sequence: Synthetic oligonucleotide
  Target: DMPK; (-) strand; PAM type: NRG; PAM sequence: GAG
tactggggaagctgaggcag

SEQ ID NO: 8517 - DNA, 20 bp, Artificial Sequence
  Description of Artificial Sequence: Synthetic oligonucleotide
  Target: DMPK; (-) strand; PAM type: NRG; PAM sequence: AGG
gttactggggaagctgaggc

SEQ ID NO: 8518 - DNA, 20 bp, Artificial Sequence
  Description of Artificial Sequence: Synthetic oligonucleotide
  Target: DMPK; (-) strand; PAM type: NRG; PAM sequence: CAG
agttactggggaagctgagg

SEQ ID NO: 8519 - DNA, 20 bp, Artificial Sequence
  Description of Artificial Sequence: Synthetic oligonucleotide
  Target: DMPK; (-) strand; PAM type: NRG; PAM sequence: AGG
tccagttactggggaagctg

SEQ ID NO: 8520 - DNA, 20 bp, Artificial Sequence
  Description of Artificial Sequence: Synthetic oligonucleotide
  Target: DMPK; (-) strand; PAM type: NRG; PAM sequence: GAG
ttccagttactggggaagct

SEQ ID NO: 8521 - DNA, 20 bp, Artificial Sequence
  Description of Artificial Sequence: Synthetic oligonucleotide
  Target: DMPK; (-) strand; PAM type: NRG; PAM sequence: AAG
tgtaattccagttactgggg

SEQ ID NO: 8522 - DNA, 20 bp, Artificial Sequence
  Description of Artificial Sequence: Synthetic oligonucleotide
  Target: DMPK; (-) strand; PAM type: NRG; PAM sequence: GGG
gcctgtaattccagttactg

SEQ ID NO: 8523 - DNA, 20 bp, Artificial Sequence
  Description of Artificial Sequence: Synthetic oligonucleotide
  Target: DMPK; (-) strand; PAM type: NRG; PAM sequence: GGG
tgcctgtaattccagttact

SEQ ID NO: 8524 - DNA, 20 bp, Artificial Sequence
  Description of Artificial Sequence: Synthetic oligonucleotide
  Target: DMPK; (-) strand; PAM type: NRG; PAM sequence: TGG
gtgcctgtaattccagttac

SEQ ID NO: 8525 - DNA, 20 bp, Artificial Sequence
  Description of Artificial Sequence: Synthetic oligonucleotide
  Target: DMPK; (-) strand; PAM type: NRG; PAM sequence: CAG
gtctcgggtgcctgtaattc

SEQ ID NO: 8526 - DNA, 20 bp, Artificial Sequence
  Description of Artificial Sequence: Synthetic oligonucleotide
  Target: DMPK; (-) strand; PAM type: NRG; PAM sequence: GGG
aattagctgggtgtggtctc

SEQ ID NO: 8527 - DNA, 20 bp, Artificial Sequence
  Description of Artificial Sequence: Synthetic oligonucleotide
  Target: DMPK; (-) strand; PAM type: NRG; PAM sequence: CGG
aaattagctgggtgtggtct

SEQ ID NO: 8528 - DNA, 20 bp, Artificial Sequence
  Description of Artificial Sequence: Synthetic oligonucleotide
  Target: DMPK; (-) strand; PAM type: NRG; PAM sequence: TGG
acaagaaaattagctgggtg

SEQ ID NO: 8529 - DNA, 20 bp, Artificial Sequence
  Description of Artificial Sequence: Synthetic oligonucleotide
  Target: DMPK; (-) strand; PAM type: NRG; PAM sequence: GGG
aaaatacaagaaaattagct

SEQ ID NO: 8530 - DNA, 20 bp, Artificial Sequence
  Description of Artificial Sequence: Synthetic oligonucleotide
  Target: DMPK; (-) strand; PAM type: NRG; PAM sequence: TGG
aaaaatacaagaaaattagc

SEQ ID NO: 8531 - DNA, 20 bp, Artificial Sequence
  Description of Artificial Sequence: Synthetic oligonucleotide
  Target: DMPK; (-) strand; PAM type: NRG; PAM sequence: TAG
tactaaaaatacaagaaaat

SEQ ID NO: 8532 - DNA, 20 bp, Artificial Sequence
  Description of Artificial Sequence: Synthetic oligonucleotide
  Target: DMPK; (-) strand; PAM type: NRG; PAM sequence: AAG
cccgtctctactaaaaatac

SEQ ID NO: 8533 - DNA, 20 bp, Artificial Sequence
  Description of Artificial Sequence: Synthetic oligonucleotide
  Target: DMPK; (-) strand; PAM type: NRG; PAM sequence: CGG
tgagactaggctggccaaca

SEQ ID NO: 8534 - DNA, 20 bp, Artificial Sequence
  Description of Artificial Sequence: Synthetic oligonucleotide
  Target: DMPK; (-) strand; PAM type: NRG; PAM sequence: TGG
caggagttttgagactaggc

SEQ ID NO: 8535 - DNA, 20 bp, Artificial Sequence
  Description of Artificial Sequence: Synthetic oligonucleotide
  Target: DMPK; (-) strand; PAM type: NRG; PAM sequence: AGG
agatcaggagttttgagact

SEQ ID NO: 8536 - DNA, 20 bp, Artificial Sequence
  Description of Artificial Sequence: Synthetic oligonucleotide
  Target: DMPK; (-) strand; PAM type: NRG; PAM sequence: TAG
gagatcaggagttttgagac

SEQ ID NO: 8537 - DNA, 20 bp, Artificial Sequence
  Description of Artificial Sequence: Synthetic oligonucleotide
  Target: DMPK; (-) strand; PAM type: NRG; PAM sequence: GAG
gtcatgagatcaggagtttt

SEQ ID NO: 8538 - DNA, 20 bp, Artificial Sequence
  Description of Artificial Sequence: Synthetic oligonucleotide
  Target: DMPK; (-) strand; PAM type: NRG; PAM sequence: GAG
ccggtgggtcatgagatcag

SEQ ID NO: 8539 - DNA, 20 bp, Artificial Sequence
  Description of Artificial Sequence: Synthetic oligonucleotide
  Target: DMPK; (-) strand; PAM type: NRG; PAM sequence: AGG
ggccggtgggtcatgagatc

SEQ ID NO: 8540 - DNA, 20 bp, Artificial Sequence
  Description of Artificial Sequence: Synthetic oligonucleotide
  Target: DMPK; (-) strand; PAM type: NRG; PAM sequence: CAG
aggccggtgggtcatgagat

SEQ ID NO: 8541 - DNA, 20 bp, Artificial Sequence
  Description of Artificial Sequence: Synthetic oligonucleotide
  Target: DMPK; (-) strand; PAM type: NRG; PAM sequence: GAG
gtccaaggccggtgggtcat

SEQ ID NO: 8542 - DNA, 20 bp, Artificial Sequence
  Description of Artificial Sequence: Synthetic oligonucleotide
  Target: DMPK; (-) strand; PAM type: NRG; PAM sequence: GGG
tttgggagtccaaggccggt

SEQ ID NO: 8543 - DNA, 20 bp, Artificial Sequence
  Description of Artificial Sequence: Synthetic oligonucleotide
  Target: DMPK; (-) strand; PAM type: NRG; PAM sequence: TGG
ctttgggagtccaaggccgg

SEQ ID NO: 8544 - DNA, 20 bp, Artificial Sequence
  Description of Artificial Sequence: Synthetic oligonucleotide
  Target: DMPK; (-) strand; PAM type: NRG; PAM sequence: CGG
gcactttgggagtccaaggc

SEQ ID NO: 8545 - DNA, 20 bp, Artificial Sequence
  Description of Artificial Sequence: Synthetic oligonucleotide
  Target: DMPK; (-) strand; PAM type: NRG; PAM sequence: AGG
cccagcactttgggagtcca

SEQ ID NO: 8546 - DNA, 20 bp, Artificial Sequence
  Description of Artificial Sequence: Synthetic oligonucleotide
  Target: DMPK; (-) strand; PAM type: NRG; PAM sequence: AAG
tcccagcactttgggagtcc

SEQ ID NO: 8547 - DNA, 20 bp, Artificial Sequence
  Description of Artificial Sequence: Synthetic oligonucleotide
  Target: DMPK; (-) strand; PAM type: NRG; PAM sequence: GAG
ctgtaatcccagcactttgg

SEQ ID NO: 8548 - DNA, 20 bp, Artificial Sequence
  Description of Artificial Sequence: Synthetic oligonucleotide
  Target: DMPK; (-) strand; PAM type: NRG; PAM sequence: GGG
gcctgtaatcccagcacttt

SEQ ID NO: 8549 - DNA, 20 bp, Artificial Sequence
  Description of Artificial Sequence: Synthetic oligonucleotide
  Target: DMPK; (-) strand; PAM type: NRG; PAM sequence: TGG
tgcctgtaatcccagcactt

SEQ ID NO: 8550 - DNA, 20 bp, Artificial Sequence
  Description of Artificial Sequence: Synthetic oligonucleotide
  Target: DMPK; (-) strand; PAM type: NRG; PAM sequence: CAG
gtggctcatgcctgtaatcc

SEQ ID NO: 8551 - DNA, 20 bp, Artificial Sequence
  Description of Artificial Sequence: Synthetic oligonucleotide
  Target: DMPK; (-) strand; PAM type: NRG; PAM sequence: TGG
tggaccgcggccgggcgctg

SEQ ID NO: 8552 - DNA, 20 bp, Artificial Sequence
  Description of Artificial Sequence: Synthetic oligonucleotide
  Target: DMPK; (-) strand; PAM type: NRG; PAM sequence: GGG
aaataggctggaccgcggcc

SEQ ID NO: 8553 - DNA, 20 bp, Artificial Sequence
  Description of Artificial Sequence: Synthetic oligonucleotide
  Target: DMPK; (-) strand; PAM type: NRG; PAM sequence: CGG
aaaataggctggaccgcggc

SEQ ID NO: 8554 - DNA, 20 bp, Artificial Sequence
  Description of Artificial Sequence: Synthetic oligonucleotide
  Target: DMPK; (-) strand; PAM type: NRG; PAM sequence: CGG
aaaaaaaataggctggaccg

SEQ ID NO: 8555 - DNA, 20 bp, Artificial Sequence
  Description of Artificial Sequence: Synthetic oligonucleotide
  Target: DMPK; (-) strand; PAM type: NRG; PAM sequence: TGG
aaaaaaaaaaaaaaataggc

SEQ ID NO: 8556 - DNA, 20 bp, Artificial Sequence
  Description of Artificial Sequence: Synthetic oligonucleotide
  Target: DMPK; (-) strand; PAM type: NRG; PAM sequence: AGG
aaaaaaaaaaaaaaaaaaat

SEQ ID NO: 8557 - DNA, 20 bp, Artificial Sequence
  Description of Artificial Sequence: Synthetic oligonucleotide
  Target: DMPK; (-) strand; PAM type: NRG; PAM sequence: TAG
aaaaaaaaaaaaaaaaaaaa

SEQ ID NO: 8558 - DNA, 20 bp, Artificial Sequence
  Description of Artificial Sequence: Synthetic oligonucleotide
  Target: DMPK; (-) strand; PAM type: NRG; PAM sequence: CAG
gacagagcgagactctgtct

SEQ ID NO: 8559 - DNA, 20 bp, Artificial Sequence
  Description of Artificial Sequence: Synthetic oligonucleotide
  Target: DMPK; (-) strand; PAM type: NRG; PAM sequence: GAG
tccagcctgggcgacagagc

SEQ ID NO: 8560 - DNA, 20 bp, Artificial Sequence
  Description of Artificial Sequence: Synthetic oligonucleotide
  Target: DMPK; (-) strand; PAM type: NRG; PAM sequence: GAG
gcactccagcctgggcgaca

SEQ ID NO: 8561 - DNA, 20 bp, Artificial Sequence
  Description of Artificial Sequence: Synthetic oligonucleotide
  Target: DMPK; (-) strand; PAM type: NRG; PAM sequence: CAG
ctgcactccagcctgggcga

SEQ ID NO: 8562 - DNA, 20 bp, Artificial Sequence
  Description of Artificial Sequence: Synthetic oligonucleotide
  Target: DMPK; (-) strand; PAM type: NRG; PAM sequence: GGG
gtgccactgcactccagcct

SEQ ID NO: 8563 - DNA, 20 bp, Artificial Sequence
  Description of Artificial Sequence: Synthetic oligonucleotide
  Target: DMPK; (-) strand; PAM type: NRG; PAM sequence: TGG
cgtgccactgcactccagcc

SEQ ID NO: 8564 - DNA, 20 bp, Artificial Sequence
  Description of Artificial Sequence: Synthetic oligonucleotide
  Target: DMPK; (-) strand; PAM type: NRG; PAM sequence: CAG
gagatcgtgccactgcactc

SEQ ID NO: 8565 - DNA, 20 bp, Artificial Sequence
  Description of Artificial Sequence: Synthetic oligonucleotide
  Target: DMPK; (-) strand; PAM type: NRG; PAM sequence: GAG
ggcagagtttgcagtgagcc

SEQ ID NO: 8566 - DNA, 20 bp, Artificial Sequence
  Description of Artificial Sequence: Synthetic oligonucleotide
  Target: DMPK; (-) strand; PAM type: NRG; PAM sequence: GAG
cgggaggcagagtttgcagt

SEQ ID NO: 8567 - DNA, 20 bp, Artificial Sequence
  Description of Artificial Sequence: Synthetic oligonucleotide
  Target: DMPK; (-) strand; PAM type: NRG; PAM sequence: CAG
aacccgggaggcagagtttg

SEQ ID NO: 8568 - DNA, 20 bp, Artificial Sequence
  Description of Artificial Sequence: Synthetic oligonucleotide
  Target: DMPK; (-) strand; PAM type: NRG; PAM sequence: GAG
tggcgtgaacccgggaggca

SEQ ID NO: 8569 - DNA, 20 bp, Artificial Sequence
  Description of Artificial Sequence: Synthetic oligonucleotide
  Target: DMPK; (-) strand; PAM type: NRG; PAM sequence: CAG
aatggcgtgaacccgggagg

SEQ ID NO: 8570 - DNA, 20 bp, Artificial Sequence
  Description of Artificial Sequence: Synthetic oligonucleotide
  Target: DMPK; (-) strand; PAM type: NRG; PAM sequence: AGG
gagaatggcgtgaacccggg

SEQ ID NO: 8571 - DNA, 20 bp, Artificial Sequence
  Description of Artificial Sequence: Synthetic oligonucleotide
  Target: DMPK; (-) strand; PAM type: NRG; PAM sequence: GAG
ggagaatggcgtgaacccgg

SEQ ID NO: 8572 - DNA, 20 bp, Artificial Sequence
  Description of Artificial Sequence: Synthetic oligonucleotide
  Target: DMPK; (-) strand; PAM type: NRG; PAM sequence: GGG
caggagaatggcgtgaaccc

SEQ ID NO: 8573 - DNA, 20 bp, Artificial Sequence
  Description of Artificial Sequence: Synthetic oligonucleotide
  Target: DMPK; (-) strand; PAM type: NRG; PAM sequence: CGG
gcaggagaatggcgtgaacc

SEQ ID NO: 8574 - DNA, 20 bp, Artificial Sequence
  Description of Artificial Sequence: Synthetic oligonucleotide
  Target: DMPK; (-) strand; PAM type: NRG; PAM sequence: TGG
aggaggctgaggcaggagaa

SEQ ID NO: 8575 - DNA, 20 bp, Artificial Sequence
  Description of Artificial Sequence: Synthetic oligonucleotide
  Target: DMPK; (-) strand; PAM type: NRG; PAM sequence: GAG
tactcaggaggctgaggcag

SEQ ID NO: 8576 - DNA, 20 bp, Artificial Sequence
  Description of Artificial Sequence: Synthetic oligonucleotide
  Target: DMPK; (-) strand; PAM type: NRG; PAM sequence: AGG
gctactcaggaggctgaggc

SEQ ID NO: 8577 - DNA, 20 bp, Artificial Sequence
  Description of Artificial Sequence: Synthetic oligonucleotide
  Target: DMPK; (-) strand; PAM type: NRG; PAM sequence: CAG
agctactcaggaggctgagg

SEQ ID NO: 8578 - DNA, 20 bp, Artificial Sequence
  Description of Artificial Sequence: Synthetic oligonucleotide
  Target: DMPK; (-) strand; PAM type: NRG; PAM sequence: AGG
cccagctactcaggaggctg

SEQ ID NO: 8579 - DNA, 20 bp, Artificial Sequence
  Description of Artificial Sequence: Synthetic oligonucleotide
  Target: DMPK; (-) strand; PAM type: NRG; PAM sequence: GAG
tcccagctactcaggaggct

SEQ ID NO: 8580 - DNA, 20 bp, Artificial Sequence
  Description of Artificial Sequence: Synthetic oligonucleotide
  Target: DMPK; (-) strand; PAM type: NRG; PAM sequence: AGG
tgtagtcccagctactcagg

SEQ ID NO: 8581 - DNA, 20 bp, Artificial Sequence
  Description of Artificial Sequence: Synthetic oligonucleotide
  Target: DMPK; (-) strand; PAM type: NRG; PAM sequence: GAG
ctgtagtcccagctactcag

SEQ ID NO: 8582 - DNA, 20 bp, Artificial Sequence
  Description of Artificial Sequence: Synthetic oligonucleotide
  Target: DMPK; (-) strand; PAM type: NRG; PAM sequence: AGG
gcctgtagtcccagctactc

SEQ ID NO: 8583 - DNA, 20 bp, Artificial Sequence
  Description of Artificial Sequence: Synthetic oligonucleotide
  Target: DMPK; (-) strand; PAM type: NRG; PAM sequence: CAG
cgcctgtagtcccagctact

SEQ ID NO: 8584 - DNA, 20 bp, Artificial Sequence
  Description of Artificial Sequence: Synthetic oligonucleotide
  Target: DMPK; (-) strand; PAM type: NRG; PAM sequence: CAG
gtggcgggcgcctgtagtcc

SEQ ID NO: 8585 - DNA, 20 bp, Artificial Sequence
  Description of Artificial Sequence: Synthetic oligonucleotide
  Target: DMPK; (-) strand; PAM type: NRG; PAM sequence: TAG
ggcgtggtggcgggcgcctg

SEQ ID NO: 8586 - DNA, 20 bp, Artificial Sequence
  Description of Artificial Sequence: Synthetic oligonucleotide
  Target: DMPK; (-) strand; PAM type: NRG; PAM sequence: GGG
aattagccaggcgtggtggc

SEQ ID NO: 8587 - DNA, 20 bp, Artificial Sequence
  Description of Artificial Sequence: Synthetic oligonucleotide
  Target: DMPK; (-) strand; PAM type: NRG; PAM sequence: CGG
aaattagccaggcgtggtgg

SEQ ID NO: 8588 - DNA, 20 bp, Artificial Sequence
  Description of Artificial Sequence: Synthetic oligonucleotide
  Target: DMPK; (-) strand; PAM type: NRG; PAM sequence: TGG
aaaaaattagccaggcgtgg

SEQ ID NO: 8589 - DNA, 20 bp, Artificial Sequence
  Description of Artificial Sequence: Synthetic oligonucleotide
  Target: DMPK; (-) strand; PAM type: NRG; PAM sequence: TGG
tacaaaaaattagccaggcg

SEQ ID NO: 8590 - DNA, 20 bp, Artificial Sequence
  Description of Artificial Sequence: Synthetic oligonucleotide
  Target: DMPK; (-) strand; PAM type: NRG; PAM sequence: AGG
aaaaatacaaaaaattagcc

SEQ ID NO: 8591 - DNA, 20 bp, Artificial Sequence
  Description of Artificial Sequence: Synthetic oligonucleotide
  Target: DMPK; (-) strand; PAM type: NRG; PAM sequence: CAG
taaaaatacaaaaaattagc

SEQ ID NO: 8592 - DNA, 20 bp, Artificial Sequence
  Description of Artificial Sequence: Synthetic oligonucleotide
  Target: DMPK; (-) strand; PAM type: NRG; PAM sequence: TAG
ctcctaaaaatacaaaaaat

SEQ ID NO: 8593 - DNA, 20 bp, Artificial Sequence
  Description of Artificial Sequence: Synthetic oligonucleotide
  Target: DMPK; (-) strand; PAM type: NRG; PAM sequence: CGG
cgagaccatcttggctaaca

SEQ ID NO: 8594 - DNA, 20 bp, Artificial Sequence
  Description of Artificial Sequence: Synthetic oligonucleotide
  Target: DMPK; (-) strand; PAM type: NRG; PAM sequence: TGG
tcaggagatcgagaccatct

SEQ ID NO: 8595 - DNA, 20 bp, Artificial Sequence
  Description of Artificial Sequence: Synthetic oligonucleotide
  Target: DMPK; (-) strand; PAM type: NRG; PAM sequence: GAG
gatcacgaggtcaggagatc

SEQ ID NO: 8596 - DNA, 20 bp, Artificial Sequence
  Description of Artificial Sequence: Synthetic oligonucleotide
  Target: DMPK; (-) strand; PAM type: NRG; PAM sequence: GAG
cgggtggatcacgaggtcag

SEQ ID NO: 8597 - DNA, 20 bp, Artificial Sequence
  Description of Artificial Sequence: Synthetic oligonucleotide
  Target: DMPK; (-) strand; PAM type: NRG; PAM sequence: AGG
ggcgggtggatcacgaggtc

SEQ ID NO: 8598 - DNA, 20 bp, Artificial Sequence
  Description of Artificial Sequence: Synthetic oligonucleotide
  Target: DMPK; (-) strand; PAM type: NRG; PAM sequence: CAG
aggcgggtggatcacgaggt

SEQ ID NO: 8599 - DNA, 20 bp, Artificial Sequence
  Description of Artificial Sequence: Synthetic oligonucleotide
  Target: DMPK; (-) strand; PAM type: NRG; PAM sequence: AGG
gccgaggcgggtggatcacg

SEQ ID NO: 8600 - DNA, 20 bp, Artificial Sequence
  Description of Artificial Sequence: Synthetic oligonucleotide
  Target: DMPK; (-) strand; PAM type: NRG; PAM sequence: GAG
ggccgaggcgggtggatcac

SEQ ID NO: 8601 - DNA, 20 bp, Artificial Sequence
  Description of Artificial Sequence: Synthetic oligonucleotide
  Target: DMPK; (-) strand; PAM type: NRG; PAM sequence: TGG
ctttgggaggccgaggcggg

SEQ ID NO: 8602 - DNA, 20 bp, Artificial Sequence
  Description of Artificial Sequence: Synthetic oligonucleotide
  Target: DMPK; (-) strand; PAM type: NRG; PAM sequence: GGG
gcactttgggaggccgaggc

SEQ ID NO: 8603 - DNA, 20 bp, Artificial Sequence
  Description of Artificial Sequence: Synthetic oligonucleotide
  Target: DMPK; (-) strand; PAM type: NRG; PAM sequence: CGG
agcactttgggaggccgagg

SEQ ID NO: 8604 - DNA, 20 bp, Artificial Sequence
  Description of Artificial Sequence: Synthetic oligonucleotide
  Target: DMPK; (-) strand; PAM type: NRG; PAM sequence: AGG
ctcagcactttgggaggccg

SEQ ID NO: 8605 - DNA, 20 bp, Artificial Sequence
  Description of Artificial Sequence: Synthetic oligonucleotide
  Target: DMPK; (-) strand; PAM type: NRG; PAM sequence: GAG
tctcagcactttgggaggcc

SEQ ID NO: 8606 - DNA, 20 bp, Artificial Sequence
  Description of Artificial Sequence: Synthetic oligonucleotide
  Target: DMPK; (-) strand; PAM type: NRG; PAM sequence: AGG
tgtaatctcagcactttggg

SEQ ID NO: 8607 - DNA, 20 bp, Artificial Sequence
  Description of Artificial Sequence: Synthetic oligonucleotide
  Target: DMPK; (-) strand; PAM type: NRG; PAM sequence: GAG
ctgtaatctcagcactttgg

SEQ ID NO: 8608 - DNA, 20 bp, Artificial Sequence
  Description of Artificial Sequence: Synthetic oligonucleotide
  Target: DMPK; (-) strand; PAM type: NRG; PAM sequence: GGG
gcctgtaatctcagcacttt

SEQ ID NO: 8609 - DNA, 20 bp, Artificial Sequence
  Description of Artificial Sequence: Synthetic oligonucleotide
  Target: DMPK; (-) strand; PAM type: NRG; PAM sequence: TGG
cgcctgtaatctcagcactt

SEQ ID NO: 8610 - DNA, 20 bp, Artificial Sequence
  Description of Artificial Sequence: Synthetic oligonucleotide
  Target: DMPK; (-) strand; PAM type: NRG; PAM sequence: CAG
gtggctcacgcctgtaatct

SEQ ID NO: 8611 - DNA, 20 bp, Artificial Sequence
  Description of Artificial Sequence: Synthetic oligonucleotide
  Target: DMPK; (-) strand; PAM type: NRG; PAM sequence: TGG
gctgggctggccgggcgtgg

SEQ ID NO: 8612 - DNA, 20 bp, Artificial Sequence
  Description of Artificial Sequence: Synthetic oligonucleotide
  Target: DMPK; (-) strand; PAM type: NRG; PAM sequence: TGG
taggctgggctggccgggcg

SEQ ID NO: 8613 - DNA, 20 bp, Artificial Sequence
  Description of Artificial Sequence: Synthetic oligonucleotide
  Target: DMPK; (-) strand; PAM type: NRG; PAM sequence: GGG
aaaaataggctgggctggcc

SEQ ID NO: 8614 - DNA, 20 bp, Artificial Sequence
  Description of Artificial Sequence: Synthetic oligonucleotide
  Target: DMPK; (-) strand; PAM type: NRG; PAM sequence: CGG
aaaaaataggctgggctggc

SEQ ID NO: 8615 - DNA, 20 bp, Artificial Sequence
  Description of Artificial Sequence: Synthetic oligonucleotide
  Target: DMPK; (-) strand; PAM type: NRG; PAM sequence: TGG
aattaaaaaataggctgggc

SEQ ID NO: 8616 - DNA, 20 bp, Artificial Sequence
  Description of Artificial Sequence: Synthetic oligonucleotide
  Target: DMPK; (-) strand; PAM type: NRG; PAM sequence: GGG
ctgaaattaaaaaataggct

SEQ ID NO: 8617 - DNA, 20 bp, Artificial Sequence
  Description of Artificial Sequence: Synthetic oligonucleotide
  Target: DMPK; (-) strand; PAM type: NRG; PAM sequence: TGG
actgaaattaaaaaataggc

SEQ ID NO: 8618 - DNA, 20 bp, Artificial Sequence
  Description of Artificial Sequence: Synthetic oligonucleotide
  Target: DMPK; (-) strand; PAM type: NRG; PAM sequence: AGG
ataaactgaaattaaaaaat

SEQ ID NO: 8619 - DNA, 20 bp, Artificial Sequence
  Description of Artificial Sequence: Synthetic oligonucleotide
  Target: DMPK; (-) strand; PAM type: NRG; PAM sequence: TAG
gataaactgaaattaaaaaa

SEQ ID NO: 8620 - DNA, 20 bp, Artificial Sequence
  Description of Artificial Sequence: Synthetic oligonucleotide
  Target: DMPK; (-) strand; PAM type: NRG; PAM sequence: AAG
agagactctgtctcaaaaat

SEQ ID NO: 8621 - DNA, 20 bp, Artificial Sequence
  Description of Artificial Sequence: Synthetic oligonucleotide
  Target: DMPK; (-) strand; PAM type: NRG; PAM sequence: GAG
tccagcctgggcaacggaga

SEQ ID NO: 8622 - DNA, 20 bp, Artificial Sequence
  Description of Artificial Sequence: Synthetic oligonucleotide
  Target: DMPK; (-) strand; PAM type: NRG; PAM sequence: GAG
actccagcctgggcaacgga

SEQ ID NO: 8623 - DNA, 20 bp, Artificial Sequence
  Description of Artificial Sequence: Synthetic oligonucleotide
  Target: DMPK; (-) strand; PAM type: NRG; PAM sequence: GAG
gcactccagcctgggcaacg

SEQ ID NO: 8624 - DNA, 20 bp, Artificial Sequence
  Description of Artificial Sequence: Synthetic oligonucleotide
  Target: DMPK; (-) strand; PAM type: NRG; PAM sequence: CGG
ctgcactccagcctgggcaa

SEQ ID NO: 8625 - DNA, 20 bp, Artificial Sequence
  Description of Artificial Sequence: Synthetic oligonucleotide
  Target: DMPK; (-) strand; PAM type: NRG; PAM sequence: GGG
gtgccactgcactccagcct

SEQ ID NO: 8626 - DNA, 20 bp, Artificial Sequence
  Description of Artificial Sequence: Synthetic oligonucleotide
  Target: DMPK; (-) strand; PAM type: NRG; PAM sequence: TGG
tgtgccactgcactccagcc

SEQ ID NO: 8627 - DNA, 20 bp, Artificial Sequence
  Description of Artificial Sequence: Synthetic oligonucleotide
  Target: DMPK; (-) strand; PAM type: NRG; PAM sequence: CAG
gtgattgtgccactgcactc

SEQ ID NO: 8628 - DNA, 20 bp, Artificial Sequence
  Description of Artificial Sequence: Synthetic oligonucleotide
  Target: DMPK; (-) strand; PAM type: NRG; PAM sequence: GAG
caggaggtcaaggctgcagt

SEQ ID NO: 8629 - DNA, 20 bp, Artificial Sequence
  Description of Artificial Sequence: Synthetic oligonucleotide
  Target: DMPK; (-) strand; PAM type: NRG; PAM sequence: CAG
agcccaggaggtcaaggctg

SEQ ID NO: 8630 - DNA, 20 bp, Artificial Sequence
  Description of Artificial Sequence: Synthetic oligonucleotide
  Target: DMPK; (-) strand; PAM type: NRG; PAM sequence: AGG
ggcttgagcccaggaggtca

SEQ ID NO: 8631 - DNA, 20 bp, Artificial Sequence
  Description of Artificial Sequence: Synthetic oligonucleotide
  Target: DMPK; (-) strand; PAM type: NRG; PAM sequence: AAG
gggcttgagcccaggaggtc

SEQ ID NO: 8632 - DNA, 20 bp, Artificial Sequence
  Description of Artificial Sequence: Synthetic oligonucleotide
  Target: DMPK; (-) strand; PAM type: NRG; PAM sequence: AGG
gacgtgggcttgagcccagg

SEQ ID NO: 8633 - DNA, 20 bp, Artificial Sequence
  Description of Artificial Sequence: Synthetic oligonucleotide
  Target: DMPK; (-) strand; PAM type: NRG; PAM sequence: GAG
cgacgtgggcttgagcccag

SEQ ID NO: 8634 - DNA, 20 bp, Artificial Sequence
  Description of Artificial Sequence: Synthetic oligonucleotide
  Target: DMPK; (-) strand; PAM type: NRG; PAM sequence: AGG
gccgacgtgggcttgagccc

SEQ ID NO: 8635 - DNA, 20 bp, Artificial Sequence
  Description of Artificial Sequence: Synthetic oligonucleotide
  Target: DMPK; (-) strand; PAM type: NRG; PAM sequence: CAG
ggccgacgtgggcttgagcc

SEQ ID NO: 8636 - DNA, 20 bp, Artificial Sequence
  Description of Artificial Sequence: Synthetic oligonucleotide
  Target: DMPK; (-) strand; PAM type: NRG; PAM sequence: GAG
agggtggccgacgtgggctt

SEQ ID NO: 8637 - DNA, 20 bp, Artificial Sequence
  Description of Artificial Sequence: Synthetic oligonucleotide
  Target: DMPK; (-) strand; PAM type: NRG; PAM sequence: GGG
gctactagggtggccgacgt

SEQ ID NO: 8638 - DNA, 20 bp, Artificial Sequence
  Description of Artificial Sequence: Synthetic oligonucleotide
  Target: DMPK; (-) strand; PAM type: NRG; PAM sequence: TGG
agctactagggtggccgacg

SEQ ID NO: 8639 - DNA, 20 bp, Artificial Sequence
  Description of Artificial Sequence: Synthetic oligonucleotide
  Target: DMPK; (-) strand; PAM type: NRG; PAM sequence: TGG
tgtatactcagctactaggg

SEQ ID NO: 8640 - DNA, 20 bp, Artificial Sequence
  Description of Artificial Sequence: Synthetic oligonucleotide
  Target: DMPK; (-) strand; PAM type: NRG; PAM sequence: GGG
gcctgtatactcagctacta

SEQ ID NO: 8641 - DNA, 20 bp, Artificial Sequence
  Description of Artificial Sequence: Synthetic oligonucleotide
  Target: DMPK; (-) strand; PAM type: NRG; PAM sequence: AGG
tgcctgtatactcagctact

SEQ ID NO: 8642 - DNA, 20 bp, Artificial Sequence
  Description of Artificial Sequence: Synthetic oligonucleotide
  Target: DMPK; (-) strand; PAM type: NRG; PAM sequence: TAG
atgcctgtatactcagctac

SEQ ID NO: 8643 - DNA, 20 bp, Artificial Sequence
  Description of Artificial Sequence: Synthetic oligonucleotide
  Target: DMPK; (-) strand; PAM type: NRG; PAM sequence: CAG
gtggcgcatgcctgtatact

SEQ ID NO: 8644 - DNA, 20 bp, Artificial Sequence
  Description of Artificial Sequence: Synthetic oligonucleotide
  Target: DMPK; (-) strand; PAM type: NRG; PAM sequence: TGG
taaaaattggttgggcgtgg

SEQ ID NO: 8645 - DNA, 20 bp, Artificial Sequence
  Description of Artificial Sequence: Synthetic oligonucleotide
  Target: DMPK; (-) strand; PAM type: NRG; PAM sequence: TGG
ttttaaaaattggttgggcg

SEQ ID NO: 8646 - DNA, 20 bp, Artificial Sequence
  Description of Artificial Sequence: Synthetic oligonucleotide
  Target: DMPK; (-) strand; PAM type: NRG; PAM sequence: GGG
aaatgttttaaaaattggtt

SEQ ID NO: 8647 - DNA, 20 bp, Artificial Sequence
  Description of Artificial Sequence: Synthetic oligonucleotide
  Target: DMPK; (-) strand; PAM type: NRG; PAM sequence: TGG
aaaatgttttaaaaattggt

SEQ ID NO: 8648 - DNA, 20 bp, Artificial Sequence
  Description of Artificial Sequence: Synthetic oligonucleotide
  Target: DMPK; (-) strand; PAM type: NRG; PAM sequence: TGG
tacaaaaatgttttaaaaat

SEQ ID NO: 8649 - DNA, 20 bp, Artificial Sequence
  Description of Artificial Sequence: Synthetic oligonucleotide
  Target: DMPK; (-) strand; PAM type: NRG; PAM sequence: GAG
accagcctgggcaatgtggt

SEQ ID NO: 8650 - DNA, 20 bp, Artificial Sequence
  Description of Artificial Sequence: Synthetic oligonucleotide
  Target: DMPK; (-) strand; PAM type: NRG; PAM sequence: TGG
cgagaccagcctgggcaatg

SEQ ID NO: 8651 - DNA, 20 bp, Artificial Sequence
  Description of Artificial Sequence: Synthetic oligonucleotide
  Target: DMPK; (-) strand; PAM type: NRG; PAM sequence: GGG
caggagttcgagaccagcct

SEQ ID NO: 8652 - DNA, 20 bp, Artificial Sequence
  Description of Artificial Sequence: Synthetic oligonucleotide
  Target: DMPK; (-) strand; PAM type: NRG; PAM sequence: TGG
ccaggagttcgagaccagcc

SEQ ID NO: 8653 - DNA, 20 bp, Artificial Sequence
  Description of Artificial Sequence: Synthetic oligonucleotide
  Target: DMPK; (-) strand; PAM type: NRG; PAM sequence: CAG
tgagcccaggagttcgagac

SEQ ID NO: 8654 - DNA, 20 bp, Artificial Sequence
  Description of Artificial Sequence: Synthetic oligonucleotide
  Target: DMPK; (-) strand; PAM type: NRG; PAM sequence: GAG
ttgcttgagcccaggagttc

SEQ ID NO: 8655 - DNA, 20 bp, Artificial Sequence
  Description of Artificial Sequence: Synthetic oligonucleotide
  Target: DMPK; (-) strand; PAM type: NRG; PAM sequence: GAG
ggtggattgcttgagcccag

SEQ ID NO: 8656 - DNA, 20 bp, Artificial Sequence
  Description of Artificial Sequence: Synthetic oligonucleotide
  Target: DMPK; (-) strand; PAM type: NRG; PAM sequence: AGG
tgggtggattgcttgagccc

SEQ ID NO: 8657 - DNA, 20 bp, Artificial Sequence
  Description of Artificial Sequence: Synthetic oligonucleotide
  Target: DMPK; (-) strand; PAM type: NRG; PAM sequence: CAG
gtgggtggattgcttgagcc

SEQ ID NO: 8658 - DNA, 20 bp, Artificial Sequence
  Description of Artificial Sequence: Synthetic oligonucleotide
  Target: DMPK; (-) strand; PAM type: NRG; PAM sequence: GAG
ccgaagtgggtggattgctt

SEQ ID NO: 8659 - DNA, 20 bp, Artificial Sequence
  Description of Artificial Sequence: Synthetic oligonucleotide
  Target: DMPK; (-) strand; PAM type: NRG; PAM sequence: TGG
atttggcaggccgaagtggg

SEQ ID NO: 8660 - DNA, 20 bp, Artificial Sequence
  Description of Artificial Sequence: Synthetic oligonucleotide
  Target: DMPK; (-) strand; PAM type: NRG; PAM sequence: GGG
gcaatttggcaggccgaagt

SEQ ID NO: 8661 - DNA, 20 bp, Artificial Sequence
  Description of Artificial Sequence: Synthetic oligonucleotide
  Target: DMPK; (-) strand; PAM type: NRG; PAM sequence: TGG
agcaatttggcaggccgaag

SEQ ID NO: 8662 - DNA, 20 bp, Artificial Sequence
  Description of Artificial Sequence: Synthetic oligonucleotide
  Target: DMPK; (-) strand; PAM type: NRG; PAM sequence: AAG
cccagcaatttggcaggccg

SEQ ID NO: 8663 - DNA, 20 bp, Artificial Sequence
  Description of Artificial Sequence: Synthetic oligonucleotide
  Target: DMPK; (-) strand; PAM type: NRG; PAM sequence: AGG
tgtaaccccagcaatttggc

SEQ ID NO: 8664 - DNA, 20 bp, Artificial Sequence
  Description of Artificial Sequence: Synthetic oligonucleotide
  Target: DMPK; (-) strand; PAM type: NRG; PAM sequence: CAG
ctgtaaccccagcaatttgg

SEQ ID NO: 8665 - DNA, 20 bp, Artificial Sequence
  Description of Artificial Sequence: Synthetic oligonucleotide
  Target: DMPK; (-) strand; PAM type: NRG; PAM sequence: TGG
cgcctgtaaccccagcaatt

SEQ ID NO: 8666 - DNA, 20 bp, Artificial Sequence
  Description of Artificial Sequence: Synthetic oligonucleotide
  Target: DMPK; (-) strand; PAM type: NRG; PAM sequence: CAG
gtggctcacgcctgtaaccc

SEQ ID NO: 8667 - DNA, 20 bp, Artificial Sequence
  Description of Artificial Sequence: Synthetic oligonucleotide
  Target: DMPK; (-) strand; PAM type: NRG; PAM sequence: TGG
aatgatggggccaggcacgg

SEQ ID NO: 8668 - DNA, 20 bp, Artificial Sequence
  Description of Artificial Sequence: Synthetic oligonucleotide
  Target: DMPK; (-) strand; PAM type: NRG; PAM sequence: CGG
aaaaatgatggggccaggca

SEQ ID NO: 8669 - DNA, 20 bp, Artificial Sequence
  Description of Artificial Sequence: Synthetic oligonucleotide
  Target: DMPK; (-) strand; PAM type: NRG; PAM sequence: AGG
caagaaaaaatgatggggcc

SEQ ID NO: 8670 - DNA, 20 bp, Artificial Sequence
  Description of Artificial Sequence: Synthetic oligonucleotide
  Target: DMPK; (-) strand; PAM type: NRG; PAM sequence: CAG
acaagaaaaaatgatggggc

SEQ ID NO: 8671 - DNA, 20 bp, Artificial Sequence
  Description of Artificial Sequence: Synthetic oligonucleotide
  Target: DMPK; (-) strand; PAM type: NRG; PAM sequence: GGG
ggatacaagaaaaaatgatg

SEQ ID NO: 8672 - DNA, 20 bp, Artificial Sequence
  Description of Artificial Sequence: Synthetic oligonucleotide
  Target: DMPK; (-) strand; PAM type: NRG; PAM sequence: GGG
aggatacaagaaaaaatgat

SEQ ID NO: 8673 - DNA, 20 bp, Artificial Sequence
  Description of Artificial Sequence: Synthetic oligonucleotide
  Target: DMPK; (-) strand; PAM type: NRG; PAM sequence: TGG
caggatacaagaaaaaatga

SEQ ID NO: 8674 - DNA, 20 bp, Artificial Sequence
  Description of Artificial Sequence: Synthetic oligonucleotide
  Target: DMPK; (-) strand; PAM type: NRG; PAM sequence: AAG
gaagggaagcaacaggatac

SEQ ID NO: 8675 - DNA, 20 bp, Artificial Sequence
  Description of Artificial Sequence: Synthetic oligonucleotide
  Target: DMPK; (-) strand; PAM type: NRG; PAM sequence: AGG
gtgccctgaagggaagcaac

SEQ ID NO: 8676 - DNA, 20 bp, Artificial Sequence
  Description of Artificial Sequence: Synthetic oligonucleotide
  Target: DMPK; (-) strand; PAM type: NRG; PAM sequence: CAG
ggtgccctgaagggaagcaa

SEQ ID NO: 8677 - DNA, 20 bp, Artificial Sequence
  Description of Artificial Sequence: Synthetic oligonucleotide
  Target: DMPK; (-) strand; PAM type: NRG; PAM sequence: AAG
gtggcaggtgccctgaaggg

SEQ ID NO: 8678 - DNA, 20 bp, Artificial Sequence
  Description of Artificial Sequence: Synthetic oligonucleotide
  Target: DMPK; (-) strand; PAM type: NRG; PAM sequence: GGG
agtgtggcaggtgccctgaa

SEQ ID NO: 8679 - DNA, 20 bp, Artificial Sequence
  Description of Artificial Sequence: Synthetic oligonucleotide
  Target: DMPK; (-) strand; PAM type: NRG; PAM sequence: AGG
gagtgtggcaggtgccctga

SEQ ID NO: 8680 - DNA, 20 bp, Artificial Sequence
  Description of Artificial Sequence: Synthetic oligonucleotide
  Target: DMPK; (-) strand; PAM type: NRG; PAM sequence: AAG
agagtgtggcaggtgccctg

SEQ ID NO: 8681 - DNA, 20 bp, Artificial Sequence
  Description of Artificial Sequence: Synthetic oligonucleotide
  Target: DMPK; (-) strand; PAM type: NRG; PAM sequence: AGG
agaattatggagagtgtggc

SEQ ID NO: 8682 - DNA, 20 bp, Artificial Sequence
  Description of Artificial Sequence: Synthetic oligonucleotide
  Target: DMPK; (-) strand; PAM type: NRG; PAM sequence: CAG
gagaattatggagagtgtgg

SEQ ID NO: 8683 - DNA, 20 bp, Artificial Sequence
  Description of Artificial Sequence: Synthetic oligonucleotide
  Target: DMPK; (-) strand; PAM type: NRG; PAM sequence: TGG
ttagagaattatggagagtg

SEQ ID NO: 8684 - DNA, 20 bp, Artificial Sequence
  Description of Artificial Sequence: Synthetic oligonucleotide
  Target: DMPK; (-) strand; PAM type: NRG; PAM sequence: GAG
gagaattagagaattatgga

SEQ ID NO: 8685 - DNA, 20 bp, Artificial Sequence
  Description of Artificial Sequence: Synthetic oligonucleotide
  Target: DMPK; (-) strand; PAM type: NRG; PAM sequence: GAG
tagagaattagagaattatg

SEQ ID NO: 8686 - DNA, 20 bp, Artificial Sequence
  Description of Artificial Sequence: Synthetic oligonucleotide
  Target: DMPK; (-) strand; PAM type: NRG; PAM sequence: TGG
tctagagaattagagaatta

SEQ ID NO: 8687 - DNA, 20 bp, Artificial Sequence
  Description of Artificial Sequence: Synthetic oligonucleotide
  Target: DMPK; (-) strand; PAM type: NRG; PAM sequence: GAG
agttgcagtctagagaatta

SEQ ID NO: 8688 - DNA, 20 bp, Artificial Sequence
  Description of Artificial Sequence: Synthetic oligonucleotide
  Target: DMPK; (-) strand; PAM type: NRG; PAM sequence: TAG
ccagttgcagtctagagaat

SEQ ID NO: 8689 - DNA, 20 bp, Artificial Sequence
  Description of Artificial Sequence: Synthetic oligonucleotide
  Target: DMPK; (-) strand; PAM type: NRG; PAM sequence: GAG
cctcatccagttgcagtcta

SEQ ID NO: 8690 - DNA, 20 bp, Artificial Sequence
  Description of Artificial Sequence: Synthetic oligonucleotide
  Target: DMPK; (-) strand; PAM type: NRG; PAM sequence: TAG
gccctcatccagttgcagtc

SEQ ID NO: 8691 - DNA, 20 bp, Artificial Sequence
  Description of Artificial Sequence: Synthetic oligonucleotide
  Target: DMPK; (-) strand; PAM type: NRG; PAM sequence: CAG
tccctgccctcatccagttg

SEQ ID NO: 8692 - DNA, 20 bp, Artificial Sequence
  Description of Artificial Sequence: Synthetic oligonucleotide
  Target: DMPK; (-) strand; PAM type: NRG; PAM sequence: CAG
ctctggtccctgccctcatc

SEQ ID NO: 8693 - DNA, 20 bp, Artificial Sequence
  Description of Artificial Sequence: Synthetic oligonucleotide
  Target: DMPK; (-) strand; PAM type: NRG; PAM sequence: TGG
agcacggaccagatgagctc

SEQ ID NO: 8694 - DNA, 20 bp, Artificial Sequence
  Description of Artificial Sequence: Synthetic oligonucleotide
  Target: DMPK; (-) strand; PAM type: NRG; PAM sequence: GAG
ggatccagcacggaccagat

SEQ ID NO: 8695 - DNA, 20 bp, Artificial Sequence
  Description of Artificial Sequence: Synthetic oligonucleotide
  Target: DMPK; (-) strand; PAM type: NRG; PAM sequence: CAG
actggggatccagcacggac

SEQ ID NO: 8696 - DNA, 20 bp, Artificial Sequence
  Description of Artificial Sequence: Synthetic oligonucleotide
  Target: DMPK; (-) strand; PAM type: NRG; PAM sequence: CGG
acaatactggggatccagca

SEQ ID NO: 8697 - DNA, 20 bp, Artificial Sequence
  Description of Artificial Sequence: Synthetic oligonucleotide
  Target: DMPK; (-) strand; PAM type: NRG; PAM sequence: CAG
gctgaacaatactggggatc

SEQ ID NO: 8698 - DNA, 20 bp, Artificial Sequence
  Description of Artificial Sequence: Synthetic oligonucleotide
  Target: DMPK; (-) strand; PAM type: NRG; PAM sequence: GGG
ccttttgctgaacaatactg

SEQ ID NO: 8699 - DNA, 20 bp, Artificial Sequence
  Description of Artificial Sequence: Synthetic oligonucleotide
  Target: DMPK; (-) strand; PAM type: NRG; PAM sequence: GGG
cccttttgctgaacaatact

SEQ ID NO: 8700 - DNA, 20 bp, Artificial Sequence
  Description of Artificial Sequence: Synthetic oligonucleotide
  Target: DMPK; (-) strand; PAM type: NRG; PAM sequence: TGG
gcccttttgctgaacaatac

SEQ ID NO: 8701 - DNA, 20 bp, Artificial Sequence
  Description of Artificial Sequence: Synthetic oligonucleotide
  Target: DMPK; (-) strand; PAM type: NRG; PAM sequence: GGG
tggcatgcttgctcggctct

SEQ ID NO: 8702 - DNA, 20 bp, Artificial Sequence
  Description of Artificial Sequence: Synthetic oligonucleotide
  Target: DMPK; (-) strand; PAM type: NRG; PAM sequence: TGG
atggcatgcttgctcggctc

SEQ ID NO: 8703 - DNA, 20 bp, Artificial Sequence
  Description of Artificial Sequence: Synthetic oligonucleotide
  Target: DMPK; (-) strand; PAM type: NRG; PAM sequence: CGG
gctgtcatggcatgcttgct

SEQ ID NO: 8704 - DNA, 20 bp, Artificial Sequence
  Description of Artificial Sequence: Synthetic oligonucleotide
  Target: DMPK; (-) strand; PAM type: NRG; PAM sequence: TGG
caccgtgtaacaagctgtca

SEQ ID NO: 8705 - DNA, 20 bp, Artificial Sequence
  Description of Artificial Sequence: Synthetic oligonucleotide
  Target: DMPK; (-) strand; PAM type: NRG; PAM sequence: AAG
gtctctcttcaccgtgtaac

SEQ ID NO: 8706 - DNA, 20 bp, Artificial Sequence
  Description of Artificial Sequence: Synthetic oligonucleotide
  Target: DMPK; (-) strand; PAM type: NRG; PAM sequence: AGG
gagaggactcctcctccctt

SEQ ID NO: 8707 - DNA, 20 bp, Artificial Sequence
  Description of Artificial Sequence: Synthetic oligonucleotide
  Target: DMPK; (-) strand; PAM type: NRG; PAM sequence: TAG
ggagaggactcctcctccct

SEQ ID NO: 8708 - DNA, 20 bp, Artificial Sequence
  Description of Artificial Sequence: Synthetic oligonucleotide
  Target: DMPK; (-) strand; PAM type: NRG; PAM sequence: AGG
ggagggatgagaagcaggag

SEQ ID NO: 8709 - DNA, 20 bp, Artificial Sequence
  Description of Artificial Sequence: Synthetic oligonucleotide
  Target: DMPK; (-) strand; PAM type: NRG; PAM sequence: GAG
tggagggatgagaagcagga

SEQ ID NO: 8710 - DNA, 20 bp, Artificial Sequence
  Description of Artificial Sequence: Synthetic oligonucleotide
  Target: DMPK; (-) strand; PAM type: NRG; PAM sequence: GAG
cttggagggatgagaagcag

SEQ ID NO: 8711 - DNA, 20 bp, Artificial Sequence
  Description of Artificial Sequence: Synthetic oligonucleotide
  Target: DMPK; (-) strand; PAM type: NRG; PAM sequence: AGG
gacttggagggatgagaagc

SEQ ID NO: 8712 - DNA, 20 bp, Artificial Sequence
  Description of Artificial Sequence: Synthetic oligonucleotide
  Target: DMPK; (-) strand; PAM type: NRG; PAM sequence: CAG
agacttggagggatgagaag

SEQ ID NO: 8713 - DNA, 20 bp, Artificial Sequence
  Description of Artificial Sequence: Synthetic oligonucleotide
  Target: DMPK; (-) strand; PAM type: NRG; PAM sequence: AAG
ctgagacttggagggatgag

SEQ ID NO: 8714 - DNA, 20 bp, Artificial Sequence
  Description of Artificial Sequence: Synthetic oligonucleotide
  Target: DMPK; (-) strand; PAM type: NRG; PAM sequence: GAG
gagctgagacttggagggat

SEQ ID NO: 8715 - DNA, 20 bp, Artificial Sequence
  Description of Artificial Sequence: Synthetic oligonucleotide
  Target: DMPK; (-) strand; PAM type: NRG; PAM sequence: GGG
tatctgagctgagacttgga

SEQ ID NO: 8716 - DNA, 20 bp, Artificial Sequence
  Description of Artificial Sequence: Synthetic oligonucleotide
  Target: DMPK; (-) strand; PAM type: NRG; PAM sequence: AGG
ctatctgagctgagacttgg

SEQ ID NO: 8717 - DNA, 20 bp, Artificial Sequence
  Description of Artificial Sequence: Synthetic oligonucleotide
  Target: DMPK; (-) strand; PAM type: NRG; PAM sequence: GAG
gctatctgagctgagacttg

SEQ ID NO: 8718 - DNA, 20 bp, Artificial Sequence
  Description of Artificial Sequence: Synthetic oligonucleotide
  Target: DMPK; (-) strand; PAM type: NRG; PAM sequence: TGG
gagctatctgagctgagact

SEQ ID NO: 8719 - DNA, 20 bp, Artificial Sequence
  Description of Artificial Sequence: Synthetic oligonucleotide
  Target: DMPK; (-) strand; PAM type: NRG; PAM sequence: GAG
agtggggagctatctgagct

SEQ ID NO: 8720 - DNA, 20 bp, Artificial Sequence
  Description of Artificial Sequence: Synthetic oligonucleotide
  Target: DMPK; (-) strand; PAM type: NRG; PAM sequence: GAG
tctggagtggggagctatct

SEQ ID NO: 8721 - DNA, 20 bp, Artificial Sequence
  Description of Artificial Sequence: Synthetic oligonucleotide
  Target: DMPK; (-) strand; PAM type: NRG; PAM sequence: GAG
ggagggctttctggagtggg

SEQ ID NO: 8722 - DNA, 20 bp, Artificial Sequence
  Description of Artificial Sequence: Synthetic oligonucleotide
  Target: DMPK; (-) strand; PAM type: NRG; PAM sequence: GGG
ctggagggctttctggagtg

SEQ ID NO: 8723 - DNA, 20 bp, Artificial Sequence
  Description of Artificial Sequence: Synthetic oligonucleotide
  Target: DMPK; (-) strand; PAM type: NRG; PAM sequence: GGG
cctggagggctttctggagt

SEQ ID NO: 8724 - DNA, 20 bp, Artificial Sequence
  Description of Artificial Sequence: Synthetic oligonucleotide
  Target: DMPK; (-) strand; PAM type: NRG; PAM sequence: TGG
tcctggagggctttctggag

SEQ ID NO: 8725 - DNA, 20 bp, Artificial Sequence
  Description of Artificial Sequence: Synthetic oligonucleotide
  Target: DMPK; (-) strand; PAM type: NRG; PAM sequence: GAG
aggtcctggagggctttctg

SEQ ID NO: 8726 - DNA, 20 bp, Artificial Sequence
  Description of Artificial Sequence: Synthetic oligonucleotide
  Target: DMPK; (-) strand; PAM type: NRG; PAM sequence: TGG
gaaggtcctggagggctttc

SEQ ID NO: 8727 - DNA, 20 bp, Artificial Sequence
  Description of Artificial Sequence: Synthetic oligonucleotide
  Target: DMPK; (-) strand; PAM type: NRG; PAM sequence: GGG
tcagcaaggaaggtcctgga

SEQ ID NO: 8728 - DNA, 20 bp, Artificial Sequence
  Description of Artificial Sequence: Synthetic oligonucleotide
  Target: DMPK; (-) strand; PAM type: NRG; PAM sequence: AGG
ctcagcaaggaaggtcctgg

SEQ ID NO: 8729 - DNA, 20 bp, Artificial Sequence
  Description of Artificial Sequence: Synthetic oligonucleotide
  Target: DMPK; (-) strand; PAM type: NRG; PAM sequence: GAG
actcagcaaggaaggtcctg

SEQ ID NO: 8730 - DNA, 20 bp, Artificial Sequence
  Description of Artificial Sequence: Synthetic oligonucleotide
  Target: DMPK; (-) strand; PAM type: NRG; PAM sequence: TGG
tgactcagcaaggaaggtcc

SEQ ID NO: 8731 - DNA, 20 bp, Artificial Sequence
  Description of Artificial Sequence: Synthetic oligonucleotide
  Target: DMPK; (-) strand; PAM type: NRG; PAM sequence: AGG
gactcctgactcagcaagga

SEQ ID NO: 8732 - DNA, 20 bp, Artificial Sequence
  Description of Artificial Sequence: Synthetic oligonucleotide
  Target: DMPK; (-) strand; PAM type: NRG; PAM sequence: AAG
ggactcctgactcagcaagg

SEQ ID NO: 8733 - DNA, 20 bp, Artificial Sequence
  Description of Artificial Sequence: Synthetic oligonucleotide
  Target: DMPK; (-) strand; PAM type: NRG; PAM sequence: AGG
gggggactcctgactcagca

SEQ ID NO: 8734 - DNA, 20 bp, Artificial Sequence
  Description of Artificial Sequence: Synthetic oligonucleotide
  Target: DMPK; (-) strand; PAM type: NRG; PAM sequence: AAG
tgggggactcctgactcagc

SEQ ID NO: 8735 - DNA, 20 bp, Artificial Sequence
  Description of Artificial Sequence: Synthetic oligonucleotide
  Target: DMPK; (-) strand; PAM type: NRG; PAM sequence: CAG
ggggtgggggactcctgact

SEQ ID NO: 8736 - DNA, 20 bp, Artificial Sequence
  Description of Artificial Sequence: Synthetic oligonucleotide
  Target: DMPK; (-) strand; PAM type: NRG; PAM sequence: GGG
caatggagtgcagggggtgg

SEQ ID NO: 8737 - DNA, 20 bp, Artificial Sequence
  Description of Artificial Sequence: Synthetic oligonucleotide
  Target: DMPK; (-) strand; PAM type: NRG; PAM sequence: GGG
acaatggagtgcagggggtg

SEQ ID NO: 8738 - DNA, 20 bp, Artificial Sequence
  Description of Artificial Sequence: Synthetic oligonucleotide
  Target: DMPK; (-) strand; PAM type: NRG; PAM sequence: GGG
gacaatggagtgcagggggt

SEQ ID NO: 8739 - DNA, 20 bp, Artificial Sequence
  Description of Artificial Sequence: Synthetic oligonucleotide
  Target: DMPK; (-) strand; PAM type: NRG; PAM sequence: TGG
agacaatggagtgcaggggg

SEQ ID NO: 8740 - DNA, 20 bp, Artificial Sequence
  Description of Artificial Sequence: Synthetic oligonucleotide
  Target: DMPK; (-) strand; PAM type: NRG; PAM sequence: GGG
ctgagacaatggagtgcagg

SEQ ID NO: 8741 - DNA, 20 bp, Artificial Sequence
  Description of Artificial Sequence: Synthetic oligonucleotide
  Target: DMPK; (-) strand; PAM type: NRG; PAM sequence: GGG
gctgagacaatggagtgcag

SEQ ID NO: 8742 - DNA, 20 bp, Artificial Sequence
  Description of Artificial Sequence: Synthetic oligonucleotide
  Target: DMPK; (-) strand; PAM type: NRG; PAM sequence: GGG
ggctgagacaatggagtgca

SEQ ID NO: 8743 - DNA, 20 bp, Artificial Sequence
  Description of Artificial Sequence: Synthetic oligonucleotide
  Target: DMPK; (-) strand; PAM type: NRG; PAM sequence: AGG
gggctgagacaatggagtgc

SEQ ID NO: 8744 - DNA, 20 bp, Artificial Sequence
  Description of Artificial Sequence: Synthetic oligonucleotide
  Target: DMPK; (-) strand; PAM type: NRG; PAM sequence: CAG
agggctgagacaatggagtg

SEQ ID NO: 8745 - DNA, 20 bp, Artificial Sequence
  Description of Artificial Sequence: Synthetic oligonucleotide
  Target: DMPK; (-) strand; PAM type: NRG; PAM sequence: GAG
tgatcagggctgagacaatg

SEQ ID NO: 8746 - DNA, 20 bp, Artificial Sequence
  Description of Artificial Sequence: Synthetic oligonucleotide
  Target: DMPK; (-) strand; PAM type: NRG; PAM sequence: TGG
agtgatcagggctgagacaa

SEQ ID NO: 8747 - DNA, 20 bp, Artificial Sequence
  Description of Artificial Sequence: Synthetic oligonucleotide
  Target: DMPK; (-) strand; PAM type: NRG; PAM sequence: GAG
gccccagagtgatcagggct

SEQ ID NO: 8748 - DNA, 20 bp, Artificial Sequence
  Description of Artificial Sequence: Synthetic oligonucleotide
  Target: DMPK; (-) strand; PAM type: NRG; PAM sequence: GGG
gtaaggccccagagtgatca

SEQ ID NO: 8749 - DNA, 20 bp, Artificial Sequence
  Description of Artificial Sequence: Synthetic oligonucleotide
  Target: DMPK; (-) strand; PAM type: NRG; PAM sequence: AGG
agtaaggccccagagtgatc

SEQ ID NO: 8750 - DNA, 20 bp, Artificial Sequence
  Description of Artificial Sequence: Synthetic oligonucleotide
  Target: DMPK; (-) strand; PAM type: NRG; PAM sequence: CAG
cagtaaggccccagagtgat

SEQ ID NO: 8751 - DNA, 20 bp, Artificial Sequence
  Description of Artificial Sequence: Synthetic oligonucleotide
  Target: DMPK; (-) strand; PAM type: NRG; PAM sequence: GAG
cttcagacagtaaggcccca

SEQ ID NO: 8752 - DNA, 20 bp, Artificial Sequence
  Description of Artificial Sequence: Synthetic oligonucleotide
  Target: DMPK; (-) strand; PAM type: NRG; PAM sequence: CAG
gtcttcagacagtaaggccc

SEQ ID NO: 8753 - DNA, 20 bp, Artificial Sequence
  Description of Artificial Sequence: Synthetic oligonucleotide
  Target: DMPK; (-) strand; PAM type: NRG; PAM sequence: AGG
agagcagtcttcagacagta

SEQ ID NO: 8754 - DNA, 20 bp, Artificial Sequence
  Description of Artificial Sequence: Synthetic oligonucleotide
  Target: DMPK; (-) strand; PAM type: NRG; PAM sequence: AAG
cagagcagtcttcagacagt

SEQ ID NO: 8755 - DNA, 20 bp, Artificial Sequence
  Description of Artificial Sequence: Synthetic oligonucleotide
  Target: DMPK; (-) strand; PAM type: NRG; PAM sequence: CAG
aacacagagcagtcttcaga

SEQ ID NO: 8756 - DNA, 20 bp, Artificial Sequence
  Description of Artificial Sequence: Synthetic oligonucleotide
  Target: DMPK; (-) strand; PAM type: NRG; PAM sequence: CAG
ggggaacacagagcagtctt

SEQ ID NO: 8757 - DNA, 20 bp, Artificial Sequence
  Description of Artificial Sequence: Synthetic oligonucleotide
  Target: DMPK; (-) strand; PAM type: NRG; PAM sequence: CAG
tccagtgggggaacacagag

SEQ ID NO: 8758 - DNA, 20 bp, Artificial Sequence
  Description of Artificial Sequence: Synthetic oligonucleotide
  Target: DMPK; (-) strand; PAM type: NRG; PAM sequence: GAG
cagtccagtgggggaacaca

SEQ ID NO: 8759 - DNA, 20 bp, Artificial Sequence
  Description of Artificial Sequence: Synthetic oligonucleotide
  Target: DMPK; (-) strand; PAM type: NRG; PAM sequence: CAG
tacagtccagtgggggaaca

SEQ ID NO: 8760 - DNA, 20 bp, Artificial Sequence
  Description of Artificial Sequence: Synthetic oligonucleotide
  Target: DMPK; (-) strand; PAM type: NRG; PAM sequence: GGG
ctagacttacagtccagtgg

SEQ ID NO: 8761 - DNA, 20 bp, Artificial Sequence
  Description of Artificial Sequence: Synthetic oligonucleotide
  Target: DMPK; (-) strand; PAM type: NRG; PAM sequence: GGG
cctagacttacagtccagtg

SEQ ID NO: 8762 - DNA, 20 bp, Artificial Sequence
  Description of Artificial Sequence: Synthetic oligonucleotide
  Target: DMPK; (-) strand; PAM type: NRG; PAM sequence: GGG
acctagacttacagtccagt

SEQ ID NO: 8763 - DNA, 20 bp, Artificial Sequence
  Description of Artificial Sequence: Synthetic oligonucleotide
  Target: DMPK; (-) strand; PAM type: NRG; PAM sequence: TGG
gacctagacttacagtccag

SEQ ID NO: 8764 - DNA, 20 bp, Artificial Sequence
  Description of Artificial Sequence: Synthetic oligonucleotide
  Target: DMPK; (-) strand; PAM type: NRG; PAM sequence: CAG
agtgacctagacttacagtc

SEQ ID NO: 8765 - DNA, 20 bp, Artificial Sequence
  Description of Artificial Sequence: Synthetic oligonucleotide
  Target: DMPK; (-) strand; PAM type: NRG; PAM sequence: CAG
ccagcagtgacctagactta

SEQ ID NO: 8766 - DNA, 20 bp, Artificial Sequence
  Description of Artificial Sequence: Synthetic oligonucleotide
  Target: DMPK; (-) strand; PAM type: NRG; PAM sequence: TAG
ctgaggacccagcagtgacc

SEQ ID NO: 8767 - DNA, 20 bp, Artificial Sequence
  Description of Artificial Sequence: Synthetic oligonucleotide
  Target: DMPK; (-) strand; PAM type: NRG; PAM sequence: CAG
atctactactgaggacccag

SEQ ID NO: 8768 - DNA, 20 bp, Artificial Sequence
  Description of Artificial Sequence: Synthetic oligonucleotide
  Target: DMPK; (-) strand; PAM type: NRG; PAM sequence: CAG
cccatctactactgaggacc

SEQ ID NO: 8769 - DNA, 20 bp, Artificial Sequence
  Description of Artificial Sequence: Synthetic oligonucleotide
  Target: DMPK; (-) strand; PAM type: NRG; PAM sequence: AGG
tctgtgcccatctactactg

SEQ ID NO: 8770 - DNA, 20 bp, Artificial Sequence
  Description of Artificial Sequence: Synthetic oligonucleotide
  Target: DMPK; (-) strand; PAM type: NRG; PAM sequence: GAG
ctctgtgcccatctactact

SEQ ID NO: 8771 - DNA, 20 bp, Artificial Sequence
  Description of Artificial Sequence: Synthetic oligonucleotide
  Target: DMPK; (-) strand; PAM type: NRG; PAM sequence: GAG
cctgaatcactcattcccca

SEQ ID NO: 8772 - DNA, 20 bp, Artificial Sequence
  Description of Artificial Sequence: Synthetic oligonucleotide
  Target: DMPK; (-) strand; PAM type: NRG; PAM sequence: CAG
gtcctgaatcactcattccc

SEQ ID NO: 8773 - DNA, 20 bp, Artificial Sequence
  Description of Artificial Sequence: Synthetic oligonucleotide
  Target: DMPK; (-) strand; PAM type: NRG; PAM sequence: GGG
aggacagtgcctaccttctg

SEQ ID NO: 8774 - DNA, 20 bp, Artificial Sequence
  Description of Artificial Sequence: Synthetic oligonucleotide
  Target: DMPK; (-) strand; PAM type: NRG; PAM sequence: GGG
aaggacagtgcctaccttct

SEQ ID NO: 8775 - DNA, 20 bp, Artificial Sequence
  Description of Artificial Sequence: Synthetic oligonucleotide
  Target: DMPK; (-) strand; PAM type: NRG; PAM sequence: TGG
taaggacagtgcctaccttc

SEQ ID NO: 8776 - DNA, 20 bp, Artificial Sequence
  Description of Artificial Sequence: Synthetic oligonucleotide
  Target: DMPK; (-) strand; PAM type: NRG; PAM sequence: CAG
ccataaagttggagtaagga

SEQ ID NO: 8777 - DNA, 20 bp, Artificial Sequence
  Description of Artificial Sequence: Synthetic oligonucleotide
  Target: DMPK; (-) strand; PAM type: NRG; PAM sequence: AGG
ccctccataaagttggagta

SEQ ID NO: 8778 - DNA, 20 bp, Artificial Sequence
  Description of Artificial Sequence: Synthetic oligonucleotide
  Target: DMPK; (-) strand; PAM type: NRG; PAM sequence: AAG
tccctccataaagttggagt

SEQ ID NO: 8779 - DNA, 20 bp, Artificial Sequence
  Description of Artificial Sequence: Synthetic oligonucleotide
  Target: DMPK; (-) strand; PAM type: NRG; PAM sequence: GAG
atgctccctccataaagttg

SEQ ID NO: 8780 - DNA, 20 bp, Artificial Sequence
  Description of Artificial Sequence: Synthetic oligonucleotide
  Target: DMPK; (-) strand; PAM type: NRG; PAM sequence: TGG
ccatgctccctccataaagt

SEQ ID NO: 8781 - DNA, 20 bp, Artificial Sequence
  Description of Artificial Sequence: Synthetic oligonucleotide
  Target: DMPK; (-) strand; PAM type: NRG; PAM sequence: AAG
ctccccatgctccctccata

SEQ ID NO: 8782 - DNA, 20 bp, Artificial Sequence
  Description of Artificial Sequence: Synthetic oligonucleotide
  Target: DMPK; (-) strand; PAM type: NRG; PAM sequence: GGG
tgtggcccctgctcggctgc

SEQ ID NO: 8783 - DNA, 20 bp, Artificial Sequence
  Description of Artificial Sequence: Synthetic oligonucleotide
  Target: DMPK; (-) strand; PAM type: NRG; PAM sequence: CGG
ctgtggcccctgctcggctg

SEQ ID NO: 8784 - DNA, 20 bp, Artificial Sequence
  Description of Artificial Sequence: Synthetic oligonucleotide
  Target: DMPK; (-) strand; PAM type: NRG; PAM sequence: CGG
aggtacctgtggcccctgct

SEQ ID NO: 8785 - DNA, 20 bp, Artificial Sequence
  Description of Artificial Sequence: Synthetic oligonucleotide
  Target: DMPK; (-) strand; PAM type: NRG; PAM sequence: TGG
gggggcggggtaggtacctg

SEQ ID NO: 8786 - DNA, 20 bp, Artificial Sequence
  Description of Artificial Sequence: Synthetic oligonucleotide
  Target: DMPK; (-) strand; PAM type: NRG; PAM sequence: AGG
atggtgagcgggggcggggt

SEQ ID NO: 8787 - DNA, 20 bp, Artificial Sequence
  Description of Artificial Sequence: Synthetic oligonucleotide
  Target: DMPK; (-) strand; PAM type: NRG; PAM sequence: TAG
catggtgagcgggggcgggg

SEQ ID NO: 8788 - DNA, 20 bp, Artificial Sequence
  Description of Artificial Sequence: Synthetic oligonucleotide
  Target: DMPK; (-) strand; PAM type: NRG; PAM sequence: GGG
tgccatggtgagcgggggcg

SEQ ID NO: 8789 - DNA, 20 bp, Artificial Sequence
  Description of Artificial Sequence: Synthetic oligonucleotide
  Target: DMPK; (-) strand; PAM type: NRG; PAM sequence: GGG
ctgccatggtgagcgggggc

SEQ ID NO: 8790 - DNA, 20 bp, Artificial Sequence
  Description of Artificial Sequence: Synthetic oligonucleotide
  Target: DMPK; (-) strand; PAM type: NRG; PAM sequence: CGG
actgccatggtgagcggggg

SEQ ID NO: 8791 - DNA, 20 bp, Artificial Sequence
  Description of Artificial Sequence: Synthetic oligonucleotide
  Target: DMPK; (-) strand; PAM type: NRG; PAM sequence: GGG
ctcactgccatggtgagcgg

SEQ ID NO: 8792 - DNA, 20 bp, Artificial Sequence
  Description of Artificial Sequence: Synthetic oligonucleotide
  Target: DMPK; (-) strand; PAM type: NRG; PAM sequence: GGG
gctcactgccatggtgagcg

SEQ ID NO: 8793 - DNA, 20 bp, Artificial Sequence
  Description of Artificial Sequence: Synthetic oligonucleotide
  Target: DMPK; (-) strand; PAM type: NRG; PAM sequence: GGG
ggctcactgccatggtgagc

SEQ ID NO: 8794 - DNA, 20 bp, Artificial Sequence
  Description of Artificial Sequence: Synthetic oligonucleotide
  Target: DMPK; (-) strand; PAM type: NRG; PAM sequence: CGG
gggctcactgccatggtgag

SEQ ID NO: 8795 - DNA, 20 bp, Artificial Sequence
  Description of Artificial Sequence: Synthetic oligonucleotide
  Target: DMPK; (-) strand; PAM type: NRG; PAM sequence: GAG
gacgggctcactgccatggt

SEQ ID NO: 8796 - DNA, 20 bp, Artificial Sequence
  Description of Artificial Sequence: Synthetic oligonucleotide
  Target: DMPK; (-) strand; PAM type: NRG; PAM sequence: TGG
ggaggacgggctcactgcca

SEQ ID NO: 8797 - DNA, 20 bp, Artificial Sequence
  Description of Artificial Sequence: Synthetic oligonucleotide
  Target: DMPK; (-) strand; PAM type: NRG; PAM sequence: GGG
acttcgacttggtggaggac

SEQ ID NO: 8798 - DNA, 20 bp, Artificial Sequence
  Description of Artificial Sequence: Synthetic oligonucleotide
  Target: DMPK; (-) strand; PAM type: NRG; PAM sequence: CGG
aacttcgacttggtggagga

SEQ ID NO: 8799 - DNA, 20 bp, Artificial Sequence
  Description of Artificial Sequence: Synthetic oligonucleotide
  Target: DMPK; (-) strand; PAM type: NRG; PAM sequence: AGG
atgcaacttcgacttggtgg

SEQ ID NO: 8800 - DNA, 20 bp, Artificial Sequence
  Description of Artificial Sequence: Synthetic oligonucleotide
  Target: DMPK; (-) strand; PAM type: NRG; PAM sequence: GAG
catgcaacttcgacttggtg

SEQ ID NO: 8801 - DNA, 20 bp, Artificial Sequence
  Description of Artificial Sequence: Synthetic oligonucleotide
  Target: DMPK; (-) strand; PAM type: NRG; PAM sequence: TGG
cacatgcaacttcgacttgg

SEQ ID NO: 8802 - DNA, 20 bp, Artificial Sequence
  Description of Artificial Sequence: Synthetic oligonucleotide
  Target: DMPK; (-) strand; PAM type: NRG; PAM sequence: TGG
cgacacatgcaacttcgact

SEQ ID NO: 8803 - DNA, 20 bp, Artificial Sequence
  Description of Artificial Sequence: Synthetic oligonucleotide
  Target: DMPK; (-) strand; PAM type: NRG; PAM sequence: AGG
ccctttacaccggatttcga

SEQ ID NO: 8804 - DNA, 20 bp, Artificial Sequence
  Description of Artificial Sequence: Synthetic oligonucleotide
  Target: DMPK; (-) strand; PAM type: NRG; PAM sequence: AAG
cccctttacaccggatttcg

SEQ ID NO: 8805 - DNA, 20 bp, Artificial Sequence
  Description of Artificial Sequence: Synthetic oligonucleotide
  Target: DMPK; (-) strand; PAM type: NRG; PAM sequence: CGG
cagcgtgcccccctttacac

SEQ ID NO: 8806 - DNA, 20 bp, Artificial Sequence
  Description of Artificial Sequence: Synthetic oligonucleotide
  Target: DMPK; (-) strand; PAM type: NRG; PAM sequence: CAG
gactgggatggtctccggga

SEQ ID NO: 8807 - DNA, 20 bp, Artificial Sequence
  Description of Artificial Sequence: Synthetic oligonucleotide
  Target: DMPK; (-) strand; PAM type: NRG; PAM sequence: GGG
cctcgactgggatggtctcc

SEQ ID NO: 8808 - DNA, 20 bp, Artificial Sequence
  Description of Artificial Sequence: Synthetic oligonucleotide
  Target: DMPK; (-) strand; PAM type: NRG; PAM sequence: CGG
gcctcgactgggatggtctc

SEQ ID NO: 8809 - DNA, 20 bp, Artificial Sequence
  Description of Artificial Sequence: Synthetic oligonucleotide
  Target: DMPK; (-) strand; PAM type: NRG; PAM sequence: TGG
ttctttggcctcgactggga

SEQ ID NO: 8810 - DNA, 20 bp, Artificial Sequence
  Description of Artificial Sequence: Synthetic oligonucleotide
  Target: DMPK; (-) strand; PAM type: NRG; PAM sequence: GGG
cttcttctttggcctcgact

SEQ ID NO: 8811 - DNA, 20 bp, Artificial Sequence
  Description of Artificial Sequence: Synthetic oligonucleotide
  Target: DMPK; (-) strand; PAM type: NRG; PAM sequence: TGG
ccttcttctttggcctcgac

SEQ ID NO: 8812 - DNA, 20 bp, Artificial Sequence
  Description of Artificial Sequence: Synthetic oligonucleotide
  Target: DMPK; (-) strand; PAM type: NRG; PAM sequence: TGG
cggacacatcccttcttctt

SEQ ID NO: 8813 - DNA, 20 bp, Artificial Sequence
  Description of Artificial Sequence: Synthetic oligonucleotide
  Target: DMPK; (-) strand; PAM type: NRG; PAM sequence: CGG
ggggtggagcaggcgacttc

SEQ ID NO: 8814 - DNA, 20 bp, Artificial Sequence
  Description of Artificial Sequence: Synthetic oligonucleotide
  Target: DMPK; (-) strand; PAM type: NRG; PAM sequence: AGG
cggctgggccggggtggagc

SEQ ID NO: 8815 - DNA, 20 bp, Artificial Sequence
  Description of Artificial Sequence: Synthetic oligonucleotide
  Target: DMPK; (-) strand; PAM type: NRG; PAM sequence: CAG
acggctgggccggggtggag

SEQ ID NO: 8816 - DNA, 20 bp, Artificial Sequence
  Description of Artificial Sequence: Synthetic oligonucleotide
  Target: DMPK; (-) strand; PAM type: NRG; PAM sequence: GAG
gacacggctgggccggggtg

SEQ ID NO: 8817 - DNA, 20 bp, Artificial Sequence
  Description of Artificial Sequence: Synthetic oligonucleotide
  Target: DMPK; (-) strand; PAM type: NRG; PAM sequence: TGG
gagacacggctgggccgggg

SEQ ID NO: 8818 - DNA, 20 bp, Artificial Sequence
  Description of Artificial Sequence: Synthetic oligonucleotide
  Target: DMPK; (-) strand; PAM type: NRG; PAM sequence: GGG
ccggagacacggctgggccg

SEQ ID NO: 8819 - DNA, 20 bp, Artificial Sequence
  Description of Artificial Sequence: Synthetic oligonucleotide
  Target: DMPK; (-) strand; PAM type: NRG; PAM sequence: GGG
cccggagacacggctgggcc

SEQ ID NO: 8820 - DNA, 20 bp, Artificial Sequence
  Description of Artificial Sequence: Synthetic oligonucleotide
  Target: DMPK; (-) strand; PAM type: NRG; PAM sequence: CGG
ccccggagacacggctgggc

SEQ ID NO: 8821 - DNA, 20 bp, Artificial Sequence
  Description of Artificial Sequence: Synthetic oligonucleotide
  Target: DMPK; (-) strand; PAM type: NRG; PAM sequence: GGG
tgtcccccggagacacggct

SEQ ID NO: 8822 - DNA, 20 bp, Artificial Sequence
  Description of Artificial Sequence: Synthetic oligonucleotide
  Target: DMPK; (-) strand; PAM type: NRG; PAM sequence: TGG
gtgtcccccggagacacggc

SEQ ID NO: 8823 - DNA, 20 bp, Artificial Sequence
  Description of Artificial Sequence: Synthetic oligonucleotide
  Target: DMPK; (-) strand; PAM type: NRG; PAM sequence: CGG
tgctgtgtcccccggagaca

SEQ ID NO: 8824 - DNA, 20 bp, Artificial Sequence
  Description of Artificial Sequence: Synthetic oligonucleotide
  Target: DMPK; (-) strand; PAM type: NRG; PAM sequence: GAG
agcggttgctgtgtcccccg

SEQ ID NO: 8825 - DNA, 20 bp, Artificial Sequence
  Description of Artificial Sequence: Synthetic oligonucleotide
  Target: DMPK; (-) strand; PAM type: NRG; PAM sequence: CGG
tcagcggttgctgtgtcccc

SEQ ID NO: 8826 - DNA, 20 bp, Artificial Sequence
  Description of Artificial Sequence: Synthetic oligonucleotide
  Target: DMPK; (-) strand; PAM type: NRG; PAM sequence: CGG
aggctcgagacttcattcag

SEQ ID NO: 8827 - DNA, 20 bp, Artificial Sequence
  Description of Artificial Sequence: Synthetic oligonucleotide
  Target: DMPK; (-) strand; PAM type: NRG; PAM sequence: CAG
aggaggctcgagacttcatt

SEQ ID NO: 8828 - DNA, 20 bp, Artificial Sequence
  Description of Artificial Sequence: Synthetic oligonucleotide
  Target: DMPK; (-) strand; PAM type: NRG; PAM sequence: GAG
aggggtccctgaggaggctc

SEQ ID NO: 8829 - DNA, 20 bp, Artificial Sequence
  Description of Artificial Sequence: Synthetic oligonucleotide
  Target: DMPK; (-) strand; PAM type: NRG; PAM sequence: AGG
ggacgaaggggtccctgagg

SEQ ID NO: 8830 - DNA, 20 bp, Artificial Sequence
  Description of Artificial Sequence: Synthetic oligonucleotide
  Target: DMPK; (-) strand; PAM type: NRG; PAM sequence: GAG
tggacgaaggggtccctgag

SEQ ID NO: 8831 - DNA, 20 bp, Artificial Sequence
  Description of Artificial Sequence: Synthetic oligonucleotide
  Target: DMPK; (-) strand; PAM type: NRG; PAM sequence: AGG
ggtggacgaaggggtccctg

SEQ ID NO: 8832 - DNA, 20 bp, Artificial Sequence
  Description of Artificial Sequence: Synthetic oligonucleotide
  Target: DMPK; (-) strand; PAM type: NRG; PAM sequence: GAG
tggtggacgaaggggtccct

SEQ ID NO: 8833 - DNA, 20 bp, Artificial Sequence
  Description of Artificial Sequence: Synthetic oligonucleotide
  Target: DMPK; (-) strand; PAM type: NRG; PAM sequence: GGG
tctgccgctggtggacgaag

SEQ ID NO: 8834 - DNA, 20 bp, Artificial Sequence
  Description of Artificial Sequence: Synthetic oligonucleotide
  Target: DMPK; (-) strand; PAM type: NRG; PAM sequence: GGG
ctctgccgctggtggacgaa

SEQ ID NO: 8835 - DNA, 20 bp, Artificial Sequence
  Description of Artificial Sequence: Synthetic oligonucleotide
  Target: DMPK; (-) strand; PAM type: NRG; PAM sequence: AGG
tctctgccgctggtggacga

SEQ ID NO: 8836 - DNA, 20 bp, Artificial Sequence
  Description of Artificial Sequence: Synthetic oligonucleotide
  Target: DMPK; (-) strand; PAM type: NRG; PAM sequence: AAG
ctctctgccgctggtggacg

SEQ ID NO: 8837 - DNA, 20 bp, Artificial Sequence
  Description of Artificial Sequence: Synthetic oligonucleotide
  Target: DMPK; (-) strand; PAM type: NRG; PAM sequence: TGG
gcacctctctctgccgctgg

SEQ ID NO: 8838 - DNA, 20 bp, Artificial Sequence
  Description of Artificial Sequence: Synthetic oligonucleotide
  Target: DMPK; (-) strand; PAM type: NRG; PAM sequence: TGG
ggagcacctctctctgccgc

SEQ ID NO: 8839 - DNA, 20 bp, Artificial Sequence
  Description of Artificial Sequence: Synthetic oligonucleotide
  Target: DMPK; (-) strand; PAM type: NRG; PAM sequence: GAG
cctcctctccctctgagcag

SEQ ID NO: 8840 - DNA, 20 bp, Artificial Sequence
  Description of Artificial Sequence: Synthetic oligonucleotide
  Target: DMPK; (-) strand; PAM type: NRG; PAM sequence: AGG
cgcctcctctccctctgagc

SEQ ID NO: 8841 - DNA, 20 bp, Artificial Sequence
  Description of Artificial Sequence: Synthetic oligonucleotide
  Target: DMPK; (-) strand; PAM type: NRG; PAM sequence: CAG
tcgcctcctctccctctgag

SEQ ID NO: 8842 - DNA, 20 bp, Artificial Sequence
  Description of Artificial Sequence: Synthetic oligonucleotide
  Target: DMPK; (-) strand; PAM type: NRG; PAM sequence: GAG
ctatcgcctcctctccctct

SEQ ID NO: 8843 - DNA, 20 bp, Artificial Sequence
  Description of Artificial Sequence: Synthetic oligonucleotide
  Target: DMPK; (-) strand; PAM type: NRG; PAM sequence: AGG
ctctcccggtaggcgctccc

SEQ ID NO: 8844 - DNA, 20 bp, Artificial Sequence
  Description of Artificial Sequence: Synthetic oligonucleotide
  Target: DMPK; (-) strand; PAM type: NRG; PAM sequence: CAG
cctctcccggtaggcgctcc

SEQ ID NO: 8845 - DNA, 20 bp, Artificial Sequence
  Description of Artificial Sequence: Synthetic oligonucleotide
  Target: DMPK; (-) strand; PAM type: NRG; PAM sequence: AGG
gagacctggcctctcccggt

SEQ ID NO: 8846 - DNA, 20 bp, Artificial Sequence
  Description of Artificial Sequence: Synthetic oligonucleotide
  Target: DMPK; (-) strand; PAM type: NRG; PAM sequence: TAG
ggagacctggcctctcccgg

SEQ ID NO: 8847 - DNA, 20 bp, Artificial Sequence
  Description of Artificial Sequence: Synthetic oligonucleotide
  Target: DMPK; (-) strand; PAM type: NRG; PAM sequence: CGG
cagggagacctggcctctcc

SEQ ID NO: 8848 - DNA, 20 bp, Artificial Sequence
  Description of Artificial Sequence: Synthetic oligonucleotide
  Target: DMPK; (-) strand; PAM type: NRG; PAM sequence: TGG
agcacggccgcagggagacc

SEQ ID NO: 8849 - DNA, 20 bp, Artificial Sequence
  Description of Artificial Sequence: Synthetic oligonucleotide
  Target: DMPK; (-) strand; PAM type: NRG; PAM sequence: GAG
aaggtgagcacggccgcagg

SEQ ID NO: 8850 - DNA, 20 bp, Artificial Sequence
  Description of Artificial Sequence: Synthetic oligonucleotide
  Target: DMPK; (-) strand; PAM type: NRG; PAM sequence: GGG
acaaggtgagcacggccgca

SEQ ID NO: 8851 - DNA, 20 bp, Artificial Sequence
  Description of Artificial Sequence: Synthetic oligonucleotide
  Target: DMPK; (-) strand; PAM type: NRG; PAM sequence: AGG
tacaaggtgagcacggccgc

SEQ ID NO: 8852 - DNA, 20 bp, Artificial Sequence
  Description of Artificial Sequence: Synthetic oligonucleotide
  Target: DMPK; (-) strand; PAM type: NRG; PAM sequence: CAG
ctacaaggtgagcacggccg

SEQ ID NO: 8853 - DNA, 20 bp, Artificial Sequence
  Description of Artificial Sequence: Synthetic oligonucleotide
  Target: DMPK; (-) strand; PAM type: NRG; PAM sequence: CGG
cgtccactacaaggtgagca

SEQ ID NO: 8854 - DNA, 20 bp, Artificial Sequence
  Description of Artificial Sequence: Synthetic oligonucleotide
  Target: DMPK; (-) strand; PAM type: NRG; PAM sequence: GAG
aagatcgtccactacaaggt

SEQ ID NO: 8855 - DNA, 20 bp, Artificial Sequence
  Description of Artificial Sequence: Synthetic oligonucleotide
  Target: DMPK; (-) strand; PAM type: NRG; PAM sequence: AGG
tggcaagatcgtccactaca

SEQ ID NO: 8856 - DNA, 20 bp, Artificial Sequence
  Description of Artificial Sequence: Synthetic oligonucleotide
  Target: DMPK; (-) strand; PAM type: NRG; PAM sequence: AAG
atggcaagatcgtccactac

SEQ ID NO: 8857 - DNA, 20 bp, Artificial Sequence
  Description of Artificial Sequence: Synthetic oligonucleotide
  Target: DMPK; (-) strand; PAM type: NRG; PAM sequence: AAG
ccacggcggagacctatggc

SEQ ID NO: 8858 - DNA, 20 bp, Artificial Sequence
  Description of Artificial Sequence: Synthetic oligonucleotide
  Target: DMPK; (-) strand; PAM type: NRG; PAM sequence: TGG
gattccacggcggagaccta

SEQ ID NO: 8859 - DNA, 20 bp, Artificial Sequence
  Description of Artificial Sequence: Synthetic oligonucleotide
  Target: DMPK; (-) strand; PAM type: NRG; PAM sequence: GAG
tctacgcggattccacggcg

SEQ ID NO: 8860 - DNA, 20 bp, Artificial Sequence
  Description of Artificial Sequence: Synthetic oligonucleotide
  Target: DMPK; (-) strand; PAM type: NRG; PAM sequence: CGG
cttctacgcggattccacgg

SEQ ID NO: 8861 - DNA, 20 bp, Artificial Sequence
  Description of Artificial Sequence: Synthetic oligonucleotide
  Target: DMPK; (-) strand; PAM type: NRG; PAM sequence: CGG
gcccttctacgcggattcca

SEQ ID NO: 8862 - DNA, 20 bp, Artificial Sequence
  Description of Artificial Sequence: Synthetic oligonucleotide
  Target: DMPK; (-) strand; PAM type: NRG; PAM sequence: CGG
tgggcagacgcccttctacg

SEQ ID NO: 8863 - DNA, 20 bp, Artificial Sequence
  Description of Artificial Sequence: Synthetic oligonucleotide
  Target: DMPK; (-) strand; PAM type: NRG; PAM sequence: CAG
cctatgaaatgttctatggg

SEQ ID NO: 8864 - DNA, 20 bp, Artificial Sequence
  Description of Artificial Sequence: Synthetic oligonucleotide
  Target: DMPK; (-) strand; PAM type: NRG; PAM sequence: GGG
tcgcctatgaaatgttctat

SEQ ID NO: 8865 - DNA, 20 bp, Artificial Sequence
  Description of Artificial Sequence: Synthetic oligonucleotide
  Target: DMPK; (-) strand; PAM type: NRG; PAM sequence: TGG
ttcgcctatgaaatgttcta

SEQ ID NO: 8866 - DNA, 20 bp, Artificial Sequence
  Description of Artificial Sequence: Synthetic oligonucleotide
  Target: DMPK; (-) strand; PAM type: NRG; PAM sequence: GGG
gagtgtgactggtgggcgct

SEQ ID NO: 8867 - DNA, 20 bp, Artificial Sequence
  Description of Artificial Sequence: Synthetic oligonucleotide
  Target: DMPK; (-) strand; PAM type: NRG; PAM sequence: TGG
cgagtgtgactggtgggcgc

SEQ ID NO: 8868 - DNA, 20 bp, Artificial Sequence
  Description of Artificial Sequence: Synthetic oligonucleotide
  Target: DMPK; (-) strand; PAM type: NRG; PAM sequence: GGG
cgggcccgagtgtgactggt

SEQ ID NO: 8869 - DNA, 20 bp, Artificial Sequence
  Description of Artificial Sequence: Synthetic oligonucleotide
  Target: DMPK; (-) strand; PAM type: NRG; PAM sequence: TGG
acgggcccgagtgtgactgg

SEQ ID NO: 8870 - DNA, 20 bp, Artificial Sequence
  Description of Artificial Sequence: Synthetic oligonucleotide
  Target: DMPK; (-) strand; PAM type: NRG; PAM sequence: TGG
gctacgggcccgagtgtgac

SEQ ID NO: 8871 - DNA, 20 bp, Artificial Sequence
  Description of Artificial Sequence: Synthetic oligonucleotide
  Target: DMPK; (-) strand; PAM type: NRG; PAM sequence: GAG
ggacaggcagctacgggccc

SEQ ID NO: 8872 - DNA, 20 bp, Artificial Sequence
  Description of Artificial Sequence: Synthetic oligonucleotide
  Target: DMPK; (-) strand; PAM type: NRG; PAM sequence: GGG
ggcctgggacaggcagctac

SEQ ID NO: 8873 - DNA, 20 bp, Artificial Sequence
  Description of Artificial Sequence: Synthetic oligonucleotide
  Target: DMPK; (-) strand; PAM type: NRG; PAM sequence: CGG
gggcctgggacaggcagcta

SEQ ID NO: 8874 - DNA, 20 bp, Artificial Sequence
  Description of Artificial Sequence: Synthetic oligonucleotide
  Target: DMPK; (-) strand; PAM type: NRG; PAM sequence: CAG
ggcggtgggcctgggacagg

SEQ ID NO: 8875 - DNA, 20 bp, Artificial Sequence
  Description of Artificial Sequence: Synthetic oligonucleotide
  Target: DMPK; (-) strand; PAM type: NRG; PAM sequence: AGG
gtgggcggtgggcctgggac

SEQ ID NO: 8876 - DNA, 20 bp, Artificial Sequence
  Description of Artificial Sequence: Synthetic oligonucleotide
  Target: DMPK; (-) strand; PAM type: NRG; PAM sequence: CAG
tgtgggcggtgggcctggga

SEQ ID NO: 8877 - DNA, 20 bp, Artificial Sequence
  Description of Artificial Sequence: Synthetic oligonucleotide
  Target: DMPK; (-) strand; PAM type: NRG; PAM sequence: GGG
aggctgtgggcggtgggcct

SEQ ID NO: 8878 - DNA, 20 bp, Artificial Sequence
  Description of Artificial Sequence: Synthetic oligonucleotide
  Target: DMPK; (-) strand; PAM type: NRG; PAM sequence: TGG
caggctgtgggcggtgggcc

SEQ ID NO: 8879 - DNA, 20 bp, Artificial Sequence
  Description of Artificial Sequence: Synthetic oligonucleotide
  Target: DMPK; (-) strand; PAM type: NRG; PAM sequence: GGG
tcctgcaggctgtgggcggt

SEQ ID NO: 8880 - DNA, 20 bp, Artificial Sequence
  Description of Artificial Sequence: Synthetic oligonucleotide
  Target: DMPK; (-) strand; PAM type: NRG; PAM sequence: TGG
atcctgcaggctgtgggcgg

SEQ ID NO: 8881 - DNA, 20 bp, Artificial Sequence
  Description of Artificial Sequence: Synthetic oligonucleotide
  Target: DMPK; (-) strand; PAM type: NRG; PAM sequence: CGG
gagatcctgcaggctgtggg

SEQ ID NO: 8882 - DNA, 20 bp, Artificial Sequence
  Description of Artificial Sequence: Synthetic oligonucleotide
  Target: DMPK; (-) strand; PAM type: NRG; PAM sequence: GGG
cccgagatcctgcaggctgt

SEQ ID NO: 8883 - DNA, 20 bp, Artificial Sequence
  Description of Artificial Sequence: Synthetic oligonucleotide
  Target: DMPK; (-) strand; PAM type: NRG; PAM sequence: TGG
ccccgagatcctgcaggctg

SEQ ID NO: 8884 - DNA, 20 bp, Artificial Sequence
  Description of Artificial Sequence: Synthetic oligonucleotide
  Target: DMPK; (-) strand; PAM type: NRG; PAM sequence: AGG
cctgtcccccgagatcctgc

SEQ ID NO: 8885 - DNA, 20 bp, Artificial Sequence
  Description of Artificial Sequence: Synthetic oligonucleotide
  Target: DMPK; (-) strand; PAM type: NRG; PAM sequence: CAG
acctgtcccccgagatcctg

SEQ ID NO: 8886 - DNA, 20 bp, Artificial Sequence
  Description of Artificial Sequence: Synthetic oligonucleotide
  Target: DMPK; (-) strand; PAM type: NRG; PAM sequence: GAG
ccccagactacctgtccccc

SEQ ID NO: 8887 - DNA, 20 bp, Artificial Sequence
  Description of Artificial Sequence: Synthetic oligonucleotide
  Target: DMPK; (-) strand; PAM type: NRG; PAM sequence: CAG
gctggtggctgtgggcaccc

SEQ ID NO: 8888 - DNA, 20 bp, Artificial Sequence
  Description of Artificial Sequence: Synthetic oligonucleotide
  Target: DMPK; (-) strand; PAM type: NRG; PAM sequence: GGG
gtgcggtcgctggtggctgt

SEQ ID NO: 8889 - DNA, 20 bp, Artificial Sequence
  Description of Artificial Sequence: Synthetic oligonucleotide
  Target: DMPK; (-) strand; PAM type: NRG; PAM sequence: TGG
ggtgcggtcgctggtggctg

SEQ ID NO: 8890 - DNA, 20 bp, Artificial Sequence
  Description of Artificial Sequence: Synthetic oligonucleotide
  Target: DMPK; (-) strand; PAM type: NRG; PAM sequence: TGG
ggtccaggtgcggtcgctgg

SEQ ID NO: 8891 - DNA, 20 bp, Artificial Sequence
  Description of Artificial Sequence: Synthetic oligonucleotide
  Target: DMPK; (-) strand; PAM type: NRG; PAM sequence: TGG
tttggtccaggtgcggtcgc

SEQ ID NO: 8892 - DNA, 20 bp, Artificial Sequence
  Description of Artificial Sequence: Synthetic oligonucleotide
  Target: DMPK; (-) strand; PAM type: NRG; PAM sequence: CGG
tgctccttttggtccaggtg

SEQ ID NO: 8893 - DNA, 20 bp, Artificial Sequence
  Description of Artificial Sequence: Synthetic oligonucleotide
  Target: DMPK; (-) strand; PAM type: NRG; PAM sequence: AGG
cgctctgctccttttggtcc

SEQ ID NO: 8894 - DNA, 20 bp, Artificial Sequence
  Description of Artificial Sequence: Synthetic oligonucleotide
  Target: DMPK; (-) strand; PAM type: NRG; PAM sequence: CAG
tcgctctgctccttttggtc

SEQ ID NO: 8895 - DNA, 20 bp, Artificial Sequence
  Description of Artificial Sequence: Synthetic oligonucleotide
  Target: DMPK; (-) strand; PAM type: NRG; PAM sequence: TGG
aagcctcgctctgctccttt

SEQ ID NO: 8896 - DNA, 20 bp, Artificial Sequence
  Description of Artificial Sequence: Synthetic oligonucleotide
  Target: DMPK; (-) strand; PAM type: NRG; PAM sequence: AAG
gggcccagaggggtgggccc

SEQ ID NO: 8897 - DNA, 20 bp, Artificial Sequence
  Description of Artificial Sequence: Synthetic oligonucleotide
  Target: DMPK; (-) strand; PAM type: NRG; PAM sequence: GGG
gctggtgggcccagaggggt

SEQ ID NO: 8898 - DNA, 20 bp, Artificial Sequence
  Description of Artificial Sequence: Synthetic oligonucleotide
  Target: DMPK; (-) strand; PAM type: NRG; PAM sequence: TGG
agctggtgggcccagagggg

SEQ ID NO: 8899 - DNA, 20 bp, Artificial Sequence
  Description of Artificial Sequence: Synthetic oligonucleotide
  Target: DMPK; (-) strand; PAM type: NRG; PAM sequence: GGG
cagagctggtgggcccagag

SEQ ID NO: 8900 - DNA, 20 bp, Artificial Sequence
  Description of Artificial Sequence: Synthetic oligonucleotide
  Target: DMPK; (-) strand; PAM type: NRG; PAM sequence: GGG
ccagagctggtgggcccaga

SEQ ID NO: 8901 - DNA, 20 bp, Artificial Sequence
  Description of Artificial Sequence: Synthetic oligonucleotide
  Target: DMPK; (-) strand; PAM type: NRG; PAM sequence: AGG
cccagagctggtgggcccag

SEQ ID NO: 8902 - DNA, 20 bp, Artificial Sequence
  Description of Artificial Sequence: Synthetic oligonucleotide
  Target: DMPK; (-) strand; PAM type: NRG; PAM sequence: GAG
gcccagagctggtgggccca

SEQ ID NO: 8903 - DNA, 20 bp, Artificial Sequence
  Description of Artificial Sequence: Synthetic oligonucleotide
  Target: DMPK; (-) strand; PAM type: NRG; PAM sequence: CAG
gggcccagagctggtgggcc

SEQ ID NO: 8904 - DNA, 20 bp, Artificial Sequence
  Description of Artificial Sequence: Synthetic oligonucleotide
  Target: DMPK; (-) strand; PAM type: NRG; PAM sequence: GGG
aaggagggcccagagctggt

SEQ ID NO: 8905 - DNA, 20 bp, Artificial Sequence
  Description of Artificial Sequence: Synthetic oligonucleotide
  Target: DMPK; (-) strand; PAM type: NRG; PAM sequence: TGG
gaaggagggcccagagctgg

SEQ ID NO: 8906 - DNA, 20 bp, Artificial Sequence
  Description of Artificial Sequence: Synthetic oligonucleotide
  Target: DMPK; (-) strand; PAM type: NRG; PAM sequence: TGG
ttggaaggagggcccagagc

SEQ ID NO: 8907 - DNA, 20 bp, Artificial Sequence
  Description of Artificial Sequence: Synthetic oligonucleotide
  Target: DMPK; (-) strand; PAM type: NRG; PAM sequence: GAG
gtggttggaaggagggccca

SEQ ID NO: 8908 - DNA, 20 bp, Artificial Sequence
  Description of Artificial Sequence: Synthetic oligonucleotide
  Target: DMPK; (-) strand; PAM type: NRG; PAM sequence: CAG
gagtggttggaaggagggcc

SEQ ID NO: 8909 - DNA, 20 bp, Artificial Sequence
  Description of Artificial Sequence: Synthetic oligonucleotide
  Target: DMPK; (-) strand; PAM type: NRG; PAM sequence: GGG
ttggggagtggttggaagga

SEQ ID NO: 8910 - DNA, 20 bp, Artificial Sequence
  Description of Artificial Sequence: Synthetic oligonucleotide
  Target: DMPK; (-) strand; PAM type: NRG; PAM sequence: AGG
tttggggagtggttggaagg

SEQ ID NO: 8911 - DNA, 20 bp, Artificial Sequence
  Description of Artificial Sequence: Synthetic oligonucleotide
  Target: DMPK; (-) strand; PAM type: NRG; PAM sequence: GAG
atttggggagtggttggaag

SEQ ID NO: 8912 - DNA, 20 bp, Artificial Sequence
  Description of Artificial Sequence: Synthetic oligonucleotide
  Target: DMPK; (-) strand; PAM type: NRG; PAM sequence: AGG
gcatttggggagtggttgga

SEQ ID NO: 8913 - DNA, 20 bp, Artificial Sequence
  Description of Artificial Sequence: Synthetic oligonucleotide
  Target: DMPK; (-) strand; PAM type: NRG; PAM sequence: AAG
agcatttggggagtggttgg

SEQ ID NO: 8914 - DNA, 20 bp, Artificial Sequence
  Description of Artificial Sequence: Synthetic oligonucleotide
  Target: DMPK; (-) strand; PAM type: NRG; PAM sequence: TGG
ctaagcatttggggagtggt

SEQ ID NO: 8915 - DNA, 20 bp, Artificial Sequence
  Description of Artificial Sequence: Synthetic oligonucleotide
  Target: DMPK; (-) strand; PAM type: NRG; PAM sequence: TGG
ggggctaagcatttggggag

SEQ ID NO: 8916 - DNA, 20 bp, Artificial Sequence
  Description of Artificial Sequence: Synthetic oligonucleotide
  Target: DMPK; (-) strand; PAM type: NRG; PAM sequence: GAG
ggaggggctaagcatttggg

SEQ ID NO: 8917 - DNA, 20 bp, Artificial Sequence
  Description of Artificial Sequence: Synthetic oligonucleotide
  Target: DMPK; (-) strand; PAM type: NRG; PAM sequence: GGG
agggaggggctaagcatttg

SEQ ID NO: 8918 - DNA, 20 bp, Artificial Sequence
  Description of Artificial Sequence: Synthetic oligonucleotide
  Target: DMPK; (-) strand; PAM type: NRG; PAM sequence: GGG
gagggaggggctaagcattt

SEQ ID NO: 8919 - DNA, 20 bp, Artificial Sequence
  Description of Artificial Sequence: Synthetic oligonucleotide
  Target: DMPK; (-) strand; PAM type: NRG; PAM sequence: TGG
agagggaggggctaagcatt

SEQ ID NO: 8920 - DNA, 20 bp, Artificial Sequence
  Description of Artificial Sequence: Synthetic oligonucleotide
  Target: DMPK; (-) strand; PAM type: NRG; PAM sequence: AAG
accaggcagagggaggggct

SEQ ID NO: 8921 - DNA, 20 bp, Artificial Sequence
  Description of Artificial Sequence: Synthetic oligonucleotide
  Target: DMPK; (-) strand; PAM type: NRG; PAM sequence: GGG
attagaccaggcagagggag

SEQ ID NO: 8922 - DNA, 20 bp, Artificial Sequence
  Description of Artificial Sequence: Synthetic oligonucleotide
  Target: DMPK; (-) strand; PAM type: NRG; PAM sequence: GGG
tattagaccaggcagaggga

SEQ ID NO: 8923 - DNA, 20 bp, Artificial Sequence
  Description of Artificial Sequence: Synthetic oligonucleotide
  Target: DMPK; (-) strand; PAM type: NRG; PAM sequence: AGG
gtattagaccaggcagaggg

SEQ ID NO: 8924 - DNA, 20 bp, Artificial Sequence
  Description of Artificial Sequence: Synthetic oligonucleotide
  Target: DMPK; (-) strand; PAM type: NRG; PAM sequence: GAG
agtattagaccaggcagagg

SEQ ID NO: 8925 - DNA, 20 bp, Artificial Sequence
  Description of Artificial Sequence: Synthetic oligonucleotide
  Target: DMPK; (-) strand; PAM type: NRG; PAM sequence: GGG
ggagtattagaccaggcaga

SEQ ID NO: 8926 - DNA, 20 bp, Artificial Sequence
  Description of Artificial Sequence: Synthetic oligonucleotide
  Target: DMPK; (-) strand; PAM type: NRG; PAM sequence: AGG
cggagtattagaccaggcag

SEQ ID NO: 8927 - DNA, 20 bp, Artificial Sequence
  Description of Artificial Sequence: Synthetic oligonucleotide
  Target: DMPK; (-) strand; PAM type: NRG; PAM sequence: GAG
gcggagtattagaccaggca

SEQ ID NO: 8928 - DNA, 20 bp, Artificial Sequence
  Description of Artificial Sequence: Synthetic oligonucleotide
  Target: DMPK; (-) strand; PAM type: NRG; PAM sequence: CAG
tggcggagtattagaccagg

SEQ ID NO: 8929 - DNA, 20 bp, Artificial Sequence
  Description of Artificial Sequence: Synthetic oligonucleotide
  Target: DMPK; (-) strand; PAM type: NRG; PAM sequence: AGG
gtgtggcggagtattagacc

SEQ ID NO: 8930 - DNA, 20 bp, Artificial Sequence
  Description of Artificial Sequence: Synthetic oligonucleotide
  Target: DMPK; (-) strand; PAM type: NRG; PAM sequence: CAG
tgtgtggcggagtattagac

SEQ ID NO: 8931 - DNA, 20 bp, Artificial Sequence
  Description of Artificial Sequence: Synthetic oligonucleotide
  Target: DMPK; (-) strand; PAM type: NRG; PAM sequence: TAG
gcatctgtgtggcggagtat

SEQ ID NO: 8932 - DNA, 20 bp, Artificial Sequence
  Description of Artificial Sequence: Synthetic oligonucleotide
  Target: DMPK; (-) strand; PAM type: NRG; PAM sequence: GAG
aagtgtgcatctgtgtggcg

SEQ ID NO: 8933 - DNA, 20 bp, Artificial Sequence
  Description of Artificial Sequence: Synthetic oligonucleotide
  Target: DMPK; (-) strand; PAM type: NRG; PAM sequence: CGG
ttaagtgtgcatctgtgtgg

SEQ ID NO: 8934 - DNA, 20 bp, Artificial Sequence
  Description of Artificial Sequence: Synthetic oligonucleotide
  Target: DMPK; (-) strand; PAM type: NRG; PAM sequence: TGG
ggcttaagtgtgcatctgtg

SEQ ID NO: 8935 - DNA, 20 bp, Artificial Sequence
  Description of Artificial Sequence: Synthetic oligonucleotide
  Target: DMPK; (-) strand; PAM type: NRG; PAM sequence: AAG
aggtggtgtgacccaggctt

SEQ ID NO: 8936 - DNA, 20 bp, Artificial Sequence
  Description of Artificial Sequence: Synthetic oligonucleotide
  Target: DMPK; (-) strand; PAM type: NRG; PAM sequence: AGG
gaaaagaggtggtgtgaccc

SEQ ID NO: 8937 - DNA, 20 bp, Artificial Sequence
  Description of Artificial Sequence: Synthetic oligonucleotide
  Target: DMPK; (-) strand; PAM type: NRG; PAM sequence: CAG
ggaaaagaggtggtgtgacc

SEQ ID NO: 8938 - DNA, 20 bp, Artificial Sequence
  Description of Artificial Sequence: Synthetic oligonucleotide
  Target: DMPK; (-) strand; PAM type: NRG; PAM sequence: TGG
gatttggaggggaaaagagg

SEQ ID NO: 8939 - DNA, 20 bp, Artificial Sequence
  Description of Artificial Sequence: Synthetic oligonucleotide
  Target: DMPK; (-) strand; PAM type: NRG; PAM sequence: AGG
ctggatttggaggggaaaag

SEQ ID NO: 8940 - DNA, 20 bp, Artificial Sequence
  Description of Artificial Sequence: Synthetic oligonucleotide
  Target: DMPK; (-) strand; PAM type: NRG; PAM sequence: GAG
actggatttggaggggaaaa

SEQ ID NO: 8941 - DNA, 20 bp, Artificial Sequence
  Description of Artificial Sequence: Synthetic oligonucleotide
  Target: DMPK; (-) strand; PAM type: NRG; PAM sequence: AAG
ggactggatttggaggggaa

SEQ ID NO: 8942 - DNA, 20 bp, Artificial Sequence
  Description of Artificial Sequence: Synthetic oligonucleotide
  Target: DMPK; (-) strand; PAM type: NRG; PAM sequence: GGG
gagcgggactggatttggag

SEQ ID NO: 8943 - DNA, 20 bp, Artificial Sequence
  Description of Artificial Sequence: Synthetic oligonucleotide
  Target: DMPK; (-) strand; PAM type: NRG; PAM sequence: GGG
ggagcgggactggatttgga

SEQ ID NO: 8944 - DNA, 20 bp, Artificial Sequence
  Description of Artificial Sequence: Synthetic oligonucleotide
  Target: DMPK; (-) strand; PAM type: NRG; PAM sequence: AGG
gggagcgggactggatttgg

SEQ ID NO: 8945 - DNA, 20 bp, Artificial Sequence
  Description of Artificial Sequence: Synthetic oligonucleotide
  Target: DMPK; (-) strand; PAM type: NRG; PAM sequence: GAG
tgggagcgggactggatttg

SEQ ID NO: 8946 - DNA, 20 bp, Artificial Sequence
  Description of Artificial Sequence: Synthetic oligonucleotide
  Target: DMPK; (-) strand; PAM type: NRG; PAM sequence: TGG
tgtgggagcgggactggatt

SEQ ID NO: 8947 - DNA, 20 bp, Artificial Sequence
  Description of Artificial Sequence: Synthetic oligonucleotide
  Target: DMPK; (-) strand; PAM type: NRG; PAM sequence: TGG
acagagtgtgggagcgggac

SEQ ID NO: 8948 - DNA, 20 bp, Artificial Sequence
  Description of Artificial Sequence: Synthetic oligonucleotide
  Target: DMPK; (-) strand; PAM type: NRG; PAM sequence: GGG
aaggcacagagtgtgggagc

SEQ ID NO: 8949 - DNA, 20 bp, Artificial Sequence
  Description of Artificial Sequence: Synthetic oligonucleotide
  Target: DMPK; (-) strand; PAM type: NRG; PAM sequence: CGG
gaaggcacagagtgtgggag

SEQ ID NO: 8950 - DNA, 20 bp, Artificial Sequence
  Description of Artificial Sequence: Synthetic oligonucleotide
  Target: DMPK; (-) strand; PAM type: NRG; PAM sequence: GAG
atggaaggcacagagtgtgg

SEQ ID NO: 8951 - DNA, 20 bp, Artificial Sequence
  Description of Artificial Sequence: Synthetic oligonucleotide
  Target: DMPK; (-) strand; PAM type: NRG; PAM sequence: GGG
ggatggaaggcacagagtgt

SEQ ID NO: 8952 - DNA, 20 bp, Artificial Sequence
  Description of Artificial Sequence: Synthetic oligonucleotide
  Target: DMPK; (-) strand; PAM type: NRG; PAM sequence: TGG
gggatggaaggcacagagtg

SEQ ID NO: 8953 - DNA, 20 bp, Artificial Sequence
  Description of Artificial Sequence: Synthetic oligonucleotide
  Target: DMPK; (-) strand; PAM type: NRG; PAM sequence: GAG
gatgagggatggaaggcaca

SEQ ID NO: 8954 - DNA, 20 bp, Artificial Sequence
  Description of Artificial Sequence: Synthetic oligonucleotide
  Target: DMPK; (-) strand; PAM type: NRG; PAM sequence: CAG
ctgatgagggatggaaggca

SEQ ID NO: 8955 - DNA, 20 bp, Artificial Sequence
  Description of Artificial Sequence: Synthetic oligonucleotide
  Target: DMPK; (-) strand; PAM type: NRG; PAM sequence: AGG
ggctgctgatgagggatgga

SEQ ID NO: 8956 - DNA, 20 bp, Artificial Sequence
  Description of Artificial Sequence: Synthetic oligonucleotide
  Target: DMPK; (-) strand; PAM type: NRG; PAM sequence: AAG
gggctgctgatgagggatgg

SEQ ID NO: 8957 - DNA, 20 bp, Artificial Sequence
  Description of Artificial Sequence: Synthetic oligonucleotide
  Target: DMPK; (-) strand; PAM type: NRG; PAM sequence: TGG
ctggggctgctgatgaggga

SEQ ID NO: 8958 - DNA, 20 bp, Artificial Sequence
  Description of Artificial Sequence: Synthetic oligonucleotide
  Target: DMPK; (-) strand; PAM type: NRG; PAM sequence: GGG
gcaactggggctgctgatga

SEQ ID NO: 8959 - DNA, 20 bp, Artificial Sequence
  Description of Artificial Sequence: Synthetic oligonucleotide
  Target: DMPK; (-) strand; PAM type: NRG; PAM sequence: AGG
agcaactggggctgctgatg

SEQ ID NO: 8960 - DNA, 20 bp, Artificial Sequence
  Description of Artificial Sequence: Synthetic oligonucleotide
  Target: DMPK; (-) strand; PAM type: NRG; PAM sequence: GAG
gagcaactggggctgctgat

SEQ ID NO: 8961 - DNA, 20 bp, Artificial Sequence
  Description of Artificial Sequence: Synthetic oligonucleotide
  Target: DMPK; (-) strand; PAM type: NRG; PAM sequence: GGG
ccctggccacagagcaactg

SEQ ID NO: 8962 - DNA, 20 bp, Artificial Sequence
  Description of Artificial Sequence: Synthetic oligonucleotide
  Target: DMPK; (-) strand; PAM type: NRG; PAM sequence: GGG
gccctggccacagagcaact

SEQ ID NO: 8963 - DNA, 20 bp, Artificial Sequence
  Description of Artificial Sequence: Synthetic oligonucleotide
  Target: DMPK; (-) strand; PAM type: NRG; PAM sequence: TGG
tgccctggccacagagcaac

SEQ ID NO: 8964 - DNA, 20 bp, Artificial Sequence
  Description of Artificial Sequence: Synthetic oligonucleotide
  Target: DMPK; (-) strand; PAM type: NRG; PAM sequence: GAG
gagccagtgccctggccaca

SEQ ID NO: 8965 - DNA, 20 bp, Artificial Sequence
  Description of Artificial Sequence: Synthetic oligonucleotide
  Target: DMPK; (-) strand; PAM type: NRG; PAM sequence: CAG
gtgagccagtgccctggcca

SEQ ID NO: 8966 - DNA, 20 bp, Artificial Sequence
  Description of Artificial Sequence: Synthetic oligonucleotide
  Target: DMPK; (-) strand; PAM type: NRG; PAM sequence: TGG
ggaacggtgagccagtgccc

SEQ ID NO: 8967 - DNA, 20 bp, Artificial Sequence
  Description of Artificial Sequence: Synthetic oligonucleotide
  Target: DMPK; (-) strand; PAM type: NRG; PAM sequence: CAG
gggcagatggaacggtgagc

SEQ ID NO: 8968 - DNA, 20 bp, Artificial Sequence
  Description of Artificial Sequence: Synthetic oligonucleotide
  Target: DMPK; (-) strand; PAM type: NRG; PAM sequence: GAG
ctgcgggcagatggaacggt

SEQ ID NO: 8969 - DNA, 20 bp, Artificial Sequence
  Description of Artificial Sequence: Synthetic oligonucleotide
  Target: DMPK; (-) strand; PAM type: NRG; PAM sequence: CGG
caagctgcgggcagatggaa

SEQ ID NO: 8970 - DNA, 20 bp, Artificial Sequence
  Description of Artificial Sequence: Synthetic oligonucleotide
  Target: DMPK; (-) strand; PAM type: NRG; PAM sequence: TGG
tgcctcaagctgcgggcaga

SEQ ID NO: 8971 - DNA, 20 bp, Artificial Sequence
  Description of Artificial Sequence: Synthetic oligonucleotide
  Target: DMPK; (-) strand; PAM type: NRG; PAM sequence: CAG
ctcttgcctcaagctgcggg

SEQ ID NO: 8972 - DNA, 20 bp, Artificial Sequence
  Description of Artificial Sequence: Synthetic oligonucleotide
  Target: DMPK; (-) strand; PAM type: NRG; PAM sequence: GGG
cggctcttgcctcaagctgc

SEQ ID NO: 8973 - DNA, 20 bp, Artificial Sequence
  Description of Artificial Sequence: Synthetic oligonucleotide
  Target: DMPK; (-) strand; PAM type: NRG; PAM sequence: CGG
tcggctcttgcctcaagctg

SEQ ID NO: 8974 - DNA, 20 bp, Artificial Sequence
  Description of Artificial Sequence: Synthetic oligonucleotide
  Target: DMPK; (-) strand; PAM type: NRG; PAM sequence: AAG
ccgacttcggctcttgcctc

SEQ ID NO: 8975 - DNA, 20 bp, Artificial Sequence
  Description of Artificial Sequence: Synthetic oligonucleotide
  Target: DMPK; (-) strand; PAM type: NRG; PAM sequence: CGG
cacatccgcctggccgactt

SEQ ID NO: 8976 - DNA, 20 bp, Artificial Sequence
  Description of Artificial Sequence: Synthetic oligonucleotide
  Target: DMPK; (-) strand; PAM type: NRG; PAM sequence: TGG
ccgctgtggccacatccgcc

SEQ ID NO: 8977 - DNA, 20 bp, Artificial Sequence
  Description of Artificial Sequence: Synthetic oligonucleotide
  Target: DMPK; (-) strand; PAM type: NRG; PAM sequence: TGG
aacatcctgctggaccgctg

SEQ ID NO: 8978 - DNA, 20 bp, Artificial Sequence
  Description of Artificial Sequence: Synthetic oligonucleotide
  Target: DMPK; (-) strand; PAM type: NRG; PAM sequence: TGG
caaacccgacaacatcctgc

SEQ ID NO: 8979 - DNA, 20 bp, Artificial Sequence
  Description of Artificial Sequence: Synthetic oligonucleotide
  Target: DMPK; (-) strand; PAM type: NRG; PAM sequence: GGG
cttctcttttcctccgtgca

SEQ ID NO: 8980 - DNA, 20 bp, Artificial Sequence
  Description of Artificial Sequence: Synthetic oligonucleotide
  Target: DMPK; (-) strand; PAM type: NRG; PAM sequence: AGG
ccttctcttttcctccgtgc

SEQ ID NO: 8981 - DNA, 20 bp, Artificial Sequence
  Description of Artificial Sequence: Synthetic oligonucleotide
  Target: DMPK; (-) strand; PAM type: NRG; PAM sequence: CAG
cccttctcttttcctccgtg

SEQ ID NO: 8982 - DNA, 20 bp, Artificial Sequence
  Description of Artificial Sequence: Synthetic oligonucleotide
  Target: DMPK; (-) strand; PAM type: NRG; PAM sequence: AGG
ctggtgggaccacagaaggg

SEQ ID NO: 8983 - DNA, 20 bp, Artificial Sequence
  Description of Artificial Sequence: Synthetic oligonucleotide
  Target: DMPK; (-) strand; PAM type: NRG; PAM sequence: GAG
cctggtgggaccacagaagg

SEQ ID NO: 8984 - DNA, 20 bp, Artificial Sequence
  Description of Artificial Sequence: Synthetic oligonucleotide
  Target: DMPK; (-) strand; PAM type: NRG; PAM sequence: GGG
agcctggtgggaccacagaa

SEQ ID NO: 8985 - DNA, 20 bp, Artificial Sequence
  Description of Artificial Sequence: Synthetic oligonucleotide
  Target: DMPK; (-) strand; PAM type: NRG; PAM sequence: AGG
gagcctggtgggaccacaga

SEQ ID NO: 8986 - DNA, 20 bp, Artificial Sequence
  Description of Artificial Sequence: Synthetic oligonucleotide
  Target: DMPK; (-) strand; PAM type: NRG; PAM sequence: AAG
ggagcctggtgggaccacag

SEQ ID NO: 8987 - DNA, 20 bp, Artificial Sequence
  Description of Artificial Sequence: Synthetic oligonucleotide
  Target: DMPK; (-) strand; PAM type: NRG; PAM sequence: CAG
ggcggagcctggtgggacca

SEQ ID NO: 8988 - DNA, 20 bp, Artificial Sequence
  Description of Artificial Sequence: Synthetic oligonucleotide
  Target: DMPK; (-) strand; PAM type: NRG; PAM sequence: GGG
ccggaggggcggagcctggt

SEQ ID NO: 8989 - DNA, 20 bp, Artificial Sequence
  Description of Artificial Sequence: Synthetic oligonucleotide
  Target: DMPK; (-) strand; PAM type: NRG; PAM sequence: TGG
cccggaggggcggagcctgg

SEQ ID NO: 8990 - DNA, 20 bp, Artificial Sequence
  Description of Artificial Sequence: Synthetic oligonucleotide
  Target: DMPK; (-) strand; PAM type: NRG; PAM sequence: TGG
ctgcccggaggggcggagcc

SEQ ID NO: 8991 - DNA, 20 bp, Artificial Sequence
  Description of Artificial Sequence: Synthetic oligonucleotide
  Target: DMPK; (-) strand; PAM type: NRG; PAM sequence: GAG
tggcactgcccggaggggcg

SEQ ID NO: 8992 - DNA, 20 bp, Artificial Sequence
  Description of Artificial Sequence: Synthetic oligonucleotide
  Target: DMPK; (-) strand; PAM type: NRG; PAM sequence: CGG
ggtggcactgcccggagggg

SEQ ID NO: 8993 - DNA, 20 bp, Artificial Sequence
  Description of Artificial Sequence: Synthetic oligonucleotide
  Target: DMPK; (-) strand; PAM type: NRG; PAM sequence: GGG
ccaggtggcactgcccggag

SEQ ID NO: 8994 - DNA, 20 bp, Artificial Sequence
  Description of Artificial Sequence: Synthetic oligonucleotide
  Target: DMPK; (-) strand; PAM type: NRG; PAM sequence: GGG
cccaggtggcactgcccgga

SEQ ID NO: 8995 - DNA, 20 bp, Artificial Sequence
  Description of Artificial Sequence: Synthetic oligonucleotide
  Target: DMPK; (-) strand; PAM type: NRG; PAM sequence: AGG
tcccaggtggcactgcccgg

SEQ ID NO: 8996 - DNA, 20 bp, Artificial Sequence
  Description of Artificial Sequence: Synthetic oligonucleotide
  Target: DMPK; (-) strand; PAM type: NRG; PAM sequence: GAG
gtcccaggtggcactgcccg

SEQ ID NO: 8997 - DNA, 20 bp, Artificial Sequence
  Description of Artificial Sequence: Synthetic oligonucleotide
  Target: DMPK; (-) strand; PAM type: NRG; PAM sequence: CGG
gggtcccaggtggcactgcc

SEQ ID NO: 8998 - DNA, 20 bp, Artificial Sequence
  Description of Artificial Sequence: Synthetic oligonucleotide
  Target: DMPK; (-) strand; PAM type: NRG; PAM sequence: TGG
cgaggaagtggggtcccagg

SEQ ID NO: 8999 - DNA, 20 bp, Artificial Sequence
  Description of Artificial Sequence: Synthetic oligonucleotide
  Target: DMPK; (-) strand; PAM type: NRG; PAM sequence: AGG
acccgaggaagtggggtccc

SEQ ID NO: 9000 - DNA, 20 bp, Artificial Sequence
  Description of Artificial Sequence: Synthetic oligonucleotide
  Target: DMPK; (-) strand; PAM type: NRG; PAM sequence: CAG
aacccgaggaagtggggtcc

SEQ ID NO: 9001 - DNA, 20 bp, Artificial Sequence
  Description of Artificial Sequence: Synthetic oligonucleotide
  Target: DMPK; (-) strand; PAM type: NRG; PAM sequence: GGG
gggcggaacccgaggaagtg

SEQ ID NO: 9002 - DNA, 20 bp, Artificial Sequence
  Description of Artificial Sequence: Synthetic oligonucleotide
  Target: DMPK; (-) strand; PAM type: NRG; PAM sequence: GGG
ggggcggaacccgaggaagt

SEQ ID NO: 9003 - DNA, 20 bp, Artificial Sequence
  Description of Artificial Sequence: Synthetic oligonucleotide
  Target: DMPK; (-) strand; PAM type: NRG; PAM sequence: TGG
aggggcggaacccgaggaag

SEQ ID NO: 9004 - DNA, 20 bp, Artificial Sequence
  Description of Artificial Sequence: Synthetic oligonucleotide
  Target: DMPK; (-) strand; PAM type: NRG; PAM sequence: AAG
tacaggggcggaacccgagg

SEQ ID NO: 9005 - DNA, 20 bp, Artificial Sequence
  Description of Artificial Sequence: Synthetic oligonucleotide
  Target: DMPK; (-) strand; PAM type: NRG; PAM sequence: AGG
ccctacaggggcggaacccg

SEQ ID NO: 9006 - DNA, 20 bp, Artificial Sequence
  Description of Artificial Sequence: Synthetic oligonucleotide
  Target: DMPK; (-) strand; PAM type: NRG; PAM sequence: GAG
gccctacaggggcggaaccc

SEQ ID NO: 9007 - DNA, 20 bp, Artificial Sequence
  Description of Artificial Sequence: Synthetic oligonucleotide
  Target: DMPK; (-) strand; PAM type: NRG; PAM sequence: CGG
ctgtagaagccctacagggg

SEQ ID NO: 9008 - DNA, 20 bp, Artificial Sequence
  Description of Artificial Sequence: Synthetic oligonucleotide
  Target: DMPK; (-) strand; PAM type: NRG; PAM sequence: GGG
gaactgtagaagccctacag

SEQ ID NO: 9009 - DNA, 20 bp, Artificial Sequence
  Description of Artificial Sequence: Synthetic oligonucleotide
  Target: DMPK; (-) strand; PAM type: NRG; PAM sequence: GGG
agaactgtagaagccctaca

SEQ ID NO: 9010 - DNA, 20 bp, Artificial Sequence
  Description of Artificial Sequence: Synthetic oligonucleotide
  Target: DMPK; (-) strand; PAM type: NRG; PAM sequence: AGG
cagaactgtagaagccctac

SEQ ID NO: 9011 - DNA, 20 bp, Artificial Sequence
  Description of Artificial Sequence: Synthetic oligonucleotide
  Target: DMPK; (-) strand; PAM type: NRG; PAM sequence: CAG
tcagaactgtagaagcccta

SEQ ID NO: 9012 - DNA, 20 bp, Artificial Sequence
  Description of Artificial Sequence: Synthetic oligonucleotide
  Target: DMPK; (-) strand; PAM type: NRG; PAM sequence: AAG
agtaggggtcagaactgtag

SEQ ID NO: 9013 - DNA, 20 bp, Artificial Sequence
  Description of Artificial Sequence: Synthetic oligonucleotide
  Target: DMPK; (-) strand; PAM type: NRG; PAM sequence: TAG
gggagtaggggtcagaactg

SEQ ID NO: 9014 - DNA, 20 bp, Artificial Sequence
  Description of Artificial Sequence: Synthetic oligonucleotide
  Target: DMPK; (-) strand; PAM type: NRG; PAM sequence: CAG
gggtgcctgggagtaggggt

SEQ ID NO: 9015 - DNA, 20 bp, Artificial Sequence
  Description of Artificial Sequence: Synthetic oligonucleotide
  Target: DMPK; (-) strand; PAM type: NRG; PAM sequence: GGG
cggggggtgcctgggagtag

SEQ ID NO: 9016 - DNA, 20 bp, Artificial Sequence
  Description of Artificial Sequence: Synthetic oligonucleotide
  Target: DMPK; (-) strand; PAM type: NRG; PAM sequence: GGG
ccggggggtgcctgggagta

SEQ ID NO: 9017 - DNA, 20 bp, Artificial Sequence
  Description of Artificial Sequence: Synthetic oligonucleotide
  Target: DMPK; (-) strand; PAM type: NRG; PAM sequence: AGG
accggggggtgcctgggagt

SEQ ID NO: 9018 - DNA, 20 bp, Artificial Sequence
  Description of Artificial Sequence: Synthetic oligonucleotide
  Target: DMPK; (-) strand; PAM type: NRG; PAM sequence: TAG
caccggggggtgcctgggag

SEQ ID NO: 9019 - DNA, 20 bp, Artificial Sequence
  Description of Artificial Sequence: Synthetic oligonucleotide
  Target: DMPK; (-) strand; PAM type: NRG; PAM sequence: GAG
gcccaccggggggtgcctgg

SEQ ID NO: 9020 - DNA, 20 bp, Artificial Sequence
  Description of Artificial Sequence: Synthetic oligonucleotide
  Target: DMPK; (-) strand; PAM type: NRG; PAM sequence: GGG
gggcccaccggggggtgcct

SEQ ID NO: 9021 - DNA, 20 bp, Artificial Sequence
  Description of Artificial Sequence: Synthetic oligonucleotide
  Target: DMPK; (-) strand; PAM type: NRG; PAM sequence: TGG
ggggcccaccggggggtgcc

SEQ ID NO: 9022 - DNA, 20 bp, Artificial Sequence
  Description of Artificial Sequence: Synthetic oligonucleotide
  Target: DMPK; (-) strand; PAM type: NRG; PAM sequence: GGG
cttggttggggcccaccggg

SEQ ID NO: 9023 - DNA, 20 bp, Artificial Sequence
  Description of Artificial Sequence: Synthetic oligonucleotide
  Target: DMPK; (-) strand; PAM type: NRG; PAM sequence: GGG
tcttggttggggcccaccgg

SEQ ID NO: 9024 - DNA, 20 bp, Artificial Sequence
  Description of Artificial Sequence: Synthetic oligonucleotide
  Target: DMPK; (-) strand; PAM type: NRG; PAM sequence: GGG
ttcttggttggggcccaccg

SEQ ID NO: 9025 - DNA, 20 bp, Artificial Sequence
  Description of Artificial Sequence: Synthetic oligonucleotide
  Target: DMPK; (-) strand; PAM type: NRG; PAM sequence: GGG
cttcttggttggggcccacc

SEQ ID NO: 9026 - DNA, 20 bp, Artificial Sequence
  Description of Artificial Sequence: Synthetic oligonucleotide
  Target: DMPK; (-) strand; PAM type: NRG; PAM sequence: CGG
ccttcttggttggggcccac

SEQ ID NO: 9027 - DNA, 20 bp, Artificial Sequence
  Description of Artificial Sequence: Synthetic oligonucleotide
  Target: DMPK; (-) strand; PAM type: NRG; PAM sequence: GGG
gagagggaccttcttggttg

SEQ ID NO: 9028 - DNA, 20 bp, Artificial Sequence
  Description of Artificial Sequence: Synthetic oligonucleotide
  Target: DMPK; (-) strand; PAM type: NRG; PAM sequence: GGG
ggagagggaccttcttggtt

SEQ ID NO: 9029 - DNA, 20 bp, Artificial Sequence
  Description of Artificial Sequence: Synthetic oligonucleotide
  Target: DMPK; (-) strand; PAM type: NRG; PAM sequence: TGG
tggagagggaccttcttggt

SEQ ID NO: 9030 - DNA, 20 bp, Artificial Sequence
  Description of Artificial Sequence: Synthetic oligonucleotide
  Target: DMPK; (-) strand; PAM type: NRG; PAM sequence: TGG
ggcctggagagggaccttct

SEQ ID NO: 9031 - DNA, 20 bp, Artificial Sequence
  Description of Artificial Sequence: Synthetic oligonucleotide
  Target: DMPK; (-) strand; PAM type: NRG; PAM sequence: GGG
gagaggccagggcctggaga

SEQ ID NO: 9032 - DNA, 20 bp, Artificial Sequence
  Description of Artificial Sequence: Synthetic oligonucleotide
  Target: DMPK; (-) strand; PAM type: NRG; PAM sequence: AGG
agagaggccagggcctggag

SEQ ID NO: 9033 - DNA, 20 bp, Artificial Sequence
  Description of Artificial Sequence: Synthetic oligonucleotide
  Target: DMPK; (-) strand; PAM type: NRG; PAM sequence: GAG
cagagaggccagggcctgga

SEQ ID NO: 9034 - DNA, 20 bp, Artificial Sequence
  Description of Artificial Sequence: Synthetic oligonucleotide
  Target: DMPK; (-) strand; PAM type: NRG; PAM sequence: GAG
cccagagaggccagggcctg

SEQ ID NO: 9035 - DNA, 20 bp, Artificial Sequence
  Description of Artificial Sequence: Synthetic oligonucleotide
  Target: DMPK; (-) strand; PAM type: NRG; PAM sequence: TGG
agcccagagaggccagggcc

SEQ ID NO: 9036 - DNA, 20 bp, Artificial Sequence
  Description of Artificial Sequence: Synthetic oligonucleotide
  Target: DMPK; (-) strand; PAM type: NRG; PAM sequence: GGG
gtcagagcccagagaggcca

SEQ ID NO: 9037 - DNA, 20 bp, Artificial Sequence
  Description of Artificial Sequence: Synthetic oligonucleotide
  Target: DMPK; (-) strand; PAM type: NRG; PAM sequence: AGG
ggtcagagcccagagaggcc

SEQ ID NO: 9038 - DNA, 20 bp, Artificial Sequence
  Description of Artificial Sequence: Synthetic oligonucleotide
  Target: DMPK; (-) strand; PAM type: NRG; PAM sequence: CAG
aggtcagagcccagagaggc

SEQ ID NO: 9039 - DNA, 20 bp, Artificial Sequence
  Description of Artificial Sequence: Synthetic oligonucleotide
  Target: DMPK; (-) strand; PAM type: NRG; PAM sequence: AGG
tggaaggtcagagcccagag

SEQ ID NO: 9040 - DNA, 20 bp, Artificial Sequence
  Description of Artificial Sequence: Synthetic oligonucleotide
  Target: DMPK; (-) strand; PAM type: NRG; PAM sequence: GAG
ttggaaggtcagagcccaga

SEQ ID NO: 9041 - DNA, 20 bp, Artificial Sequence
  Description of Artificial Sequence: Synthetic oligonucleotide
  Target: DMPK; (-) strand; PAM type: NRG; PAM sequence: GAG
tcttggaaggtcagagccca

SEQ ID NO: 9042 - DNA, 20 bp, Artificial Sequence
  Description of Artificial Sequence: Synthetic oligonucleotide
  Target: DMPK; (-) strand; PAM type: NRG; PAM sequence: CAG
gttcttggaaggtcagagcc

SEQ ID NO: 9043 - DNA, 20 bp, Artificial Sequence
  Description of Artificial Sequence: Synthetic oligonucleotide
  Target: DMPK; (-) strand; PAM type: NRG; PAM sequence: GAG
gccgggttcttggaaggtca

SEQ ID NO: 9044 - DNA, 20 bp, Artificial Sequence
  Description of Artificial Sequence: Synthetic oligonucleotide
  Target: DMPK; (-) strand; PAM type: NRG; PAM sequence: CAG
tggccgggttcttggaaggt

SEQ ID NO: 9045 - DNA, 20 bp, Artificial Sequence
  Description of Artificial Sequence: Synthetic oligonucleotide
  Target: DMPK; (-) strand; PAM type: NRG; PAM sequence: AGG
tccctggccgggttcttgga

SEQ ID NO: 9046 - DNA, 20 bp, Artificial Sequence
  Description of Artificial Sequence: Synthetic oligonucleotide
  Target: DMPK; (-) strand; PAM type: NRG; PAM sequence: AAG
ttccctggccgggttcttgg

SEQ ID NO: 9047 - DNA, 20 bp, Artificial Sequence
  Description of Artificial Sequence: Synthetic oligonucleotide
  Target: DMPK; (-) strand; PAM type: NRG; PAM sequence: TGG
ttgttccctggccgggttct

SEQ ID NO: 9048 - DNA, 20 bp, Artificial Sequence
  Description of Artificial Sequence: Synthetic oligonucleotide
  Target: DMPK; (-) strand; PAM type: NRG; PAM sequence: GGG
agcaagcttgttccctggcc

SEQ ID NO: 9049 - DNA, 20 bp, Artificial Sequence
  Description of Artificial Sequence: Synthetic oligonucleotide
  Target: DMPK; (-) strand; PAM type: NRG; PAM sequence: CGG
tagcaagcttgttccctggc

SEQ ID NO: 9050 - DNA, 20 bp, Artificial Sequence
  Description of Artificial Sequence: Synthetic oligonucleotide
  Target: DMPK; (-) strand; PAM type: NRG; PAM sequence: TGG
gggatagcaagcttgttccc

SEQ ID NO: 9051 - DNA, 20 bp, Artificial Sequence
  Description of Artificial Sequence: Synthetic oligonucleotide
  Target: DMPK; (-) strand; PAM type: NRG; PAM sequence: AAG
agcatggccgaggggatagc

SEQ ID NO: 9052 - DNA, 20 bp, Artificial Sequence
  Description of Artificial Sequence: Synthetic oligonucleotide
  Target: DMPK; (-) strand; PAM type: NRG; PAM sequence: TAG
gtgcagcatggccgagggga

SEQ ID NO: 9053 - DNA, 20 bp, Artificial Sequence
  Description of Artificial Sequence: Synthetic oligonucleotide
  Target: DMPK; (-) strand; PAM type: NRG; PAM sequence: GGG
gtgggtgcagcatggccgag

SEQ ID NO: 9054 - DNA, 20 bp, Artificial Sequence
  Description of Artificial Sequence: Synthetic oligonucleotide
  Target: DMPK; (-) strand; PAM type: NRG; PAM sequence: GGG
ggtgggtgcagcatggccga

SEQ ID NO: 9055 - DNA, 20 bp, Artificial Sequence
  Description of Artificial Sequence: Synthetic oligonucleotide
  Target: DMPK; (-) strand; PAM type: NRG; PAM sequence: AGG
aggtgggtgcagcatggccg

SEQ ID NO: 9056 - DNA, 20 bp, Artificial Sequence
  Description of Artificial Sequence: Synthetic oligonucleotide
  Target: DMPK; (-) strand; PAM type: NRG; PAM sequence: GAG
caggtgggtgcagcatggcc

SEQ ID NO: 9057 - DNA, 20 bp, Artificial Sequence
  Description of Artificial Sequence: Synthetic oligonucleotide
  Target: DMPK; (-) strand; PAM type: NRG; PAM sequence: TGG
gtgcacaggtgggtgcagca

SEQ ID NO: 9058 - DNA, 20 bp, Artificial Sequence
  Description of Artificial Sequence: Synthetic oligonucleotide
  Target: DMPK; (-) strand; PAM type: NRG; PAM sequence: CAG
gctacgtgcacaggtgggtg

SEQ ID NO: 9059 - DNA, 20 bp, Artificial Sequence
  Description of Artificial Sequence: Synthetic oligonucleotide
  Target: DMPK; (-) strand; PAM type: NRG; PAM sequence: GGG
gcttggctacgtgcacaggt

SEQ ID NO: 9060 - DNA, 20 bp, Artificial Sequence
  Description of Artificial Sequence: Synthetic oligonucleotide
  Target: DMPK; (-) strand; PAM type: NRG; PAM sequence: TGG
ggcttggctacgtgcacagg

SEQ ID NO: 9061 - DNA, 20 bp, Artificial Sequence
  Description of Artificial Sequence: Synthetic oligonucleotide
  Target: DMPK; (-) strand; PAM type: NRG; PAM sequence: AGG
accggcttggctacgtgcac

SEQ ID NO: 9062 - DNA, 20 bp, Artificial Sequence
  Description of Artificial Sequence: Synthetic oligonucleotide
  Target: DMPK; (-) strand; PAM type: NRG; PAM sequence: CAG
caccggcttggctacgtgca

SEQ ID NO: 9063 - DNA, 20 bp, Artificial Sequence
  Description of Artificial Sequence: Synthetic oligonucleotide
  Target: DMPK; (-) strand; PAM type: NRG; PAM sequence: TGG
atagactcggtgcaccggct

SEQ ID NO: 9064 - DNA, 20 bp, Artificial Sequence
  Description of Artificial Sequence: Synthetic oligonucleotide
  Target: DMPK; (-) strand; PAM type: NRG; PAM sequence: CGG
tggccatagactcggtgcac

SEQ ID NO: 9065 - DNA, 20 bp, Artificial Sequence
  Description of Artificial Sequence: Synthetic oligonucleotide
  Target: DMPK; (-) strand; PAM type: NRG; PAM sequence: CGG
gattgtcatggccatagact

SEQ ID NO: 9066 - DNA, 20 bp, Artificial Sequence
  Description of Artificial Sequence: Synthetic oligonucleotide
  Target: DMPK; (-) strand; PAM type: NRG; PAM sequence: TAG
ggcggagattgtcatggcca

SEQ ID NO: 9067 - DNA, 20 bp, Artificial Sequence
  Description of Artificial Sequence: Synthetic oligonucleotide
  Target: DMPK; (-) strand; PAM type: NRG; PAM sequence: TGG
ctacctggcggagattgtca

SEQ ID NO: 9068 - DNA, 20 bp, Artificial Sequence
  Description of Artificial Sequence: Synthetic oligonucleotide
  Target: DMPK; (-) strand; PAM type: NRG; PAM sequence: GAG
tggcgcgcttctacctggcg

SEQ ID NO: 9069 - DNA, 20 bp, Artificial Sequence
  Description of Artificial Sequence: Synthetic oligonucleotide
  Target: DMPK; (-) strand; PAM type: NRG; PAM sequence: CGG
gatggcgcgcttctacctgg

SEQ ID NO: 9070 - DNA, 20 bp, Artificial Sequence
  Description of Artificial Sequence: Synthetic oligonucleotide
  Target: DMPK; (-) strand; PAM type: NRG; PAM sequence: TGG
cgagatggcgcgcttctacc

SEQ ID NO: 9071 - DNA, 20 bp, Artificial Sequence
  Description of Artificial Sequence: Synthetic oligonucleotide
  Target: DMPK; (-) strand; PAM type: NRG; PAM sequence: TGG
ggagcggattccggccgaga

SEQ ID NO: 9072 - DNA, 20 bp, Artificial Sequence
  Description of Artificial Sequence: Synthetic oligonucleotide
  Target: DMPK; (-) strand; PAM type: NRG; PAM sequence: GAG
ttggggagcggattccggcc

SEQ ID NO: 9073 - DNA, 20 bp, Artificial Sequence
  Description of Artificial Sequence: Synthetic oligonucleotide
  Target: DMPK; (-) strand; PAM type: NRG; PAM sequence: CGG
caagtttggggagcggattc

SEQ ID NO: 9074 - DNA, 20 bp, Artificial Sequence
  Description of Artificial Sequence: Synthetic oligonucleotide
  Target: DMPK; (-) strand; PAM type: NRG; PAM sequence: CGG
tgctgagcaagtttggggag

SEQ ID NO: 9075 - DNA, 20 bp, Artificial Sequence
  Description of Artificial Sequence: Synthetic oligonucleotide
  Target: DMPK; (-) strand; PAM type: NRG; PAM sequence: GAG
cactgctgagcaagtttggg

SEQ ID NO: 9076 - DNA, 20 bp, Artificial Sequence
  Description of Artificial Sequence: Synthetic oligonucleotide
  Target: DMPK; (-) strand; PAM type: NRG; PAM sequence: GGG
gacactgctgagcaagtttg

SEQ ID NO: 9077 - DNA, 20 bp, Artificial Sequence
  Description of Artificial Sequence: Synthetic oligonucleotide
  Target: DMPK; (-) strand; PAM type: NRG; PAM sequence: GGG
tgacactgctgagcaagttt

SEQ ID NO: 9078 - DNA, 20 bp, Artificial Sequence
  Description of Artificial Sequence: Synthetic oligonucleotide
  Target: DMPK; (-) strand; PAM type: NRG; PAM sequence: TGG
ctgacactgctgagcaagtt

SEQ ID NO: 9079 - DNA, 20 bp, Artificial Sequence
  Description of Artificial Sequence: Synthetic oligonucleotide
  Target: DMPK; (-) strand; PAM type: NRG; PAM sequence: AAG
acctgctgacactgctgagc

SEQ ID NO: 9080 - DNA, 20 bp, Artificial Sequence
  Description of Artificial Sequence: Synthetic oligonucleotide
  Target: DMPK; (-) strand; PAM type: NRG; PAM sequence: GAG
ggggacctgctgacactgct

SEQ ID NO: 9081 - DNA, 20 bp, Artificial Sequence
  Description of Artificial Sequence: Synthetic oligonucleotide
  Target: DMPK; (-) strand; PAM type: NRG; PAM sequence: GGG
catggagtattacgtgggcg

SEQ ID NO: 9082 - DNA, 20 bp, Artificial Sequence
  Description of Artificial Sequence: Synthetic oligonucleotide
  Target: DMPK; (-) strand; PAM type: NRG; PAM sequence: GGG
tcatggagtattacgtgggc

SEQ ID NO: 9083 - DNA, 20 bp, Artificial Sequence
  Description of Artificial Sequence: Synthetic oligonucleotide
  Target: DMPK; (-) strand; PAM type: NRG; PAM sequence: CGG
gtcatggagtattacgtggg

SEQ ID NO: 9084 - DNA, 20 bp, Artificial Sequence
  Description of Artificial Sequence: Synthetic oligonucleotide
  Target: DMPK; (-) strand; PAM type: NRG; PAM sequence: GGG
ctggtcatggagtattacgt

SEQ ID NO: 9085 - DNA, 20 bp, Artificial Sequence
  Description of Artificial Sequence: Synthetic oligonucleotide
  Target: DMPK; (-) strand; PAM type: NRG; PAM sequence: TGG
cctggtcatggagtattacg

SEQ ID NO: 9086 - DNA, 20 bp, Artificial Sequence
  Description of Artificial Sequence: Synthetic oligonucleotide
  Target: DMPK; (-) strand; PAM type: NRG; PAM sequence: GAG
cttctcagtacctggtcatg

SEQ ID NO: 9087 - DNA, 20 bp, Artificial Sequence
  Description of Artificial Sequence: Synthetic oligonucleotide
  Target: DMPK; (-) strand; PAM type: NRG; PAM sequence: TGG
cccttctcagtacctggtca

SEQ ID NO: 9088 - DNA, 20 bp, Artificial Sequence
  Description of Artificial Sequence: Synthetic oligonucleotide
  Target: DMPK; (-) strand; PAM type: NRG; PAM sequence: TGG
acgaaccccttctcagtacc

SEQ ID NO: 9089 - DNA, 20 bp, Artificial Sequence
  Description of Artificial Sequence: Synthetic oligonucleotide
  Target: DMPK; (-) strand; PAM type: NRG; PAM sequence: CAG
acccatgacgaaccccttct

SEQ ID NO: 9090 - DNA, 20 bp, Artificial Sequence
  Description of Artificial Sequence: Synthetic oligonucleotide
  Target: DMPK; (-) strand; PAM type: NRG; PAM sequence: GGG
gtgatggatcagggcctcag

SEQ ID NO: 9091 - DNA, 20 bp, Artificial Sequence
  Description of Artificial Sequence: Synthetic oligonucleotide
  Target: DMPK; (-) strand; PAM type: NRG; PAM sequence: GGG
cgtgatggatcagggcctca

SEQ ID NO: 9092 - DNA, 20 bp, Artificial Sequence
  Description of Artificial Sequence: Synthetic oligonucleotide
  Target: DMPK; (-) strand; PAM type: NRG; PAM sequence: AGG
ccgtgatggatcagggcctc

SEQ ID NO: 9093 - DNA, 20 bp, Artificial Sequence
  Description of Artificial Sequence: Synthetic oligonucleotide
  Target: DMPK; (-) strand; PAM type: NRG; PAM sequence: CAG
tccgtgatggatcagggcct

SEQ ID NO: 9094 - DNA, 20 bp, Artificial Sequence
  Description of Artificial Sequence: Synthetic oligonucleotide
  Target: DMPK; (-) strand; PAM type: NRG; PAM sequence: GGG
cagccatccgtgatggatca

SEQ ID NO: 9095 - DNA, 20 bp, Artificial Sequence
  Description of Artificial Sequence: Synthetic oligonucleotide
  Target: DMPK; (-) strand; PAM type: NRG; PAM sequence: AGG
ccagccatccgtgatggatc

SEQ ID NO: 9096 - DNA, 20 bp, Artificial Sequence
  Description of Artificial Sequence: Synthetic oligonucleotide
  Target: DMPK; (-) strand; PAM type: NRG; PAM sequence: CAG
cccagccatccgtgatggat

SEQ ID NO: 9097 - DNA, 20 bp, Artificial Sequence
  Description of Artificial Sequence: Synthetic oligonucleotide
  Target: DMPK; (-) strand; PAM type: NRG; PAM sequence: TGG
gttgtcccagccatccgtga

SEQ ID NO: 9098 - DNA, 20 bp, Artificial Sequence
  Description of Artificial Sequence: Synthetic oligonucleotide
  Target: DMPK; (-) strand; PAM type: NRG; PAM sequence: CAG
gtctctgggaggggttgtcc

SEQ ID NO: 9099 - DNA, 20 bp, Artificial Sequence
  Description of Artificial Sequence: Synthetic oligonucleotide
  Target: DMPK; (-) strand; PAM type: NRG; PAM sequence: GGG
ggatggggtgtctctgggag

SEQ ID NO: 9100 - DNA, 20 bp, Artificial Sequence
  Description of Artificial Sequence: Synthetic oligonucleotide
  Target: DMPK; (-) strand; PAM type: NRG; PAM sequence: GGG
aggatggggtgtctctggga

SEQ ID NO: 9101 - DNA, 20 bp, Artificial Sequence
  Description of Artificial Sequence: Synthetic oligonucleotide
  Target: DMPK; (-) strand; PAM type: NRG; PAM sequence: AGG
aaggatggggtgtctctggg

SEQ ID NO: 9102 - DNA, 20 bp, Artificial Sequence
  Description of Artificial Sequence: Synthetic oligonucleotide
  Target: DMPK; (-) strand; PAM type: NRG; PAM sequence: GAG
caaggatggggtgtctctgg

SEQ ID NO: 9103 - DNA, 20 bp, Artificial Sequence
  Description of Artificial Sequence: Synthetic oligonucleotide
  Target: DMPK; (-) strand; PAM type: NRG; PAM sequence: GGG
cccaaggatggggtgtctct

SEQ ID NO: 9104 - DNA, 20 bp, Artificial Sequence
  Description of Artificial Sequence: Synthetic oligonucleotide
  Target: DMPK; (-) strand; PAM type: NRG; PAM sequence: TGG
gcccaaggatggggtgtctc

SEQ ID NO: 9105 - DNA, 20 bp, Artificial Sequence
  Description of Artificial Sequence: Synthetic oligonucleotide
  Target: DMPK; (-) strand; PAM type: NRG; PAM sequence: GGG
caggtctctgcccaaggatg

SEQ ID NO: 9106 - DNA, 20 bp, Artificial Sequence
  Description of Artificial Sequence: Synthetic oligonucleotide
  Target: DMPK; (-) strand; PAM type: NRG; PAM sequence: GGG
gcaggtctctgcccaaggat

SEQ ID NO: 9107 - DNA, 20 bp, Artificial Sequence
  Description of Artificial Sequence: Synthetic oligonucleotide
  Target: DMPK; (-) strand; PAM type: NRG; PAM sequence: TGG
tgcaggtctctgcccaagga

SEQ ID NO: 9108 - DNA, 20 bp, Artificial Sequence
  Description of Artificial Sequence: Synthetic oligonucleotide
  Target: DMPK; (-) strand; PAM type: NRG; PAM sequence: AGG
gggctgcaggtctctgccca

SEQ ID NO: 9109 - DNA, 20 bp, Artificial Sequence
  Description of Artificial Sequence: Synthetic oligonucleotide
  Target: DMPK; (-) strand; PAM type: NRG; PAM sequence: AAG
ggggctgcaggtctctgccc

SEQ ID NO: 9110 - DNA, 20 bp, Artificial Sequence
  Description of Artificial Sequence: Synthetic oligonucleotide
  Target: DMPK; (-) strand; PAM type: NRG; PAM sequence: AGG
tatctctgggctggggctgc

SEQ ID NO: 9111 - DNA, 20 bp, Artificial Sequence
  Description of Artificial Sequence: Synthetic oligonucleotide
  Target: DMPK; (-) strand; PAM type: NRG; PAM sequence: CAG
ttatctctgggctggggctg

SEQ ID NO: 9112 - DNA, 20 bp, Artificial Sequence
  Description of Artificial Sequence: Synthetic oligonucleotide
  Target: DMPK; (-) strand; PAM type: NRG; PAM sequence: GGG
ctatggttatctctgggctg

SEQ ID NO: 9113 - DNA, 20 bp, Artificial Sequence
  Description of Artificial Sequence: Synthetic oligonucleotide
  Target: DMPK; (-) strand; PAM type: NRG; PAM sequence: GGG
tctatggttatctctgggct

SEQ ID NO: 9114 - DNA, 20 bp, Artificial Sequence
  Description of Artificial Sequence: Synthetic oligonucleotide
  Target: DMPK; (-) strand; PAM type: NRG; PAM sequence: TGG
ctctatggttatctctgggc

SEQ ID NO: 9115 - DNA, 20 bp, Artificial Sequence
  Description of Artificial Sequence: Synthetic oligonucleotide
  Target: DMPK; (-) strand; PAM type: NRG; PAM sequence: GGG
agatctctatggttatctct

SEQ ID NO: 9116 - DNA, 20 bp, Artificial Sequence
  Description of Artificial Sequence: Synthetic oligonucleotide
  Target: DMPK; (-) strand; PAM type: NRG; PAM sequence: TGG
cagatctctatggttatctc

SEQ ID NO: 9117 - DNA, 20 bp, Artificial Sequence
  Description of Artificial Sequence: Synthetic oligonucleotide
  Target: DMPK; (-) strand; PAM type: NRG; PAM sequence: TGG
tttggcccggcagatctcta

SEQ ID NO: 9118 - DNA, 20 bp, Artificial Sequence
  Description of Artificial Sequence: Synthetic oligonucleotide
  Target: DMPK; (-) strand; PAM type: NRG; PAM sequence: CAG
tggtctctgatttggcccgg

SEQ ID NO: 9119 - DNA, 20 bp, Artificial Sequence
  Description of Artificial Sequence: Synthetic oligonucleotide
  Target: DMPK; (-) strand; PAM type: NRG; PAM sequence: CGG
aggtggtctctgatttggcc

SEQ ID NO: 9120 - DNA, 20 bp, Artificial Sequence
  Description of Artificial Sequence: Synthetic oligonucleotide
  Target: DMPK; (-) strand; PAM type: NRG; PAM sequence: TGG
gccgcaggtggtctctgatt

SEQ ID NO: 9121 - DNA, 20 bp, Artificial Sequence
  Description of Artificial Sequence: Synthetic oligonucleotide
  Target: DMPK; (-) strand; PAM type: NRG; PAM sequence: TGG
gcgggggcgggggccgcagg

SEQ ID NO: 9122 - DNA, 20 bp, Artificial Sequence
  Description of Artificial Sequence: Synthetic oligonucleotide
  Target: DMPK; (-) strand; PAM type: NRG; PAM sequence: AGG
ggggcgggggcgggggccgc

SEQ ID NO: 9123 - DNA, 20 bp, Artificial Sequence
  Description of Artificial Sequence: Synthetic oligonucleotide
  Target: DMPK; (-) strand; PAM type: NRG; PAM sequence: CAG
aggggcgggggcgggggccg

SEQ ID NO: 9124 - DNA, 20 bp, Artificial Sequence
  Description of Artificial Sequence: Synthetic oligonucleotide
  Target: DMPK; (-) strand; PAM type: NRG; PAM sequence: GGG
tttttgaggggcgggggcgg

SEQ ID NO: 9125 - DNA, 20 bp, Artificial Sequence
  Description of Artificial Sequence: Synthetic oligonucleotide
  Target: DMPK; (-) strand; PAM type: NRG; PAM sequence: GGG
ttttttgaggggcgggggcg

SEQ ID NO: 9126 - DNA, 20 bp, Artificial Sequence
  Description of Artificial Sequence: Synthetic oligonucleotide
  Target: DMPK; (-) strand; PAM type: NRG; PAM sequence: GGG
tttttttgaggggcgggggc

SEQ ID NO: 9127 - DNA, 20 bp, Artificial Sequence
  Description of Artificial Sequence: Synthetic oligonucleotide
  Target: DMPK; (-) strand; PAM type: NRG; PAM sequence: CGG
ttttttttgaggggcggggg

SEQ ID NO: 9128 - DNA, 20 bp, Artificial Sequence
  Description of Artificial Sequence: Synthetic oligonucleotide
  Target: DMPK; (-) strand; PAM type: NRG; PAM sequence: GGG
tgtttttttttgaggggcgg

SEQ ID NO: 9129 - DNA, 20 bp, Artificial Sequence
  Description of Artificial Sequence: Synthetic oligonucleotide
  Target: DMPK; (-) strand; PAM type: NRG; PAM sequence: GGG
gtgtttttttttgaggggcg

SEQ ID NO: 9130 - DNA, 20 bp, Artificial Sequence
  Description of Artificial Sequence: Synthetic oligonucleotide
  Target: DMPK; (-) strand; PAM type: NRG; PAM sequence: GGG
tgtgtttttttttgaggggc

SEQ ID NO: 9131 - DNA, 20 bp, Artificial Sequence
  Description of Artificial Sequence: Synthetic oligonucleotide
  Target: DMPK; (-) strand; PAM type: NRG; PAM sequence: CGG
ttgtgtttttttttgagggg

SEQ ID NO: 9132 - DNA, 20 bp, Artificial Sequence
  Description of Artificial Sequence: Synthetic oligonucleotide
  Target: DMPK; (-) strand; PAM type: NRG; PAM sequence: GGG
tgtttgtgtttttttttgag

SEQ ID NO: 9133 - DNA, 20 bp, Artificial Sequence
  Description of Artificial Sequence: Synthetic oligonucleotide
  Target: DMPK; (-) strand; PAM type: NRG; PAM sequence: GGG
ttgtttgtgtttttttttga

SEQ ID NO: 9134 - DNA, 20 bp, Artificial Sequence
  Description of Artificial Sequence: Synthetic oligonucleotide
  Target: DMPK; (-) strand; PAM type: NRG; PAM sequence: AGG
tttgtttgtgtttttttttg

SEQ ID NO: 9135 - DNA, 20 bp, Artificial Sequence
  Description of Artificial Sequence: Synthetic oligonucleotide
  Target: DMPK; (-) strand; PAM type: NRG; PAM sequence: GAG
ttttgtttgtgttttttttt

SEQ ID NO: 9136 - DNA, 20 bp, Artificial Sequence
  Description of Artificial Sequence: Synthetic oligonucleotide
  Target: DMPK; (-) strand; PAM type: NRG; PAM sequence: AAG
tgcccagtgacatcccagga

SEQ ID NO: 9137 - DNA, 20 bp, Artificial Sequence
  Description of Artificial Sequence: Synthetic oligonucleotide
  Target: DMPK; (-) strand; PAM type: NRG; PAM sequence: AGG
aatctgcccagtgacatccc

SEQ ID NO: 9138 - DNA, 20 bp, Artificial Sequence
  Description of Artificial Sequence: Synthetic oligonucleotide
  Target: DMPK; (-) strand; PAM type: NRG; PAM sequence: CAG
gaatctgcccagtgacatcc

SEQ ID NO: 9139 - DNA, 20 bp, Artificial Sequence
  Description of Artificial Sequence: Synthetic oligonucleotide
  Target: DMPK; (-) strand; PAM type: NRG; PAM sequence: CAG
tcagggggagtgaatctgcc

SEQ ID NO: 9140 - DNA, 20 bp, Artificial Sequence
  Description of Artificial Sequence: Synthetic oligonucleotide
  Target: DMPK; (-) strand; PAM type: NRG; PAM sequence: GAG
ttcccagaacatctcagggg

SEQ ID NO: 9141 - DNA, 20 bp, Artificial Sequence
  Description of Artificial Sequence: Synthetic oligonucleotide
  Target: DMPK; (-) strand; PAM type: NRG; PAM sequence: GGG
ctttcccagaacatctcagg

SEQ ID NO: 9142 - DNA, 20 bp, Artificial Sequence
  Description of Artificial Sequence: Synthetic oligonucleotide
  Target: DMPK; (-) strand; PAM type: NRG; PAM sequence: GGG
tctttcccagaacatctcag

SEQ ID NO: 9143 - DNA, 20 bp, Artificial Sequence
  Description of Artificial Sequence: Synthetic oligonucleotide
  Target: DMPK; (-) strand; PAM type: NRG; PAM sequence: GGG
ctctttcccagaacatctca

SEQ ID NO: 9144 - DNA, 20 bp, Artificial Sequence
  Description of Artificial Sequence: Synthetic oligonucleotide
  Target: DMPK; (-) strand; PAM type: NRG; PAM sequence: AGG
tctctttcccagaacatctc

SEQ ID NO: 9145 - DNA, 20 bp, Artificial Sequence
  Description of Artificial Sequence: Synthetic oligonucleotide
  Target: DMPK; (-) strand; PAM type: NRG; PAM sequence: CAG
ttctctttcccagaacatct

SEQ ID NO: 9146 - DNA, 20 bp, Artificial Sequence
  Description of Artificial Sequence: Synthetic oligonucleotide
  Target: DMPK; (-) strand; PAM type: NRG; PAM sequence: CAG
ggcctctgggttctctttcc

SEQ ID NO: 9147 - DNA, 20 bp, Artificial Sequence
  Description of Artificial Sequence: Synthetic oligonucleotide
  Target: DMPK; (-) strand; PAM type: NRG; PAM sequence: GGG
ctgggtgttgggtggcctct

SEQ ID NO: 9148 - DNA, 20 bp, Artificial Sequence
  Description of Artificial Sequence: Synthetic oligonucleotide
  Target: DMPK; (-) strand; PAM type: NRG; PAM sequence: TGG
tctgggtgttgggtggcctc

SEQ ID NO: 9149 - DNA, 20 bp, Artificial Sequence
  Description of Artificial Sequence: Synthetic oligonucleotide
  Target: DMPK; (-) strand; PAM type: NRG; PAM sequence: TGG
cctattctctgggtgttggg

SEQ ID NO: 9150 - DNA, 20 bp, Artificial Sequence
  Description of Artificial Sequence: Synthetic oligonucleotide
  Target: DMPK; (-) strand; PAM type: NRG; PAM sequence: GGG
ggacctattctctgggtgtt

SEQ ID NO: 9151 - DNA, 20 bp, Artificial Sequence
  Description of Artificial Sequence: Synthetic oligonucleotide
  Target: DMPK; (-) strand; PAM type: NRG; PAM sequence: TGG
gggacctattctctgggtgt

SEQ ID NO: 9152 - DNA, 20 bp, Artificial Sequence
  Description of Artificial Sequence: Synthetic oligonucleotide
  Target: DMPK; (-) strand; PAM type: NRG; PAM sequence: GGG
gtgtctgggacctattctct

SEQ ID NO: 9153 - DNA, 20 bp, Artificial Sequence
  Description of Artificial Sequence: Synthetic oligonucleotide
  Target: DMPK; (-) strand; PAM type: NRG; PAM sequence: TGG
agtgtctgggacctattctc

SEQ ID NO: 9154 - DNA, 20 bp, Artificial Sequence
  Description of Artificial Sequence: Synthetic oligonucleotide
  Target: DMPK; (-) strand; PAM type: NRG; PAM sequence: GGG
tgcctagggaaggagtgtct

SEQ ID NO: 9155 - DNA, 20 bp, Artificial Sequence
  Description of Artificial Sequence: Synthetic oligonucleotide
  Target: DMPK; (-) strand; PAM type: NRG; PAM sequence: TGG
ctgcctagggaaggagtgtc

SEQ ID NO: 9156 - DNA, 20 bp, Artificial Sequence
  Description of Artificial Sequence: Synthetic oligonucleotide
  Target: DMPK; (-) strand; PAM type: NRG; PAM sequence: GAG
ggggccactgcctagggaag

SEQ ID NO: 9157 - DNA, 20 bp, Artificial Sequence
  Description of Artificial Sequence: Synthetic oligonucleotide
  Target: DMPK; (-) strand; PAM type: NRG; PAM sequence: AGG
acggggccactgcctaggga

SEQ ID NO: 9158 - DNA, 20 bp, Artificial Sequence
  Description of Artificial Sequence: Synthetic oligonucleotide
  Target: DMPK; (-) strand; PAM type: NRG; PAM sequence: AAG
aacggggccactgcctaggg

SEQ ID NO: 9159 - DNA, 20 bp, Artificial Sequence
  Description of Artificial Sequence: Synthetic oligonucleotide
  Target: DMPK; (-) strand; PAM type: NRG; PAM sequence: GGG
tctaacggggccactgccta

SEQ ID NO: 9160 - DNA, 20 bp, Artificial Sequence
  Description of Artificial Sequence: Synthetic oligonucleotide
  Target: DMPK; (-) strand; PAM type: NRG; PAM sequence: AGG
ttctaacggggccactgcct

SEQ ID NO: 9161 - DNA, 20 bp, Artificial Sequence
  Description of Artificial Sequence: Synthetic oligonucleotide
  Target: DMPK; (-) strand; PAM type: NRG; PAM sequence: TAG
attctaacggggccactgcc

SEQ ID NO: 9162 - DNA, 20 bp, Artificial Sequence
  Description of Artificial Sequence: Synthetic oligonucleotide
  Target: DMPK; (-) strand; PAM type: NRG; PAM sequence: GGG
ggtcttcaggaattctaacg

SEQ ID NO: 9163 - DNA, 20 bp, Artificial Sequence
  Description of Artificial Sequence: Synthetic oligonucleotide
  Target: DMPK; (-) strand; PAM type: NRG; PAM sequence: GGG
aggtcttcaggaattctaac

SEQ ID NO: 9164 - DNA, 20 bp, Artificial Sequence
  Description of Artificial Sequence: Synthetic oligonucleotide
  Target: DMPK; (-) strand; PAM type: NRG; PAM sequence: CGG
taggtcttcaggaattctaa

SEQ ID NO: 9165 - DNA, 20 bp, Artificial Sequence
  Description of Artificial Sequence: Synthetic oligonucleotide
  Target: DMPK; (-) strand; PAM type: NRG; PAM sequence: AGG
ctggaatgggataggtcttc

SEQ ID NO: 9166 - DNA, 20 bp, Artificial Sequence
  Description of Artificial Sequence: Synthetic oligonucleotide
  Target: DMPK; (-) strand; PAM type: NRG; PAM sequence: CAG
cctggaatgggataggtctt

SEQ ID NO: 9167 - DNA, 20 bp, Artificial Sequence
  Description of Artificial Sequence: Synthetic oligonucleotide
  Target: DMPK; (-) strand; PAM type: NRG; PAM sequence: AGG
tctcttacctggaatgggat

SEQ ID NO: 9168 - DNA, 20 bp, Artificial Sequence
  Description of Artificial Sequence: Synthetic oligonucleotide
  Target: DMPK; (-) strand; PAM type: NRG; PAM sequence: TAG
gtctcttacctggaatggga

SEQ ID NO: 9169 - DNA, 20 bp, Artificial Sequence
  Description of Artificial Sequence: Synthetic oligonucleotide
  Target: DMPK; (-) strand; PAM type: NRG; PAM sequence: GGG
gggggtctcttacctggaat

SEQ ID NO: 9170 - DNA, 20 bp, Artificial Sequence
  Description of Artificial Sequence: Synthetic oligonucleotide
  Target: DMPK; (-) strand; PAM type: NRG; PAM sequence: TGG
ggggggtctcttacctggaa

SEQ ID NO: 9171 - DNA, 20 bp, Artificial Sequence
  Description of Artificial Sequence: Synthetic oligonucleotide
  Target: DMPK; (-) strand; PAM type: NRG; PAM sequence: TGG
gttgcggggggtctcttacc

SEQ ID NO: 9172 - DNA, 20 bp, Artificial Sequence
  Description of Artificial Sequence: Synthetic oligonucleotide
  Target: DMPK; (-) strand; PAM type: NRG; PAM sequence: GGG
aaagatgtctctgttgcggg

SEQ ID NO: 9173 - DNA, 20 bp, Artificial Sequence
  Description of Artificial Sequence: Synthetic oligonucleotide
  Target: DMPK; (-) strand; PAM type: NRG; PAM sequence: GGG
taaagatgtctctgttgcgg

SEQ ID NO: 9174 - DNA, 20 bp, Artificial Sequence
  Description of Artificial Sequence: Synthetic oligonucleotide
  Target: DMPK; (-) strand; PAM type: NRG; PAM sequence: GGG
ataaagatgtctctgttgcg

SEQ ID NO: 9175 - DNA, 20 bp, Artificial Sequence
  Description of Artificial Sequence: Synthetic oligonucleotide
  Target: DMPK; (-) strand; PAM type: NRG; PAM sequence: GGG
tataaagatgtctctgttgc

SEQ ID NO: 9176 - DNA, 20 bp, Artificial Sequence
  Description of Artificial Sequence: Synthetic oligonucleotide
  Target: DMPK; (-) strand; PAM type: NRG; PAM sequence: CGG
ttataaagatgtctctgttg

SEQ ID NO: 9177 - DNA, 20 bp, Artificial Sequence
  Description of Artificial Sequence: Synthetic oligonucleotide
  Target: DMPK; (-) strand; PAM type: NRG; PAM sequence: AAG
tgatctgggggactcttata

SEQ ID NO: 9178 - DNA, 20 bp, Artificial Sequence
  Description of Artificial Sequence: Synthetic oligonucleotide
  Target: DMPK; (-) strand; PAM type: NRG; PAM sequence: GGG
ccgtttctggggtgatctgg

SEQ ID NO: 9179 - DNA, 20 bp, Artificial Sequence
  Description of Artificial Sequence: Synthetic oligonucleotide
  Target: DMPK; (-) strand; PAM type: NRG; PAM sequence: GGG
cccgtttctggggtgatctg

SEQ ID NO: 9180 - DNA, 20 bp, Artificial Sequence
  Description of Artificial Sequence: Synthetic oligonucleotide
  Target: DMPK; (-) strand; PAM type: NRG; PAM sequence: GGG
gcccgtttctggggtgatct

SEQ ID NO: 9181 - DNA, 20 bp, Artificial Sequence
  Description of Artificial Sequence: Synthetic oligonucleotide
  Target: DMPK; (-) strand; PAM type: NRG; PAM sequence: TGG
tgcccgtttctggggtgatc

SEQ ID NO: 9182 - DNA, 20 bp, Artificial Sequence
  Description of Artificial Sequence: Synthetic oligonucleotide
  Target: DMPK; (-) strand; PAM type: NRG; PAM sequence: GGG
tccttcactgcccgtttctg

SEQ ID NO: 9183 - DNA, 20 bp, Artificial Sequence
  Description of Artificial Sequence: Synthetic oligonucleotide
  Target: DMPK; (-) strand; PAM type: NRG; PAM sequence: GGG
gtccttcactgcccgtttct

SEQ ID NO: 9184 - DNA, 20 bp, Artificial Sequence
  Description of Artificial Sequence: Synthetic oligonucleotide
  Target: DMPK; (-) strand; PAM type: NRG; PAM sequence: TGG
tgtccttcactgcccgtttc

SEQ ID NO: 9185 - DNA, 20 bp, Artificial Sequence
  Description of Artificial Sequence: Synthetic oligonucleotide
  Target: DMPK; (-) strand; PAM type: NRG; PAM sequence: TGG
ttccctatctgagacgggga

SEQ ID NO: 9186 - DNA, 20 bp, Artificial Sequence
  Description of Artificial Sequence: Synthetic oligonucleotide
  Target: DMPK; (-) strand; PAM type: NRG; PAM sequence: GGG
ggccttccctatctgagacg

SEQ ID NO: 9187 - DNA, 20 bp, Artificial Sequence
  Description of Artificial Sequence: Synthetic oligonucleotide
  Target: DMPK; (-) strand; PAM type: NRG; PAM sequence: GGG
gggccttccctatctgagac

SEQ ID NO: 9188 - DNA, 20 bp, Artificial Sequence
  Description of Artificial Sequence: Synthetic oligonucleotide
  Target: DMPK; (-) strand; PAM type: NRG; PAM sequence: CGG
ggggccttccctatctgaga

SEQ ID NO: 9189 - DNA, 20 bp, Artificial Sequence
  Description of Artificial Sequence: Synthetic oligonucleotide
  Target: DMPK; (-) strand; PAM type: NRG; PAM sequence: GAG
atgaggggccttccctatct

SEQ ID NO: 9190 - DNA, 20 bp, Artificial Sequence
  Description of Artificial Sequence: Synthetic oligonucleotide
  Target: DMPK; (-) strand; PAM type: NRG; PAM sequence: GGG
gggtgtgtcaggtggatgag

SEQ ID NO: 9191 - DNA, 20 bp, Artificial Sequence
  Description of Artificial Sequence: Synthetic oligonucleotide
  Target: DMPK; (-) strand; PAM type: NRG; PAM sequence: GGG
agggtgtgtcaggtggatga

SEQ ID NO: 9192 - DNA, 20 bp, Artificial Sequence
  Description of Artificial Sequence: Synthetic oligonucleotide
  Target: DMPK; (-) strand; PAM type: NRG; PAM sequence: AGG
gagggtgtgtcaggtggatg

SEQ ID NO: 9193 - DNA, 20 bp, Artificial Sequence
  Description of Artificial Sequence: Synthetic oligonucleotide
  Target: DMPK; (-) strand; PAM type: NRG; PAM sequence: GAG
agagggtgtgtcaggtggat

SEQ ID NO: 9194 - DNA, 20 bp, Artificial Sequence
  Description of Artificial Sequence: Synthetic oligonucleotide
  Target: DMPK; (-) strand; PAM type: NRG; PAM sequence: TGG
cggtaagagggtgtgtcagg

SEQ ID NO: 9195 - DNA, 20 bp, Artificial Sequence
  Description of Artificial Sequence: Synthetic oligonucleotide
  Target: DMPK; (-) strand; PAM type: NRG; PAM sequence: AGG
gtgcggtaagagggtgtgtc

SEQ ID NO: 9196 - DNA, 20 bp, Artificial Sequence
  Description of Artificial Sequence: Synthetic oligonucleotide
  Target: DMPK; (-) strand; PAM type: NRG; PAM sequence: CAG
tgtgcggtaagagggtgtgt

SEQ ID NO: 9197 - DNA, 20 bp, Artificial Sequence
  Description of Artificial Sequence: Synthetic oligonucleotide
  Target: DMPK; (-) strand; PAM type: NRG; PAM sequence: GGG
aaagtctgtgtgcggtaaga

SEQ ID NO: 9198 - DNA, 20 bp, Artificial Sequence
  Description of Artificial Sequence: Synthetic oligonucleotide
  Target: DMPK; (-) strand; PAM type: NRG; PAM sequence: AGG
gaaagtctgtgtgcggtaag

SEQ ID NO: 9199 - DNA, 20 bp, Artificial Sequence
  Description of Artificial Sequence: Synthetic oligonucleotide
  Target: DMPK; (-) strand; PAM type: NRG; PAM sequence: GAG
ggaaagtctgtgtgcggtaa

SEQ ID NO: 9200 - DNA, 20 bp, Artificial Sequence
  Description of Artificial Sequence: Synthetic oligonucleotide
  Target: DMPK; (-) strand; PAM type: NRG; PAM sequence: AAG
tgggaaagtctgtgtgcggt

SEQ ID NO: 9201 - DNA, 20 bp, Artificial Sequence
  Description of Artificial Sequence: Synthetic oligonucleotide
  Target: DMPK; (-) strand; PAM type: NRG; PAM sequence: CGG
tctgtgggaaagtctgtgtg

SEQ ID NO: 9202 - DNA, 20 bp, Artificial Sequence
  Description of Artificial Sequence: Synthetic oligonucleotide
  Target: DMPK; (-) strand; PAM type: NRG; PAM sequence: AAG
gcccggaaacgtctgtggga

SEQ ID NO: 9203 - DNA, 20 bp, Artificial Sequence
  Description of Artificial Sequence: Synthetic oligonucleotide
  Target: DMPK; (-) strand; PAM type: NRG; PAM sequence: GGG
tgctgcccggaaacgtctgt

SEQ ID NO: 9204 - DNA, 20 bp, Artificial Sequence
  Description of Artificial Sequence: Synthetic oligonucleotide
  Target: DMPK; (-) strand; PAM type: NRG; PAM sequence: TGG
gtgctgcccggaaacgtctg

SEQ ID NO: 9205 - DNA, 20 bp, Artificial Sequence
  Description of Artificial Sequence: Synthetic oligonucleotide
  Target: DMPK; (-) strand; PAM type: NRG; PAM sequence: CGG
ctaggattgggggtgctgcc

SEQ ID NO: 9206 - DNA, 20 bp, Artificial Sequence
  Description of Artificial Sequence: Synthetic oligonucleotide
  Target: DMPK; (-) strand; PAM type: NRG; PAM sequence: GGG
agaggaagctctaggattgg

SEQ ID NO: 9207 - DNA, 20 bp, Artificial Sequence
  Description of Artificial Sequence: Synthetic oligonucleotide
  Target: DMPK; (-) strand; PAM type: NRG; PAM sequence: GGG
gagaggaagctctaggattg

SEQ ID NO: 9208 - DNA, 20 bp, Artificial Sequence
  Description of Artificial Sequence: Synthetic oligonucleotide
  Target: DMPK; (-) strand; PAM type: NRG; PAM sequence: GGG
ggagaggaagctctaggatt

SEQ ID NO: 9209 - DNA, 20 bp, Artificial Sequence
  Description of Artificial Sequence: Synthetic oligonucleotide
  Target: DMPK; (-) strand; PAM type: NRG; PAM sequence: TGG
gggagaggaagctctaggat

SEQ ID NO: 9210 - DNA, 20 bp, Artificial Sequence
  Description of Artificial Sequence: Synthetic oligonucleotide
  Target: DMPK; (-) strand; PAM type: NRG; PAM sequence: AGG
aggtggggagaggaagctct

SEQ ID NO: 9211 - DNA, 20 bp, Artificial Sequence
  Description of Artificial Sequence: Synthetic oligonucleotide
  Target: DMPK; (-) strand; PAM type: NRG; PAM sequence: TAG
gaggtggggagaggaagctc

SEQ ID NO: 9212 - DNA, 20 bp, Artificial Sequence
  Description of Artificial Sequence: Synthetic oligonucleotide
  Target: DMPK; (-) strand; PAM type: NRG; PAM sequence: AAG
gacgaggaggtggggagagg

SEQ ID NO: 9213 - DNA, 20 bp, Artificial Sequence
  Description of Artificial Sequence: Synthetic oligonucleotide
  Target: DMPK; (-) strand; PAM type: NRG; PAM sequence: AGG
ctggacgaggaggtggggag

SEQ ID NO: 9214 - DNA, 20 bp, Artificial Sequence
  Description of Artificial Sequence: Synthetic oligonucleotide
  Target: DMPK; (-) strand; PAM type: NRG; PAM sequence: GAG
actggacgaggaggtgggga

SEQ ID NO: 9215 - DNA, 20 bp, Artificial Sequence
  Description of Artificial Sequence: Synthetic oligonucleotide
  Target: DMPK; (-) strand; PAM type: NRG; PAM sequence: GAG
tcactggacgaggaggtggg

SEQ ID NO: 9216 - DNA, 20 bp, Artificial Sequence
  Description of Artificial Sequence: Synthetic oligonucleotide
  Target: DMPK; (-) strand; PAM type: NRG; PAM sequence: GGG
tgtcactggacgaggaggtg

SEQ ID NO: 9217 - DNA, 20 bp, Artificial Sequence
  Description of Artificial Sequence: Synthetic oligonucleotide
  Target: DMPK; (-) strand; PAM type: NRG; PAM sequence: GGG
ctgtcactggacgaggaggt

SEQ ID NO: 9218 - DNA, 20 bp, Artificial Sequence
  Description of Artificial Sequence: Synthetic oligonucleotide
  Target: DMPK; (-) strand; PAM type: NRG; PAM sequence: TGG
gctgtcactggacgaggagg

SEQ ID NO: 9219 - DNA, 20 bp, Artificial Sequence
  Description of Artificial Sequence: Synthetic oligonucleotide
  Target: DMPK; (-) strand; PAM type: NRG; PAM sequence: AGG
cgtgctgtcactggacgagg

SEQ ID NO: 9220 - DNA, 20 bp, Artificial Sequence
  Description of Artificial Sequence: Synthetic oligonucleotide
  Target: DMPK; (-) strand; PAM type: NRG; PAM sequence: GAG
ccgtgctgtcactggacgag

SEQ ID NO: 9221 - DNA, 20 bp, Artificial Sequence
  Description of Artificial Sequence: Synthetic oligonucleotide
  Target: DMPK; (-) strand; PAM type: NRG; PAM sequence: AGG
gcccgtgctgtcactggacg

SEQ ID NO: 9222 - DNA, 20 bp, Artificial Sequence
  Description of Artificial Sequence: Synthetic oligonucleotide
  Target: DMPK; (-) strand; PAM type: NRG; PAM sequence: GAG
agcccgtgctgtcactggac

SEQ ID NO: 9223 - DNA, 20 bp, Artificial Sequence
  Description of Artificial Sequence: Synthetic oligonucleotide
  Target: DMPK; (-) strand; PAM type: NRG; PAM sequence: TGG
acaagagcccgtgctgtcac

SEQ ID NO: 9224 - DNA, 20 bp, Artificial Sequence
  Description of Artificial Sequence: Synthetic oligonucleotide
  Target: DMPK; (-) strand; PAM type: NRG; PAM sequence: GAG
gtgactaggaagagggacaa

SEQ ID NO: 9225 - DNA, 20 bp, Artificial Sequence
  Description of Artificial Sequence: Synthetic oligonucleotide
  Target: DMPK; (-) strand; PAM type: NRG; PAM sequence: AAG
gggtgactaggaagagggac

SEQ ID NO: 9226 - DNA, 20 bp, Artificial Sequence
  Description of Artificial Sequence: Synthetic oligonucleotide
  Target: DMPK; (-) strand; PAM type: NRG; PAM sequence: GGG
ggccggggtgactaggaaga

SEQ ID NO: 9227 - DNA, 20 bp, Artificial Sequence
  Description of Artificial Sequence: Synthetic oligonucleotide
  Target: DMPK; (-) strand; PAM type: NRG; PAM sequence: AGG
gggccggggtgactaggaag

SEQ ID NO: 9228 - DNA, 20 bp, Artificial Sequence
  Description of Artificial Sequence: Synthetic oligonucleotide
  Target: DMPK; (-) strand; PAM type: NRG; PAM sequence: GAG
cgggccggggtgactaggaa

SEQ ID NO: 9229 - DNA, 20 bp, Artificial Sequence
  Description of Artificial Sequence: Synthetic oligonucleotide
  Target: DMPK; (-) strand; PAM type: NRG; PAM sequence: AAG
tccgggccggggtgactagg

SEQ ID NO: 9230 - DNA, 20 bp, Artificial Sequence
  Description of Artificial Sequence: Synthetic oligonucleotide
  Target: DMPK; (-) strand; PAM type: NRG; PAM sequence: AGG
agctccgggccggggtgact

SEQ ID NO: 9231 - DNA, 20 bp, Artificial Sequence
  Description of Artificial Sequence: Synthetic oligonucleotide
  Target: DMPK; (-) strand; PAM type: NRG; PAM sequence: TAG
gagctccgggccggggtgac

SEQ ID NO: 9232 - DNA, 20 bp, Artificial Sequence
  Description of Artificial Sequence: Synthetic oligonucleotide
  Target: DMPK; (-) strand; PAM type: NRG; PAM sequence: GGG
acctggtgagctccgggccg

SEQ ID NO: 9233 - DNA, 20 bp, Artificial Sequence
  Description of Artificial Sequence: Synthetic oligonucleotide
  Target: DMPK; (-) strand; PAM type: NRG; PAM sequence: GGG
tacctggtgagctccgggcc

SEQ ID NO: 9234 - DNA, 20 bp, Artificial Sequence
  Description of Artificial Sequence: Synthetic oligonucleotide
  Target: DMPK; (-) strand; PAM type: NRG; PAM sequence: CGG
ctacctggtgagctccgggc

SEQ ID NO: 9235 - DNA, 20 bp, Artificial Sequence
  Description of Artificial Sequence: Synthetic oligonucleotide
  Target: DMPK; (-) strand; PAM type: NRG; PAM sequence: GGG
agaactacctggtgagctcc

SEQ ID NO: 9236 - DNA, 20 bp, Artificial Sequence
  Description of Artificial Sequence: Synthetic oligonucleotide
  Target: DMPK; (-) strand; PAM type: NRG; PAM sequence: CGG
gagaactacctggtgagctc

SEQ ID NO: 9237 - DNA, 20 bp, Artificial Sequence
  Description of Artificial Sequence: Synthetic oligonucleotide
  Target: DMPK; (-) strand; PAM type: NRG; PAM sequence: GAG
caggatgagaactacctggt

SEQ ID NO: 9238 - DNA, 20 bp, Artificial Sequence
  Description of Artificial Sequence: Synthetic oligonucleotide
  Target: DMPK; (-) strand; PAM type: NRG; PAM sequence: TGG
cttccaggatgagaactacc

SEQ ID NO: 9239 - DNA, 20 bp, Artificial Sequence
  Description of Artificial Sequence: Synthetic oligonucleotide
  Target: DMPK; (-) strand; PAM type: NRG; PAM sequence: GAG
tgcacttcgccttccaggat

SEQ ID NO: 9240 - DNA, 20 bp, Artificial Sequence
  Description of Artificial Sequence: Synthetic oligonucleotide
  Target: DMPK; (-) strand; PAM type: NRG; PAM sequence: AGG
gcagctgcacttcgccttcc

SEQ ID NO: 9241 - DNA, 20 bp, Artificial Sequence
  Description of Artificial Sequence: Synthetic oligonucleotide
  Target: DMPK; (-) strand; PAM type: NRG; PAM sequence: CAG
cgcagctgcacttcgccttc

SEQ ID NO: 9242 - DNA, 20 bp, Artificial Sequence
  Description of Artificial Sequence: Synthetic oligonucleotide
  Target: DMPK; (-) strand; PAM type: NRG; PAM sequence: CAG
gggaccggcggtggatcacg

SEQ ID NO: 9243 - DNA, 20 bp, Artificial Sequence
  Description of Artificial Sequence: Synthetic oligonucleotide
  Target: DMPK; (-) strand; PAM type: NRG; PAM sequence: TGG
tggtgaatggggaccggcgg

SEQ ID NO: 9244 - DNA, 20 bp, Artificial Sequence
  Description of Artificial Sequence: Synthetic oligonucleotide
  Target: DMPK; (-) strand; PAM type: NRG; PAM sequence: CGG
tgttggtgaatggggaccgg

SEQ ID NO: 9245 - DNA, 20 bp, Artificial Sequence
  Description of Artificial Sequence: Synthetic oligonucleotide
  Target: DMPK; (-) strand; PAM type: NRG; PAM sequence: CGG
acgtgttggtgaatggggac

SEQ ID NO: 9246 - DNA, 20 bp, Artificial Sequence
  Description of Artificial Sequence: Synthetic oligonucleotide
  Target: DMPK; (-) strand; PAM type: NRG; PAM sequence: GGG
gagggacgtgttggtgaatg

SEQ ID NO: 9247 - DNA, 20 bp, Artificial Sequence
  Description of Artificial Sequence: Synthetic oligonucleotide
  Target: DMPK; (-) strand; PAM type: NRG; PAM sequence: GGG
agagggacgtgttggtgaat

SEQ ID NO: 9248 - DNA, 20 bp, Artificial Sequence
  Description of Artificial Sequence: Synthetic oligonucleotide
  Target: DMPK; (-) strand; PAM type: NRG; PAM sequence: TGG
gagagggacgtgttggtgaa

SEQ ID NO: 9249 - DNA, 20 bp, Artificial Sequence
  Description of Artificial Sequence: Synthetic oligonucleotide
  Target: DMPK; (-) strand; PAM type: NRG; PAM sequence: TGG
ccgtgaggagagggacgtgt

SEQ ID NO: 9250 - DNA, 20 bp, Artificial Sequence
  Description of Artificial Sequence: Synthetic oligonucleotide
  Target: DMPK; (-) strand; PAM type: NRG; PAM sequence: GGG
gtcgtgcttccgtgaggaga

SEQ ID NO: 9251 - DNA, 20 bp, Artificial Sequence
  Description of Artificial Sequence: Synthetic oligonucleotide
  Target: DMPK; (-) strand; PAM type: NRG; PAM sequence: AGG
tgtcgtgcttccgtgaggag

SEQ ID NO: 9252 - DNA, 20 bp, Artificial Sequence
  Description of Artificial Sequence: Synthetic oligonucleotide
  Target: DMPK; (-) strand; PAM type: NRG; PAM sequence: GAG
gtgtcgtgcttccgtgagga

SEQ ID NO: 9253 - DNA, 20 bp, Artificial Sequence
  Description of Artificial Sequence: Synthetic oligonucleotide
  Target: DMPK; (-) strand; PAM type: NRG; PAM sequence: GAG
aggtgtcgtgcttccgtgag

SEQ ID NO: 9254 - DNA, 20 bp, Artificial Sequence
  Description of Artificial Sequence: Synthetic oligonucleotide
  Target: DMPK; (-) strand; PAM type: NRG; PAM sequence: AGG
gcaggtgtcgtgcttccgtg

SEQ ID NO: 9255 - DNA, 20 bp, Artificial Sequence
  Description of Artificial Sequence: Synthetic oligonucleotide
  Target: DMPK; (-) strand; PAM type: NRG; PAM sequence: GAG
tgcaggtgtcgtgcttccgt

SEQ ID NO: 9256 - DNA, 20 bp, Artificial Sequence
  Description of Artificial Sequence: Synthetic oligonucleotide
  Target: DMPK; (-) strand; PAM type: NRG; PAM sequence: AGG
agctcctccgggtgccctgc

SEQ ID NO: 9257 - DNA, 20 bp, Artificial Sequence
  Description of Artificial Sequence: Synthetic oligonucleotide
  Target: DMPK; (-) strand; PAM type: NRG; PAM sequence: CAG
cagctcctccgggtgccctg

SEQ ID NO: 9258 - DNA, 20 bp, Artificial Sequence
  Description of Artificial Sequence: Synthetic oligonucleotide
  Target: DMPK; (-) strand; PAM type: NRG; PAM sequence: GGG
tctccggctgcagctcctcc

SEQ ID NO: 9259 - DNA, 20 bp, Artificial Sequence
  Description of Artificial Sequence: Synthetic oligonucleotide
  Target: DMPK; (-) strand; PAM type: NRG; PAM sequence: CGG
gtctccggctgcagctcctc

SEQ ID NO: 9260 - DNA, 20 bp, Artificial Sequence
  Description of Artificial Sequence: Synthetic oligonucleotide
  Target: DMPK; (-) strand; PAM type: NRG; PAM sequence: CAG
ccgcgccccgtctccggctg

SEQ ID NO: 9261 - DNA, 20 bp, Artificial Sequence
  Description of Artificial Sequence: Synthetic oligonucleotide
  Target: DMPK; (-) strand; PAM type: NRG; PAM sequence: CGG
gaggatccgcgccccgtctc

SEQ ID NO: 9262 - DNA, 20 bp, Artificial Sequence
  Description of Artificial Sequence: Synthetic oligonucleotide
  Target: DMPK; (-) strand; PAM type: NRG; PAM sequence: AGG
ggcggacgtggggggctttg

SEQ ID NO: 9263 - DNA, 20 bp, Artificial Sequence
  Description of Artificial Sequence: Synthetic oligonucleotide
  Target: DMPK; (-) strand; PAM type: NRG; PAM sequence: GAG
gggcggacgtggggggcttt

SEQ ID NO: 9264 - DNA, 20 bp, Artificial Sequence
  Description of Artificial Sequence: Synthetic oligonucleotide
  Target: DMPK; (-) strand; PAM type: NRG; PAM sequence: GGG
aggggctgggcggacgtggg

SEQ ID NO: 9265 - DNA, 20 bp, Artificial Sequence
  Description of Artificial Sequence: Synthetic oligonucleotide
  Target: DMPK; (-) strand; PAM type: NRG; PAM sequence: GGG
gaggggctgggcggacgtgg

SEQ ID NO: 9266 - DNA, 20 bp, Artificial Sequence
  Description of Artificial Sequence: Synthetic oligonucleotide
  Target: DMPK; (-) strand; PAM type: NRG; PAM sequence: GGG
tgaggggctgggcggacgtg

SEQ ID NO: 9267 - DNA, 20 bp, Artificial Sequence
  Description of Artificial Sequence: Synthetic oligonucleotide
  Target: DMPK; (-) strand; PAM type: NRG; PAM sequence: GGG
gtgaggggctgggcggacgt

SEQ ID NO: 9268 - DNA, 20 bp, Artificial Sequence
  Description of Artificial Sequence: Synthetic oligonucleotide
  Target: DMPK; (-) strand; PAM type: NRG; PAM sequence: TGG
ggtgaggggctgggcggacg

SEQ ID NO: 9269 - DNA, 20 bp, Artificial Sequence
  Description of Artificial Sequence: Synthetic oligonucleotide
  Target: DMPK; (-) strand; PAM type: NRG; PAM sequence: CGG
gggcgaggtgaggggctggg

SEQ ID NO: 9270 - DNA, 20 bp, Artificial Sequence
  Description of Artificial Sequence: Synthetic oligonucleotide
  Target: DMPK; (-) strand; PAM type: NRG; PAM sequence: GGG
gaggggcgaggtgaggggct

SEQ ID NO: 9271 - DNA, 20 bp, Artificial Sequence
  Description of Artificial Sequence: Synthetic oligonucleotide
  Target: DMPK; (-) strand; PAM type: NRG; PAM sequence: TGG
agaggggcgaggtgaggggc

SEQ ID NO: 9272 - DNA, 20 bp, Artificial Sequence
  Description of Artificial Sequence: Synthetic oligonucleotide
  Target: DMPK; (-) strand; PAM type: NRG; PAM sequence: GGG
ctgaagaggggcgaggtgag

SEQ ID NO: 9273 - DNA, 20 bp, Artificial Sequence
  Description of Artificial Sequence: Synthetic oligonucleotide
  Target: DMPK; (-) strand; PAM type: NRG; PAM sequence: GGG
gctgaagaggggcgaggtga

SEQ ID NO: 9274 - DNA, 20 bp, Artificial Sequence
  Description of Artificial Sequence: Synthetic oligonucleotide
  Target: DMPK; (-) strand; PAM type: NRG; PAM sequence: AGG
tgctgaagaggggcgaggtg

SEQ ID NO: 9275 - DNA, 20 bp, Artificial Sequence
  Description of Artificial Sequence: Synthetic oligonucleotide
  Target: DMPK; (-) strand; PAM type: NRG; PAM sequence: GAG
atgctgaagaggggcgaggt

SEQ ID NO: 9276 - DNA, 20 bp, Artificial Sequence
  Description of Artificial Sequence: Synthetic oligonucleotide
  Target: DMPK; (-) strand; PAM type: NRG; PAM sequence: AGG
ggacatgctgaagaggggcg

SEQ ID NO: 9277 - DNA, 20 bp, Artificial Sequence
  Description of Artificial Sequence: Synthetic oligonucleotide
  Target: DMPK; (-) strand; PAM type: NRG; PAM sequence: GAG
gggacatgctgaagaggggc

SEQ ID NO: 9278 - DNA, 20 bp, Artificial Sequence
  Description of Artificial Sequence: Synthetic oligonucleotide
  Target: DMPK; (-) strand; PAM type: NRG; PAM sequence: GGG
aagtgggacatgctgaagag

SEQ ID NO: 9279 - DNA, 20 bp, Artificial Sequence
  Description of Artificial Sequence: Synthetic oligonucleotide
  Target: DMPK; (-) strand; PAM type: NRG; PAM sequence: GGG
caagtgggacatgctgaaga

SEQ ID NO: 9280 - DNA, 20 bp, Artificial Sequence
  Description of Artificial Sequence: Synthetic oligonucleotide
  Target: DMPK; (-) strand; PAM type: NRG; PAM sequence: AGG
acaagtgggacatgctgaag

SEQ ID NO: 9281 - DNA, 20 bp, Artificial Sequence
  Description of Artificial Sequence: Synthetic oligonucleotide
  Target: DMPK; (-) strand; PAM type: NRG; PAM sequence: GAG
aacaagtgggacatgctgaa

SEQ ID NO: 9282 - DNA, 20 bp, Artificial Sequence
  Description of Artificial Sequence: Synthetic oligonucleotide
  Target: DMPK; (-) strand; PAM type: NRG; PAM sequence: AAG
tgaacaagtgggacatgctg

SEQ ID NO: 9283 - DNA, 20 bp, Artificial Sequence
  Description of Artificial Sequence: Synthetic oligonucleotide
  Target: DMPK; (-) strand; PAM type: NRG; PAM sequence: GGG
catgaagatcatgaacaagt

SEQ ID NO: 9284 - DNA, 20 bp, Artificial Sequence
  Description of Artificial Sequence: Synthetic oligonucleotide
  Target: DMPK; (-) strand; PAM type: NRG; PAM sequence: TGG
ccatgaagatcatgaacaag

SEQ ID NO: 9285 - DNA, 20 bp, Artificial Sequence
  Description of Artificial Sequence: Synthetic oligonucleotide
  Target: DMPK; (-) strand; PAM type: NRG; PAM sequence: AAG
atgccatgaagatcatgaac

SEQ ID NO: 9286 - DNA, 20 bp, Artificial Sequence
  Description of Artificial Sequence: Synthetic oligonucleotide
  Target: DMPK; (-) strand; PAM type: NRG; PAM sequence: AAG
cgggccaggtgtatgccatg

SEQ ID NO: 9287 - DNA, 20 bp, Artificial Sequence
  Description of Artificial Sequence: Synthetic oligonucleotide
  Target: DMPK; (-) strand; PAM type: NRG; PAM sequence: AGG
gaagatgaagcagacgggcc

SEQ ID NO: 9288 - DNA, 20 bp, Artificial Sequence
  Description of Artificial Sequence: Synthetic oligonucleotide
  Target: DMPK; (-) strand; PAM type: NRG; PAM sequence: CAG
tgaagatgaagcagacgggc

SEQ ID NO: 9289 - DNA, 20 bp, Artificial Sequence
  Description of Artificial Sequence: Synthetic oligonucleotide
  Target: DMPK; (-) strand; PAM type: NRG; PAM sequence: GGG
gtagtgaagatgaagcagac

SEQ ID NO: 9290 - DNA, 20 bp, Artificial Sequence
  Description of Artificial Sequence: Synthetic oligonucleotide
  Target: DMPK; (-) strand; PAM type: NRG; PAM sequence: CGG
ggtagtgaagatgaagcaga

SEQ ID NO: 9291 - DNA, 20 bp, Artificial Sequence
  Description of Artificial Sequence: Synthetic oligonucleotide
  Target: DMPK; (-) strand; PAM type: NRG; PAM sequence: CAG
tagcggtagtgaagatgaag

SEQ ID NO: 9292 - DNA, 20 bp, Artificial Sequence
  Description of Artificial Sequence: Synthetic oligonucleotide
  Target: DMPK; (-) strand; PAM type: NRG; PAM sequence: AAG
aggtagcggtagtgaagatg

SEQ ID NO: 9293 - DNA, 20 bp, Artificial Sequence
  Description of Artificial Sequence: Synthetic oligonucleotide
  Target: DMPK; (-) strand; PAM type: NRG; PAM sequence: AAG
gacctcaggtagcggtagtg

SEQ ID NO: 9294 - DNA, 20 bp, Artificial Sequence
  Description of Artificial Sequence: Synthetic oligonucleotide
  Target: DMPK; (-) strand; PAM type: NRG; PAM sequence: TAG
atctcgacctcaggtagcgg

SEQ ID NO: 9295 - DNA, 20 bp, Artificial Sequence
  Description of Artificial Sequence: Synthetic oligonucleotide
  Target: DMPK; (-) strand; PAM type: NRG; PAM sequence: CGG
actatctcgacctcaggtag

SEQ ID NO: 9296 - DNA, 20 bp, Artificial Sequence
  Description of Artificial Sequence: Synthetic oligonucleotide
  Target: DMPK; (-) strand; PAM type: NRG; PAM sequence: TAG
ctcactatctcgacctcagg

SEQ ID NO: 9297 - DNA, 20 bp, Artificial Sequence
  Description of Artificial Sequence: Synthetic oligonucleotide
  Target: DMPK; (-) strand; PAM type: NRG; PAM sequence: AGG
tgtctcactatctcgacctc

SEQ ID NO: 9298 - DNA, 20 bp, Artificial Sequence
  Description of Artificial Sequence: Synthetic oligonucleotide
  Target: DMPK; (-) strand; PAM type: NRG; PAM sequence: CAG
ctgtctcactatctcgacct

SEQ ID NO: 9299 - DNA, 20 bp, Artificial Sequence
  Description of Artificial Sequence: Synthetic oligonucleotide
  Target: DMPK; (-) strand; PAM type: NRG; PAM sequence: GAG
gggtggagttgggtctgggc

SEQ ID NO: 9300 - DNA, 20 bp, Artificial Sequence
  Description of Artificial Sequence: Synthetic oligonucleotide
  Target: DMPK; (-) strand; PAM type: NRG; PAM sequence: GGG
aagcgggtggagttgggtct

SEQ ID NO: 9301 - DNA, 20 bp, Artificial Sequence
  Description of Artificial Sequence: Synthetic oligonucleotide
  Target: DMPK; (-) strand; PAM type: NRG; PAM sequence: TGG
gaagcgggtggagttgggtc

SEQ ID NO: 9302 - DNA, 20 bp, Artificial Sequence
  Description of Artificial Sequence: Synthetic oligonucleotide
  Target: DMPK; (-) strand; PAM type: NRG; PAM sequence: GGG
gtgcagaagcgggtggagtt

SEQ ID NO: 9303 - DNA, 20 bp, Artificial Sequence
  Description of Artificial Sequence: Synthetic oligonucleotide
  Target: DMPK; (-) strand; PAM type: NRG; PAM sequence: TGG
ggtgcagaagcgggtggagt

SEQ ID NO: 9304 - DNA, 20 bp, Artificial Sequence
  Description of Artificial Sequence: Synthetic oligonucleotide
  Target: DMPK; (-) strand; PAM type: NRG; PAM sequence: GAG
gctgggtgcagaagcgggtg

SEQ ID NO: 9305 - DNA, 20 bp, Artificial Sequence
  Description of Artificial Sequence: Synthetic oligonucleotide
  Target: DMPK; (-) strand; PAM type: NRG; PAM sequence: TGG
cggctgggtgcagaagcggg

SEQ ID NO: 9306 - DNA, 20 bp, Artificial Sequence
  Description of Artificial Sequence: Synthetic oligonucleotide
  Target: DMPK; (-) strand; PAM type: NRG; PAM sequence: GGG
ccacggctgggtgcagaagc

SEQ ID NO: 9307 - DNA, 20 bp, Artificial Sequence
  Description of Artificial Sequence: Synthetic oligonucleotide
  Target: DMPK; (-) strand; PAM type: NRG; PAM sequence: CGG
gccacggctgggtgcagaag

SEQ ID NO: 9308 - DNA, 20 bp, Artificial Sequence
  Description of Artificial Sequence: Synthetic oligonucleotide
  Target: DMPK; (-) strand; PAM type: NRG; PAM sequence: AAG
ggggccacggctgggtgcag

SEQ ID NO: 9309 - DNA, 20 bp, Artificial Sequence
  Description of Artificial Sequence: Synthetic oligonucleotide
  Target: DMPK; (-) strand; PAM type: NRG; PAM sequence: CAG
ggcggggccacggctgggtg

SEQ ID NO: 9310 - DNA, 20 bp, Artificial Sequence
  Description of Artificial Sequence: Synthetic oligonucleotide
  Target: DMPK; (-) strand; PAM type: NRG; PAM sequence: GGG
ggtggggcggggccacggct

SEQ ID NO: 9311 - DNA, 20 bp, Artificial Sequence
  Description of Artificial Sequence: Synthetic oligonucleotide
  Target: DMPK; (-) strand; PAM type: NRG; PAM sequence: TGG
aggtggggcggggccacggc

SEQ ID NO: 9312 - DNA, 20 bp, Artificial Sequence
  Description of Artificial Sequence: Synthetic oligonucleotide
  Target: DMPK; (-) strand; PAM type: NRG; PAM sequence: CGG
tggcaggtggggcggggcca

SEQ ID NO: 9313 - DNA, 20 bp, Artificial Sequence
  Description of Artificial Sequence: Synthetic oligonucleotide
  Target: DMPK; (-) strand; PAM type: NRG; PAM sequence: GGG
gtggtgtggcaggtggggcg

SEQ ID NO: 9314 - DNA, 20 bp, Artificial Sequence
  Description of Artificial Sequence: Synthetic oligonucleotide
  Target: DMPK; (-) strand; PAM type: NRG; PAM sequence: GGG
cgtggtgtggcaggtggggc

SEQ ID NO: 9315 - DNA, 20 bp, Artificial Sequence
  Description of Artificial Sequence: Synthetic oligonucleotide
  Target: DMPK; (-) strand; PAM type: NRG; PAM sequence: CGG
gcgtggtgtggcaggtgggg

SEQ ID NO: 9316 - DNA, 20 bp, Artificial Sequence
  Description of Artificial Sequence: Synthetic oligonucleotide
  Target: DMPK; (-) strand; PAM type: NRG; PAM sequence: GGG
tgggcgtggtgtggcaggtg

SEQ ID NO: 9317 - DNA, 20 bp, Artificial Sequence
  Description of Artificial Sequence: Synthetic oligonucleotide
  Target: DMPK; (-) strand; PAM type: NRG; PAM sequence: GGG
atgggcgtggtgtggcaggt

SEQ ID NO: 9318 - DNA, 20 bp, Artificial Sequence
  Description of Artificial Sequence: Synthetic oligonucleotide
  Target: DMPK; (-) strand; PAM type: NRG; PAM sequence: TGG
aatgggcgtggtgtggcagg

SEQ ID NO: 9319 - DNA, 20 bp, Artificial Sequence
  Description of Artificial Sequence: Synthetic oligonucleotide
  Target: DMPK; (-) strand; PAM type: NRG; PAM sequence: AGG
accaatgggcgtggtgtggc

SEQ ID NO: 9320 - DNA, 20 bp, Artificial Sequence
  Description of Artificial Sequence: Synthetic oligonucleotide
  Target: DMPK; (-) strand; PAM type: NRG; PAM sequence: CAG
gaccaatgggcgtggtgtgg

SEQ ID NO: 9321 - DNA, 20 bp, Artificial Sequence
  Description of Artificial Sequence: Synthetic oligonucleotide
  Target: DMPK; (-) strand; PAM type: NRG; PAM sequence: TGG
tgggaccaatgggcgtggtg

SEQ ID NO: 9322 - DNA, 20 bp, Artificial Sequence
  Description of Artificial Sequence: Synthetic oligonucleotide
  Target: DMPK; (-) strand; PAM type: NRG; PAM sequence: TGG
gggcttgggaccaatgggcg

SEQ ID NO: 9323 - DNA, 20 bp, Artificial Sequence
  Description of Artificial Sequence: Synthetic oligonucleotide
  Target: DMPK; (-) strand; PAM type: NRG; PAM sequence: GGG
aggcggggcttgggaccaat

SEQ ID NO: 9324 - DNA, 20 bp, Artificial Sequence
  Description of Artificial Sequence: Synthetic oligonucleotide
  Target: DMPK; (-) strand; PAM type: NRG; PAM sequence: TGG
gaggcggggcttgggaccaa

SEQ ID NO: 9325 - DNA, 20 bp, Artificial Sequence
  Description of Artificial Sequence: Synthetic oligonucleotide
  Target: DMPK; (-) strand; PAM type: NRG; PAM sequence: GGG
ctgggctggaggcggggctt

SEQ ID NO: 9326 - DNA, 20 bp, Artificial Sequence
  Description of Artificial Sequence: Synthetic oligonucleotide
  Target: DMPK; (-) strand; PAM type: NRG; PAM sequence: TGG
gctgggctggaggcggggct

SEQ ID NO: 9327 - DNA, 20 bp, Artificial Sequence
  Description of Artificial Sequence: Synthetic oligonucleotide
  Target: DMPK; (-) strand; PAM type: NRG; PAM sequence: GGG
ctagggctgggctggaggcg

SEQ ID NO: 9328 - DNA, 20 bp, Artificial Sequence
  Description of Artificial Sequence: Synthetic oligonucleotide
  Target: DMPK; (-) strand; PAM type: NRG; PAM sequence: GGG
cctagggctgggctggaggc

SEQ ID NO: 9329 - DNA, 20 bp, Artificial Sequence
  Description of Artificial Sequence: Synthetic oligonucleotide
  Target: DMPK; (-) strand; PAM type: NRG; PAM sequence: CGG
acctagggctgggctggagg

SEQ ID NO: 9330 - DNA, 20 bp, Artificial Sequence
  Description of Artificial Sequence: Synthetic oligonucleotide
  Target: DMPK; (-) strand; PAM type: NRG; PAM sequence: AGG
agaacctagggctgggctgg

SEQ ID NO: 9331 - DNA, 20 bp, Artificial Sequence
  Description of Artificial Sequence: Synthetic oligonucleotide
  Target: DMPK; (-) strand; PAM type: NRG; PAM sequence: GAG
tagaacctagggctgggctg

SEQ ID NO: 9332 - DNA, 20 bp, Artificial Sequence
  Description of Artificial Sequence: Synthetic oligonucleotide
  Target: DMPK; (-) strand; PAM type: NRG; PAM sequence: TGG
cttagaacctagggctgggc

SEQ ID NO: 9333 - DNA, 20 bp, Artificial Sequence
  Description of Artificial Sequence: Synthetic oligonucleotide
  Target: DMPK; (-) strand; PAM type: NRG; PAM sequence: GGG
gagccttagaacctagggct

SEQ ID NO: 9334 - DNA, 20 bp, Artificial Sequence
  Description of Artificial Sequence: Synthetic oligonucleotide
  Target: DMPK; (-) strand; PAM type: NRG; PAM sequence: TGG
cgagccttagaacctagggc

SEQ ID NO: 9335 - DNA, 20 bp, Artificial Sequence
  Description of Artificial Sequence: Synthetic oligonucleotide
  Target: DMPK; (-) strand; PAM type: NRG; PAM sequence: GGG
tgaccgagccttagaaccta

SEQ ID NO: 9336 - DNA, 20 bp, Artificial Sequence
  Description of Artificial Sequence: Synthetic oligonucleotide
  Target: DMPK; (-) strand; PAM type: NRG; PAM sequence: AGG
atgaccgagccttagaacct

SEQ ID NO: 9337 - DNA, 20 bp, Artificial Sequence
  Description of Artificial Sequence: Synthetic oligonucleotide
  Target: DMPK; (-) strand; PAM type: NRG; PAM sequence: TAG
aatgaccgagccttagaacc

SEQ ID NO: 9338 - DNA, 20 bp, Artificial Sequence
  Description of Artificial Sequence: Synthetic oligonucleotide
  Target: DMPK; (-) strand; PAM type: NRG; PAM sequence: TAG
attgatgaatgaccgagcct

SEQ ID NO: 9339 - DNA, 20 bp, Artificial Sequence
  Description of Artificial Sequence: Synthetic oligonucleotide
  Target: DMPK; (-) strand; PAM type: NRG; PAM sequence: GAG
ttagaaattgatgaatgacc

SEQ ID NO: 9340 - DNA, 20 bp, Artificial Sequence
  Description of Artificial Sequence: Synthetic oligonucleotide
  Target: DMPK; (-) strand; PAM type: NRG; PAM sequence: TAG
taggggttggggcggggcct

SEQ ID NO: 9341 - DNA, 20 bp, Artificial Sequence
  Description of Artificial Sequence: Synthetic oligonucleotide
  Target: DMPK; (-) strand; PAM type: NRG; PAM sequence: GGG
ggggcataggggttggggcg

SEQ ID NO: 9342 - DNA, 20 bp, Artificial Sequence
  Description of Artificial Sequence: Synthetic oligonucleotide
  Target: DMPK; (-) strand; PAM type: NRG; PAM sequence: GGG
cggggcataggggttggggc

SEQ ID NO: 9343 - DNA, 20 bp, Artificial Sequence
  Description of Artificial Sequence: Synthetic oligonucleotide
  Target: DMPK; (-) strand; PAM type: NRG; PAM sequence: CGG
gcggggcataggggttgggg

SEQ ID NO: 9344 - DNA, 20 bp, Artificial Sequence
  Description of Artificial Sequence: Synthetic oligonucleotide
  Target: DMPK; (-) strand; PAM type: NRG; PAM sequence: GGG
tgggcggggcataggggttg

SEQ ID NO: 9345 - DNA, 20 bp, Artificial Sequence
  Description of Artificial Sequence: Synthetic oligonucleotide
  Target: DMPK; (-) strand; PAM type: NRG; PAM sequence: GGG
gtgggcggggcataggggtt

SEQ ID NO: 9346 - DNA, 20 bp, Artificial Sequence
  Description of Artificial Sequence: Synthetic oligonucleotide
  Target: DMPK; (-) strand; PAM type: NRG; PAM sequence: TGG
ggtgggcggggcataggggt

SEQ ID NO: 9347 - DNA, 20 bp, Artificial Sequence
  Description of Artificial Sequence: Synthetic oligonucleotide
  Target: DMPK; (-) strand; PAM type: NRG; PAM sequence: GGG
tcgtggtgggcggggcatag

SEQ ID NO: 9348 - DNA, 20 bp, Artificial Sequence
  Description of Artificial Sequence: Synthetic oligonucleotide
  Target: DMPK; (-) strand; PAM type: NRG; PAM sequence: GGG
ctcgtggtgggcggggcata

SEQ ID NO: 9349 - DNA, 20 bp, Artificial Sequence
  Description of Artificial Sequence: Synthetic oligonucleotide
  Target: DMPK; (-) strand; PAM type: NRG; PAM sequence: AGG
actcgtggtgggcggggcat

SEQ ID NO: 9350 - DNA, 20 bp, Artificial Sequence
  Description of Artificial Sequence: Synthetic oligonucleotide
  Target: DMPK; (-) strand; PAM type: NRG; PAM sequence: TAG
gactcgtggtgggcggggca

SEQ ID NO: 9351 - DNA, 20 bp, Artificial Sequence
  Description of Artificial Sequence: Synthetic oligonucleotide
  Target: DMPK; (-) strand; PAM type: NRG; PAM sequence: GGG
gacttgactcgtggtgggcg

SEQ ID NO: 9352 - DNA, 20 bp, Artificial Sequence
  Description of Artificial Sequence: Synthetic oligonucleotide
  Target: DMPK; (-) strand; PAM type: NRG; PAM sequence: GGG
tgacttgactcgtggtgggc

SEQ ID NO: 9353 - DNA, 20 bp, Artificial Sequence
  Description of Artificial Sequence: Synthetic oligonucleotide
  Target: DMPK; (-) strand; PAM type: NRG; PAM sequence: CGG
ctgacttgactcgtggtggg

SEQ ID NO: 9354 - DNA, 20 bp, Artificial Sequence
  Description of Artificial Sequence: Synthetic oligonucleotide
  Target: DMPK; (-) strand; PAM type: NRG; PAM sequence: GGG
agcctgacttgactcgtggt

SEQ ID NO: 9355 - DNA, 20 bp, Artificial Sequence
  Description of Artificial Sequence: Synthetic oligonucleotide
  Target: DMPK; (-) strand; PAM type: NRG; PAM sequence: TGG
gagcctgacttgactcgtgg

SEQ ID NO: 9356 - DNA, 20 bp, Artificial Sequence
  Description of Artificial Sequence: Synthetic oligonucleotide
  Target: DMPK; (-) strand; PAM type: NRG; PAM sequence: TGG
cgggagcctgacttgactcg

SEQ ID NO: 9357 - DNA, 20 bp, Artificial Sequence
  Description of Artificial Sequence: Synthetic oligonucleotide
  Target: DMPK; (-) strand; PAM type: NRG; PAM sequence: GAG
aggtaagccgaaccgggcgg

SEQ ID NO: 9358 - DNA, 20 bp, Artificial Sequence
  Description of Artificial Sequence: Synthetic oligonucleotide
  Target: DMPK; (-) strand; PAM type: NRG; PAM sequence: GGG
cgaggtaagccgaaccgggc

SEQ ID NO: 9359 - DNA, 20 bp, Artificial Sequence
  Description of Artificial Sequence: Synthetic oligonucleotide
  Target: DMPK; (-) strand; PAM type: NRG; PAM sequence: CGG
gcgaggtaagccgaaccggg

SEQ ID NO: 9360 - DNA, 20 bp, Artificial Sequence
  Description of Artificial Sequence: Synthetic oligonucleotide
  Target: DMPK; (-) strand; PAM type: NRG; PAM sequence: GGG
tcagcgaggtaagccgaacc

SEQ ID NO: 9361 - DNA, 20 bp, Artificial Sequence
  Description of Artificial Sequence: Synthetic oligonucleotide
  Target: DMPK; (-) strand; PAM type: NRG; PAM sequence: CGG
ttcagcgaggtaagccgaac

SEQ ID NO: 9362 - DNA, 20 bp, Artificial Sequence
  Description of Artificial Sequence: Synthetic oligonucleotide
  Target: DMPK; (-) strand; PAM type: NRG; PAM sequence: AAG
cgcggggcgttcagcgaggt

SEQ ID NO: 9363 - DNA, 20 bp, Artificial Sequence
  Description of Artificial Sequence: Synthetic oligonucleotide
  Target: DMPK; (-) strand; PAM type: NRG; PAM sequence: AGG
cggacgcggggcgttcagcg

SEQ ID NO: 9364 - DNA, 20 bp, Artificial Sequence
  Description of Artificial Sequence: Synthetic oligonucleotide
  Target: DMPK; (-) strand; PAM type: NRG; PAM sequence: GAG
tcggacgcggggcgttcagc

SEQ ID NO: 9365 - DNA, 20 bp, Artificial Sequence
  Description of Artificial Sequence: Synthetic oligonucleotide
  Target: DMPK; (-) strand; PAM type: NRG; PAM sequence: CAG
gtgatcggacgcggggcgtt

SEQ ID NO: 9366 - DNA, 20 bp, Artificial Sequence
  Description of Artificial Sequence: Synthetic oligonucleotide
  Target: DMPK; (-) strand; PAM type: NRG; PAM sequence: GGG
tctgaaggtgatcggacgcg

SEQ ID NO: 9367 - DNA, 20 bp, Artificial Sequence
  Description of Artificial Sequence: Synthetic oligonucleotide
  Target: DMPK; (-) strand; PAM type: NRG; PAM sequence: GGG
ttctgaaggtgatcggacgc

SEQ ID NO: 9368 - DNA, 20 bp, Artificial Sequence
  Description of Artificial Sequence: Synthetic oligonucleotide
  Target: DMPK; (-) strand; PAM type: NRG; PAM sequence: CGG
attctgaaggtgatcggacg

SEQ ID NO: 9369 - DNA, 20 bp, Artificial Sequence
  Description of Artificial Sequence: Synthetic oligonucleotide
  Target: DMPK; (-) strand; PAM type: NRG; PAM sequence: CGG
ttcgagattctgaaggtgat

SEQ ID NO: 9370 - DNA, 20 bp, Artificial Sequence
  Description of Artificial Sequence: Synthetic oligonucleotide
  Target: DMPK; (-) strand; PAM type: NRG; PAM sequence: AGG
ggacgacttcgagattctga

SEQ ID NO: 9371 - DNA, 20 bp, Artificial Sequence
  Description of Artificial Sequence: Synthetic oligonucleotide
  Target: DMPK; (-) strand; PAM type: NRG; PAM sequence: AAG
gggacgacttcgagattctg

SEQ ID NO: 9372 - DNA, 20 bp, Artificial Sequence
  Description of Artificial Sequence: Synthetic oligonucleotide
  Target: DMPK; (-) strand; PAM type: NRG; PAM sequence: GAG
gactgcagagggacgacttc

SEQ ID NO: 9373 - DNA, 20 bp, Artificial Sequence
  Description of Artificial Sequence: Synthetic oligonucleotide
  Target: DMPK; (-) strand; PAM type: NRG; PAM sequence: GGG
taaggaggtccgactgcaga

SEQ ID NO: 9374 - DNA, 20 bp, Artificial Sequence
  Description of Artificial Sequence: Synthetic oligonucleotide
  Target: DMPK; (-) strand; PAM type: NRG; PAM sequence: AGG
ttaaggaggtccgactgcag

SEQ ID NO: 9375 - DNA, 20 bp, Artificial Sequence
  Description of Artificial Sequence: Synthetic oligonucleotide
  Target: DMPK; (-) strand; PAM type: NRG; PAM sequence: GAG
cttaaggaggtccgactgca

SEQ ID NO: 9376 - DNA, 20 bp, Artificial Sequence
  Description of Artificial Sequence: Synthetic oligonucleotide
  Target: DMPK; (-) strand; PAM type: NRG; PAM sequence: CAG
ggcttaaggaggtccgactg

SEQ ID NO: 9377 - DNA, 20 bp, Artificial Sequence
  Description of Artificial Sequence: Synthetic oligonucleotide
  Target: DMPK; (-) strand; PAM type: NRG; PAM sequence: AGG
catcgtggtgaggcttaagg

SEQ ID NO: 9378 - DNA, 20 bp, Artificial Sequence
  Description of Artificial Sequence: Synthetic oligonucleotide
  Target: DMPK; (-) strand; PAM type: NRG; PAM sequence: GAG
ccatcgtggtgaggcttaag

SEQ ID NO: 9379 - DNA, 20 bp, Artificial Sequence
  Description of Artificial Sequence: Synthetic oligonucleotide
  Target: DMPK; (-) strand; PAM type: NRG; PAM sequence: AGG
gcccatcgtggtgaggctta

SEQ ID NO: 9380 - DNA, 20 bp, Artificial Sequence
  Description of Artificial Sequence: Synthetic oligonucleotide
  Target: DMPK; (-) strand; PAM type: NRG; PAM sequence: AAG
agcccatcgtggtgaggctt

SEQ ID NO: 9381 - DNA, 20 bp, Artificial Sequence
  Description of Artificial Sequence: Synthetic oligonucleotide
  Target: DMPK; (-) strand; PAM type: NRG; PAM sequence: AGG
cagcggagcccatcgtggtg

SEQ ID NO: 9382 - DNA, 20 bp, Artificial Sequence
  Description of Artificial Sequence: Synthetic oligonucleotide
  Target: DMPK; (-) strand; PAM type: NRG; PAM sequence: GAG
ccagcggagcccatcgtggt

SEQ ID NO: 9383 - DNA, 20 bp, Artificial Sequence
  Description of Artificial Sequence: Synthetic oligonucleotide
  Target: DMPK; (-) strand; PAM type: NRG; PAM sequence: TGG
ccccccagcggagcccatcg

SEQ ID NO: 9384 - DNA, 20 bp, Artificial Sequence
  Description of Artificial Sequence: Synthetic oligonucleotide
  Target: DMPK; (-) strand; PAM type: NRG; PAM sequence: GAG
cccccaccacccccccagcg

SEQ ID NO: 9385 - DNA, 20 bp, Artificial Sequence
  Description of Artificial Sequence: Synthetic oligonucleotide
  Target: DMPK; (-) strand; PAM type: NRG; PAM sequence: CGG
ttcccccaccacccccccag

SEQ ID NO: 9386 - DNA, 20 bp, Artificial Sequence
  Description of Artificial Sequence: Synthetic oligonucleotide
  Target: DMPK; (-) strand; PAM type: NRG; PAM sequence: CAG
cttttcccccaccacccccc

SEQ ID NO: 9387 - DNA, 20 bp, Artificial Sequence
  Description of Artificial Sequence: Synthetic oligonucleotide
  Target: DMPK; (-) strand; PAM type: NRG; PAM sequence: CGG
gtgccctttctggtgaccct

SEQ ID NO: 9388 - DNA, 20 bp, Artificial Sequence
  Description of Artificial Sequence: Synthetic oligonucleotide
  Target: DMPK; (-) strand; PAM type: NRG; PAM sequence: TGG
cttgtctccagtgccctttc

SEQ ID NO: 9389 - DNA, 20 bp, Artificial Sequence
  Description of Artificial Sequence: Synthetic oligonucleotide
  Target: DMPK; (-) strand; PAM type: NRG; PAM sequence: CAG
ggggctttcccccttgtctc

SEQ ID NO: 9390 - DNA, 20 bp, Artificial Sequence
  Description of Artificial Sequence: Synthetic oligonucleotide
  Target: DMPK; (-) strand; PAM type: NRG; PAM sequence: GGG
ggggagacagacagagggtg

SEQ ID NO: 9391 - DNA, 20 bp, Artificial Sequence
  Description of Artificial Sequence: Synthetic oligonucleotide
  Target: DMPK; (-) strand; PAM type: NRG; PAM sequence: GGG
aggggagacagacagagggt

SEQ ID NO: 9392 - DNA, 20 bp, Artificial Sequence
  Description of Artificial Sequence: Synthetic oligonucleotide
  Target: DMPK; (-) strand; PAM type: NRG; PAM sequence: TGG
aaggggagacagacagaggg

SEQ ID NO: 9393 - DNA, 20 bp, Artificial Sequence
  Description of Artificial Sequence: Synthetic oligonucleotide
  Target: DMPK; (-) strand; PAM type: NRG; PAM sequence: GGG
gagaaggggagacagacaga

SEQ ID NO: 9394 - DNA, 20 bp, Artificial Sequence
  Description of Artificial Sequence: Synthetic oligonucleotide
  Target: DMPK; (-) strand; PAM type: NRG; PAM sequence: AGG
agagaaggggagacagacag

SEQ ID NO: 9395 - DNA, 20 bp, Artificial Sequence
  Description of Artificial Sequence: Synthetic oligonucleotide
  Target: DMPK; (-) strand; PAM type: NRG; PAM sequence: GAG
gagagaaggggagacagaca

SEQ ID NO: 9396 - DNA, 20 bp, Artificial Sequence
  Description of Artificial Sequence: Synthetic oligonucleotide
  Target: DMPK; (-) strand; PAM type: NRG; PAM sequence: CAG
cagagagaaggggagacaga

SEQ ID NO: 9397 - DNA, 20 bp, Artificial Sequence
  Description of Artificial Sequence: Synthetic oligonucleotide
  Target: DMPK; (-) strand; PAM type: NRG; PAM sequence: CAG
gaggcagagagaaggggaga

SEQ ID NO: 9398 - DNA, 20 bp, Artificial Sequence
  Description of Artificial Sequence: Synthetic oligonucleotide
  Target: DMPK; (-) strand; PAM type: NRG; PAM sequence: GAG
ctgagaggcagagagaaggg

SEQ ID NO: 9399 - DNA, 20 bp, Artificial Sequence
  Description of Artificial Sequence: Synthetic oligonucleotide
  Target: DMPK; (-) strand; PAM type: NRG; PAM sequence: GGG
agctgagaggcagagagaag

SEQ ID NO: 9400 - DNA, 20 bp, Artificial Sequence
  Description of Artificial Sequence: Synthetic oligonucleotide
  Target: DMPK; (-) strand; PAM type: NRG; PAM sequence: GGG
aagctgagaggcagagagaa

SEQ ID NO: 9401 - DNA, 20 bp, Artificial Sequence
  Description of Artificial Sequence: Synthetic oligonucleotide
  Target: DMPK; (-) strand; PAM type: NRG; PAM sequence: AGG
gaagctgagaggcagagaga

SEQ ID NO: 9402 - DNA, 20 bp, Artificial Sequence
  Description of Artificial Sequence: Synthetic oligonucleotide
  Target: DMPK; (-) strand; PAM type: NRG; PAM sequence: AAG
tgaagctgagaggcagagag

SEQ ID NO: 9403 - DNA, 20 bp, Artificial Sequence
  Description of Artificial Sequence: Synthetic oligonucleotide
  Target: DMPK; (-) strand; PAM type: NRG; PAM sequence: GAG
gggtgaagctgagaggcaga

SEQ ID NO: 9404 - DNA, 20 bp, Artificial Sequence
  Description of Artificial Sequence: Synthetic oligonucleotide
  Target: DMPK; (-) strand; PAM type: NRG; PAM sequence: GAG
tagggtgaagctgagaggca

SEQ ID NO: 9405 - DNA, 20 bp, Artificial Sequence
  Description of Artificial Sequence: Synthetic oligonucleotide
  Target: DMPK; (-) strand; PAM type: NRG; PAM sequence: CAG
cctagggtgaagctgagagg

SEQ ID NO: 9406 - DNA, 20 bp, Artificial Sequence
  Description of Artificial Sequence: Synthetic oligonucleotide
  Target: DMPK; (-) strand; PAM type: NRG; PAM sequence: AGG
agtcctagggtgaagctgag

SEQ ID NO: 9407 - DNA, 20 bp, Artificial Sequence
  Description of Artificial Sequence: Synthetic oligonucleotide
  Target: DMPK; (-) strand; PAM type: NRG; PAM sequence: GAG
cagtcctagggtgaagctga

SEQ ID NO: 9408 - DNA, 20 bp, Artificial Sequence
  Description of Artificial Sequence: Synthetic oligonucleotide
  Target: DMPK; (-) strand; PAM type: NRG; PAM sequence: GAG
gacagtcctagggtgaagct

SEQ ID NO: 9409 - DNA, 20 bp, Artificial Sequence
  Description of Artificial Sequence: Synthetic oligonucleotide
  Target: DMPK; (-) strand; PAM type: NRG; PAM sequence: AAG
aagcagacagtcctagggtg

SEQ ID NO: 9410 - DNA, 20 bp, Artificial Sequence
  Description of Artificial Sequence: Synthetic oligonucleotide
  Target: DMPK; (-) strand; PAM type: NRG; PAM sequence: GGG
ctgggaagcagacagtccta

SEQ ID NO: 9411 - DNA, 20 bp, Artificial Sequence
  Description of Artificial Sequence: Synthetic oligonucleotide
  Target: DMPK; (-) strand; PAM type: NRG; PAM sequence: AGG
cctgggaagcagacagtcct

SEQ ID NO: 9412 - DNA, 20 bp, Artificial Sequence
  Description of Artificial Sequence: Synthetic oligonucleotide
  Target: DMPK; (-) strand; PAM type: NRG; PAM sequence: TAG
ccctgggaagcagacagtcc

SEQ ID NO: 9413 - DNA, 20 bp, Artificial Sequence
  Description of Artificial Sequence: Synthetic oligonucleotide
  Target: DMPK; (-) strand; PAM type: NRG; PAM sequence: CAG
ggaagcccctgggaagcaga

SEQ ID NO: 9414 - DNA, 20 bp, Artificial Sequence
  Description of Artificial Sequence: Synthetic oligonucleotide
  Target: DMPK; (-) strand; PAM type: NRG; PAM sequence: CAG
gtggggaagcccctgggaag

SEQ ID NO: 9415 - DNA, 20 bp, Artificial Sequence
  Description of Artificial Sequence: Synthetic oligonucleotide
  Target: DMPK; (-) strand; PAM type: NRG; PAM sequence: AAG
tatgtggggaagcccctggg

SEQ ID NO: 9416 - DNA, 20 bp, Artificial Sequence
  Description of Artificial Sequence: Synthetic oligonucleotide
  Target: DMPK; (-) strand; PAM type: NRG; PAM sequence: GGG
gtttatgtggggaagcccct

SEQ ID NO: 9417 - DNA, 20 bp, Artificial Sequence
  Description of Artificial Sequence: Synthetic oligonucleotide
  Target: DMPK; (-) strand; PAM type: NRG; PAM sequence: TGG
tgtttatgtggggaagcccc

SEQ ID NO: 9418 - DNA, 20 bp, Artificial Sequence
  Description of Artificial Sequence: Synthetic oligonucleotide
  Target: DMPK; (-) strand; PAM type: NRG; PAM sequence: AAG
tacacggtgtttatgtgggg

SEQ ID NO: 9419 - DNA, 20 bp, Artificial Sequence
  Description of Artificial Sequence: Synthetic oligonucleotide
  Target: DMPK; (-) strand; PAM type: NRG; PAM sequence: GGG
ccttacacggtgtttatgtg

SEQ ID NO: 9420 - DNA, 20 bp, Artificial Sequence
  Description of Artificial Sequence: Synthetic oligonucleotide
  Target: DMPK; (-) strand; PAM type: NRG; PAM sequence: GGG
accttacacggtgtttatgt

SEQ ID NO: 9421 - DNA, 20 bp, Artificial Sequence
  Description of Artificial Sequence: Synthetic oligonucleotide
  Target: DMPK; (-) strand; PAM type: NRG; PAM sequence: TGG
aaccttacacggtgtttatg

SEQ ID NO: 9422 - DNA, 20 bp, Artificial Sequence
  Description of Artificial Sequence: Synthetic oligonucleotide
  Target: DMPK; (-) strand; PAM type: NRG; PAM sequence: CGG
ttggcccccagaaccttaca

SEQ ID NO: 9423 - DNA, 20 bp, Artificial Sequence
  Description of Artificial Sequence: Synthetic oligonucleotide
  Target: DMPK; (-) strand; PAM type: NRG; PAM sequence: CAG
gggagggcatttttggcccc

SEQ ID NO: 9424 - DNA, 20 bp, Artificial Sequence
  Description of Artificial Sequence: Synthetic oligonucleotide
  Target: DMPK; (-) strand; PAM type: NRG; PAM sequence: TGG
cctctatgggagggcatttt

SEQ ID NO: 9425 - DNA, 20 bp, Artificial Sequence
  Description of Artificial Sequence: Synthetic oligonucleotide
  Target: DMPK; (-) strand; PAM type: NRG; PAM sequence: GGG
ggcatctcacctctatggga

SEQ ID NO: 9426 - DNA, 20 bp, Artificial Sequence
  Description of Artificial Sequence: Synthetic oligonucleotide
  Target: DMPK; (-) strand; PAM type: NRG; PAM sequence: AGG
aggcatctcacctctatggg

SEQ ID NO: 9427 - DNA, 20 bp, Artificial Sequence
  Description of Artificial Sequence: Synthetic oligonucleotide
  Target: DMPK; (-) strand; PAM type: NRG; PAM sequence: GAG
caggcatctcacctctatgg

SEQ ID NO: 9428 - DNA, 20 bp, Artificial Sequence
  Description of Artificial Sequence: Synthetic oligonucleotide
  Target: DMPK; (-) strand; PAM type: NRG; PAM sequence: GGG
ctcaggcatctcacctctat

SEQ ID NO: 9429 - DNA, 20 bp, Artificial Sequence
  Description of Artificial Sequence: Synthetic oligonucleotide
  Target: DMPK; (-) strand; PAM type: NRG; PAM sequence: TGG
tctcaggcatctcacctcta

SEQ ID NO: 9430 - DNA, 20 bp, Artificial Sequence
  Description of Artificial Sequence: Synthetic oligonucleotide
  Target: DMPK; (-) strand; PAM type: NRG; PAM sequence: AGG
tgtcccgcaaagggcttctc

SEQ ID NO: 9431 - DNA, 20 bp, Artificial Sequence
  Description of Artificial Sequence: Synthetic oligonucleotide
  Target: DMPK; (-) strand; PAM type: NRG; PAM sequence: CAG
ctgtcccgcaaagggcttct

SEQ ID NO: 9432 - DNA, 20 bp, Artificial Sequence
  Description of Artificial Sequence: Synthetic oligonucleotide
  Target: DMPK; (-) strand; PAM type: NRG; PAM sequence: GGG
ccaatgccctgtcccgcaaa

SEQ ID NO: 9433 - DNA, 20 bp, Artificial Sequence
  Description of Artificial Sequence: Synthetic oligonucleotide
  Target: DMPK; (-) strand; PAM type: NRG; PAM sequence: AGG
gccaatgccctgtcccgcaa

SEQ ID NO: 9434 - DNA, 20 bp, Artificial Sequence
  Description of Artificial Sequence: Synthetic oligonucleotide
  Target: DMPK; (-) strand; PAM type: NRG; PAM sequence: AAG
ggccaatgccctgtcccgca

SEQ ID NO: 9435 - DNA, 20 bp, Artificial Sequence
  Description of Artificial Sequence: Synthetic oligonucleotide
  Target: DMPK; (-) strand; PAM type: NRG; PAM sequence: GGG
gcacacccttggagccctct

SEQ ID NO: 9436 - DNA, 20 bp, Artificial Sequence
  Description of Artificial Sequence: Synthetic oligonucleotide
  Target: DMPK; (-) strand; PAM type: NRG; PAM sequence: TGG
tgcacacccttggagccctc

SEQ ID NO: 9437 - DNA, 20 bp, Artificial Sequence
  Description of Artificial Sequence: Synthetic oligonucleotide
  Target: DMPK; (-) strand; PAM type: NRG; PAM sequence: GAG
aaccatcctgcacacccttg

SEQ ID NO: 9438 - DNA, 20 bp, Artificial Sequence
  Description of Artificial Sequence: Synthetic oligonucleotide
  Target: DMPK; (-) strand; PAM type: NRG; PAM sequence: TGG
ctaaccatcctgcacaccct

SEQ ID NO: 9439 - DNA, 20 bp, Artificial Sequence
  Description of Artificial Sequence: Synthetic oligonucleotide
  Target: DMPK; (-) strand; PAM type: NRG; PAM sequence: CAG
ctttagggtctgtccttctg

SEQ ID NO: 9440 - DNA, 20 bp, Artificial Sequence
  Description of Artificial Sequence: Synthetic oligonucleotide
  Target: DMPK; (-) strand; PAM type: NRG; PAM sequence: GGG
ccttctccccttgttcttta

SEQ ID NO: 9441 - DNA, 20 bp, Artificial Sequence
  Description of Artificial Sequence: Synthetic oligonucleotide
  Target: DMPK; (-) strand; PAM type: NRG; PAM sequence: AGG
tccttctccccttgttcttt

SEQ ID NO: 9442 - DNA, 20 bp, Artificial Sequence
  Description of Artificial Sequence: Synthetic oligonucleotide
  Target: DMPK; (-) strand; PAM type: NRG; PAM sequence: TAG
ttccttctccccttgttctt

SEQ ID NO: 9443 - DNA, 20 bp, Artificial Sequence
  Description of Artificial Sequence: Synthetic oligonucleotide
  Target: DMPK; (-) strand; PAM type: NRG; PAM sequence: GGG
gggtggaaggtggaagaact

SEQ ID NO: 9444 - DNA, 20 bp, Artificial Sequence
  Description of Artificial Sequence: Synthetic oligonucleotide
  Target: DMPK; (-) strand; PAM type: NRG; PAM sequence: TGG
agggtggaaggtggaagaac

SEQ ID NO: 9445 - DNA, 20 bp, Artificial Sequence
  Description of Artificial Sequence: Synthetic oligonucleotide
  Target: DMPK; (-) strand; PAM type: NRG; PAM sequence: AAG
ggagtcagggtggaaggtgg

SEQ ID NO: 9446 - DNA, 20 bp, Artificial Sequence
  Description of Artificial Sequence: Synthetic oligonucleotide
  Target: DMPK; (-) strand; PAM type: NRG; PAM sequence: TGG
cctggagtcagggtggaagg

SEQ ID NO: 9447 - DNA, 20 bp, Artificial Sequence
  Description of Artificial Sequence: Synthetic oligonucleotide
  Target: DMPK; (-) strand; PAM type: NRG; PAM sequence: AGG
tcacctggagtcagggtgga

SEQ ID NO: 9448 - DNA, 20 bp, Artificial Sequence
  Description of Artificial Sequence: Synthetic oligonucleotide
  Target: DMPK; (-) strand; PAM type: NRG; PAM sequence: AAG
gtcacctggagtcagggtgg

SEQ ID NO: 9449 - DNA, 20 bp, Artificial Sequence
  Description of Artificial Sequence: Synthetic oligonucleotide
  Target: DMPK; (-) strand; PAM type: NRG; PAM sequence: TGG
actgtcacctggagtcaggg

SEQ ID NO: 9450 - DNA, 20 bp, Artificial Sequence
  Description of Artificial Sequence: Synthetic oligonucleotide
  Target: DMPK; (-) strand; PAM type: NRG; PAM sequence: GGG
tgaactgtcacctggagtca

SEQ ID NO: 9451 - DNA, 20 bp, Artificial Sequence
  Description of Artificial Sequence: Synthetic oligonucleotide
  Target: DMPK; (-) strand; PAM type: NRG; PAM sequence: AGG
ctgaactgtcacctggagtc

SEQ ID NO: 9452 - DNA, 20 bp, Artificial Sequence
  Description of Artificial Sequence: Synthetic oligonucleotide
  Target: DMPK; (-) strand; PAM type: NRG; PAM sequence: CAG
cctgaactgtcacctggagt

SEQ ID NO: 9453 - DNA, 20 bp, Artificial Sequence
  Description of Artificial Sequence: Synthetic oligonucleotide
  Target: DMPK; (-) strand; PAM type: NRG; PAM sequence: GAG
tgcacctgaactgtcacctg

SEQ ID NO: 9454 - DNA, 20 bp, Artificial Sequence
  Description of Artificial Sequence: Synthetic oligonucleotide
  Target: DMPK; (-) strand; PAM type: NRG; PAM sequence: TGG
gctgcacctgaactgtcacc

SEQ ID NO: 9455 - DNA, 20 bp, Artificial Sequence
  Description of Artificial Sequence: Synthetic oligonucleotide
  Target: DMPK; (-) strand; PAM type: NRG; PAM sequence: TGG
agaacgtgggggtggggccc

SEQ ID NO: 9456 - DNA, 20 bp, Artificial Sequence
  Description of Artificial Sequence: Synthetic oligonucleotide
  Target: DMPK; (-) strand; PAM type: NRG; PAM sequence: GGG
tacatgagaacgtgggggtg

SEQ ID NO: 9457 - DNA, 20 bp, Artificial Sequence
  Description of Artificial Sequence: Synthetic oligonucleotide
  Target: DMPK; (-) strand; PAM type: NRG; PAM sequence: GGG
ctacatgagaacgtgggggt

SEQ ID NO: 9458 - DNA, 20 bp, Artificial Sequence
  Description of Artificial Sequence: Synthetic oligonucleotide
  Target: DMPK; (-) strand; PAM type: NRG; PAM sequence: TGG
tctacatgagaacgtggggg

SEQ ID NO: 9459 - DNA, 20 bp, Artificial Sequence
  Description of Artificial Sequence: Synthetic oligonucleotide
  Target: DMPK; (-) strand; PAM type: NRG; PAM sequence: GGG
cattctacatgagaacgtgg

SEQ ID NO: 9460 - DNA, 20 bp, Artificial Sequence
  Description of Artificial Sequence: Synthetic oligonucleotide
  Target: DMPK; (-) strand; PAM type: NRG; PAM sequence: GGG
acattctacatgagaacgtg

SEQ ID NO: 9461 - DNA, 20 bp, Artificial Sequence
  Description of Artificial Sequence: Synthetic oligonucleotide
  Target: DMPK; (-) strand; PAM type: NRG; PAM sequence: GGG
gacattctacatgagaacgt

SEQ ID NO: 9462 - DNA, 20 bp, Artificial Sequence
  Description of Artificial Sequence: Synthetic oligonucleotide
  Target: DMPK; (-) strand; PAM type: NRG; PAM sequence: TGG
ggacattctacatgagaacg

SEQ ID NO: 9463 - DNA, 20 bp, Artificial Sequence
  Description of Artificial Sequence: Synthetic oligonucleotide
  Target: DMPK; (-) strand; PAM type: NRG; PAM sequence: GAG
ttacccaggacattctacat

SEQ ID NO: 9464 - DNA, 20 bp, Artificial Sequence
  Description of Artificial Sequence: Synthetic oligonucleotide
  Target: DMPK; (-) strand; PAM type: NRG; PAM sequence: AGG
ccacgtctgggccgttaccc

SEQ ID NO: 9465 - DNA, 20 bp, Artificial Sequence
  Description of Artificial Sequence: Synthetic oligonucleotide
  Target: DMPK; (-) strand; PAM type: NRG; PAM sequence: CAG
cccacgtctgggccgttacc

SEQ ID NO: 9466 - DNA, 20 bp, Artificial Sequence
  Description of Artificial Sequence: Synthetic oligonucleotide
  Target: DMPK; (-) strand; PAM type: NRG; PAM sequence: GGG
ctggatacaaccccacgtct

SEQ ID NO: 9467 - DNA, 20 bp, Artificial Sequence
  Description of Artificial Sequence: Synthetic oligonucleotide
  Target: DMPK; (-) strand; PAM type: NRG; PAM sequence: TGG
actggatacaaccccacgtc

SEQ ID NO: 9468 - DNA, 20 bp, Artificial Sequence
  Description of Artificial Sequence: Synthetic oligonucleotide
  Target: DMPK; (-) strand; PAM type: NRG; PAM sequence: TGG
gcatctgaatctagaggtac

SEQ ID NO: 9469 - DNA, 20 bp, Artificial Sequence
  Description of Artificial Sequence: Synthetic oligonucleotide
  Target: DMPK; (-) strand; PAM type: NRG; PAM sequence: AGG
ccacctgcatctgaatctag

SEQ ID NO: 9470 - DNA, 20 bp, Artificial Sequence
  Description of Artificial Sequence: Synthetic oligonucleotide
  Target: DMPK; (-) strand; PAM type: NRG; PAM sequence: GAG
accacctgcatctgaatcta

SEQ ID NO: 9471 - DNA, 20 bp, Artificial Sequence
  Description of Artificial Sequence: Synthetic oligonucleotide
  Target: DMPK; (-) strand; PAM type: NRG; PAM sequence: TAG
gaaccacctgcatctgaatc

SEQ ID NO: 9472 - DNA, 20 bp, Artificial Sequence
  Description of Artificial Sequence: Synthetic oligonucleotide
  Target: DMPK; (-) strand; PAM type: NRG; PAM sequence: AAG
ggttttccaaagtgtggttc

SEQ ID NO: 9473 - DNA, 20 bp, Artificial Sequence
  Description of Artificial Sequence: Synthetic oligonucleotide
  Target: DMPK; (-) strand; PAM type: NRG; PAM sequence: TGG
atccagggttttccaaagtg

SEQ ID NO: 9474 - DNA, 20 bp, Artificial Sequence
  Description of Artificial Sequence: Synthetic oligonucleotide
  Target: DMPK; (-) strand; PAM type: NRG; PAM sequence: AAG
cccaaatccagggttttcca

SEQ ID NO: 9475 - DNA, 20 bp, Artificial Sequence
  Description of Artificial Sequence: Synthetic oligonucleotide
  Target: DMPK; (-) strand; PAM type: NRG; PAM sequence: GGG
ttcccccagccccaaatcca

SEQ ID NO: 9476 - DNA, 20 bp, Artificial Sequence
  Description of Artificial Sequence: Synthetic oligonucleotide
  Target: DMPK; (-) strand; PAM type: NRG; PAM sequence: AGG
cttcccccagccccaaatcc

SEQ ID NO: 9477 - DNA, 20 bp, Artificial Sequence
  Description of Artificial Sequence: Synthetic oligonucleotide
  Target: DMPK; (-) strand; PAM type: NRG; PAM sequence: CAG
ccttcccccagccccaaatc

SEQ ID NO: 9478 - DNA, 20 bp, Artificial Sequence
  Description of Artificial Sequence: Synthetic oligonucleotide
  Target: DMPK; (-) strand; PAM type: NRG; PAM sequence: CAG
ccctgtcctgttccttcccc

SEQ ID NO: 9479 - DNA, 20 bp, Artificial Sequence
  Description of Artificial Sequence: Synthetic oligonucleotide
  Target: DMPK; (-) strand; PAM type: NRG; PAM sequence: GGG
ggaccggagcacttgagtct

SEQ ID NO: 9480 - DNA, 20 bp, Artificial Sequence
  Description of Artificial Sequence: Synthetic oligonucleotide
  Target: DMPK; (-) strand; PAM type: NRG; PAM sequence: TGG
tggaccggagcacttgagtc

SEQ ID NO: 9481 - DNA, 20 bp, Artificial Sequence
  Description of Artificial Sequence: Synthetic oligonucleotide
  Target: DMPK; (-) strand; PAM type: NRG; PAM sequence: GAG
tgggctggaccggagcactt

SEQ ID NO: 9482 - DNA, 20 bp, Artificial Sequence
  Description of Artificial Sequence: Synthetic oligonucleotide
  Target: DMPK; (-) strand; PAM type: NRG; PAM sequence: GAG
ctgagagatgggctggaccg

SEQ ID NO: 9483 - DNA, 20 bp, Artificial Sequence
  Description of Artificial Sequence: Synthetic oligonucleotide
  Target: DMPK; (-) strand; PAM type: NRG; PAM sequence: CGG
gactgagagatgggctggac

SEQ ID NO: 9484 - DNA, 20 bp, Artificial Sequence
  Description of Artificial Sequence: Synthetic oligonucleotide
  Target: DMPK; (-) strand; PAM type: NRG; PAM sequence: TGG
tggaggactgagagatgggc

SEQ ID NO: 9485 - DNA, 20 bp, Artificial Sequence
  Description of Artificial Sequence: Synthetic oligonucleotide
  Target: DMPK; (-) strand; PAM type: NRG; PAM sequence: GGG
ctcctggaggactgagagat

SEQ ID NO: 9486 - DNA, 20 bp, Artificial Sequence
  Description of Artificial Sequence: Synthetic oligonucleotide
  Target: DMPK; (-) strand; PAM type: NRG; PAM sequence: TGG
cctcctggaggactgagaga

SEQ ID NO: 9487 - DNA, 20 bp, Artificial Sequence
  Description of Artificial Sequence: Synthetic oligonucleotide
  Target: DMPK; (-) strand; PAM type: NRG; PAM sequence: GAG
cactcctcctggaggactga

SEQ ID NO: 9488 - DNA, 20 bp, Artificial Sequence
  Description of Artificial Sequence: Synthetic oligonucleotide
  Target: DMPK; (-) strand; PAM type: NRG; PAM sequence: GAG
agcactcctcctggaggact

SEQ ID NO: 9489 - DNA, 20 bp, Artificial Sequence
  Description of Artificial Sequence: Synthetic oligonucleotide
  Target: DMPK; (-) strand; PAM type: NRG; PAM sequence: AGG
gactaaagcactcctcctgg

SEQ ID NO: 9490 - DNA, 20 bp, Artificial Sequence
  Description of Artificial Sequence: Synthetic oligonucleotide
  Target: DMPK; (-) strand; PAM type: NRG; PAM sequence: GAG
ggactaaagcactcctcctg

SEQ ID NO: 9491 - DNA, 20 bp, Artificial Sequence
  Description of Artificial Sequence: Synthetic oligonucleotide
  Target: DMPK; (-) strand; PAM type: NRG; PAM sequence: TGG
taggactaaagcactcctcc

SEQ ID NO: 9492 - DNA, 20 bp, Artificial Sequence
  Description of Artificial Sequence: Synthetic oligonucleotide
  Target: DMPK; (-) strand; PAM type: NRG; PAM sequence: AAG
gtaaataaggggtaggacta

SEQ ID NO: 9493 - DNA, 20 bp, Artificial Sequence
  Description of Artificial Sequence: Synthetic oligonucleotide
  Target: DMPK; (-) strand; PAM type: NRG; PAM sequence: AGG
gtcatctgtaaataaggggt

SEQ ID NO: 9494 - DNA, 20 bp, Artificial Sequence
  Description of Artificial Sequence: Synthetic oligonucleotide
  Target: DMPK; (-) strand; PAM type: NRG; PAM sequence: TAG
tgtcatctgtaaataagggg

SEQ ID NO: 9495 - DNA, 20 bp, Artificial Sequence
  Description of Artificial Sequence: Synthetic oligonucleotide
  Target: DMPK; (-) strand; PAM type: NRG; PAM sequence: GGG
gattgtcatctgtaaataag

SEQ ID NO: 9496 - DNA, 20 bp, Artificial Sequence
  Description of Artificial Sequence: Synthetic oligonucleotide
  Target: DMPK; (-) strand; PAM type: NRG; PAM sequence: GGG
tgattgtcatctgtaaataa

SEQ ID NO: 9497 - DNA, 20 bp, Artificial Sequence
  Description of Artificial Sequence: Synthetic oligonucleotide
  Target: DMPK; (-) strand; PAM type: NRG; PAM sequence: AGG
ctgattgtcatctgtaaata

SEQ ID NO: 9498 - DNA, 20 bp, Artificial Sequence
  Description of Artificial Sequence: Synthetic oligonucleotide
  Target: DMPK; (-) strand; PAM type: NRG; PAM sequence: AAG
cctgattgtcatctgtaaat

SEQ ID NO: 9499 - DNA, 20 bp, Artificial Sequence
  Description of Artificial Sequence: Synthetic oligonucleotide
  Target: DMPK; (-) strand; PAM type: NRG; PAM sequence: AGG
ataggaccttgacttctgag

SEQ ID NO: 9500 - DNA, 20 bp, Artificial Sequence
  Description of Artificial Sequence: Synthetic oligonucleotide
  Target: DMPK; (-) strand; PAM type: NRG; PAM sequence: GAG
cataggaccttgacttctga

SEQ ID NO: 9501 - DNA, 20 bp, Artificial Sequence
  Description of Artificial Sequence: Synthetic oligonucleotide
  Target: DMPK; (-) strand; PAM type: NRG; PAM sequence: GAG
gtcataggaccttgacttct

SEQ ID NO: 9502 - DNA, 20 bp, Artificial Sequence
  Description of Artificial Sequence: Synthetic oligonucleotide
  Target: DMPK; (-) strand; PAM type: NRG; PAM sequence: AGG
agtttaacattcctagtcat

SEQ ID NO: 9503 - DNA, 20 bp, Artificial Sequence
  Description of Artificial Sequence: Synthetic oligonucleotide
  Target: DMPK; (-) strand; PAM type: NRG; PAM sequence: TAG
cagtttaacattcctagtca

SEQ ID NO: 9504 - DNA, 20 bp, Artificial Sequence
  Description of Artificial Sequence: Synthetic oligonucleotide
  Target: DMPK; (-) strand; PAM type: NRG; PAM sequence: TAG
gctgcccagtttaacattcc

SEQ ID NO: 9505 - DNA, 20 bp, Artificial Sequence
  Description of Artificial Sequence: Synthetic oligonucleotide
  Target: DMPK; (-) strand; PAM type: NRG; PAM sequence: CAG
ggtcccccacccaggctgcc

SEQ ID NO: 9506 - DNA, 20 bp, Artificial Sequence
  Description of Artificial Sequence: Synthetic oligonucleotide
  Target: DMPK; (-) strand; PAM type: NRG; PAM sequence: AGG
ccccagctggtcccccaccc

SEQ ID NO: 9507 - DNA, 20 bp, Artificial Sequence
  Description of Artificial Sequence: Synthetic oligonucleotide
  Target: DMPK; (-) strand; PAM type: NRG; PAM sequence: CAG
accccagctggtcccccacc

SEQ ID NO: 9508 - DNA, 20 bp, Artificial Sequence
  Description of Artificial Sequence: Synthetic oligonucleotide
  Target: DMPK; (-) strand; PAM type: NRG; PAM sequence: TGG
ccacaagcctccaccccagc

SEQ ID NO: 9509 - DNA, 20 bp, Artificial Sequence
  Description of Artificial Sequence: Synthetic oligonucleotide
  Target: DMPK; (-) strand; PAM type: NRG; PAM sequence: CAG
tgagccacaagcctccaccc

SEQ ID NO: 9510 - DNA, 20 bp, Artificial Sequence
  Description of Artificial Sequence: Synthetic oligonucleotide
  Target: DMPK; (-) strand; PAM type: NRG; PAM sequence: AAG
ccccacagtccctgagccac

SEQ ID NO: 9511 - DNA, 20 bp, Artificial Sequence
  Description of Artificial Sequence: Synthetic oligonucleotide
  Target: DMPK; (-) strand; PAM type: NRG; PAM sequence: GAG
tccctgtccccacagtccct

SEQ ID NO: 9512 - DNA, 20 bp, Artificial Sequence
  Description of Artificial Sequence: Synthetic oligonucleotide
  Target: DMPK; (-) strand; PAM type: NRG; PAM sequence: CAG
tccaggcctccctgtcccca

SEQ ID NO: 9513 - DNA, 20 bp, Artificial Sequence
  Description of Artificial Sequence: Synthetic oligonucleotide
  Target: DMPK; (-) strand; PAM type: NRG; PAM sequence: AGG
tcttccacccccgggagtcc

SEQ ID NO: 9514 - DNA, 20 bp, Artificial Sequence
  Description of Artificial Sequence: Synthetic oligonucleotide
  Target: DMPK; (-) strand; PAM type: NRG; PAM sequence: CAG
ttcttccacccccgggagtc

SEQ ID NO: 9515 - DNA, 20 bp, Artificial Sequence
  Description of Artificial Sequence: Synthetic oligonucleotide
  Target: DMPK; (-) strand; PAM type: NRG; PAM sequence: GAG
tccacttcttccacccccgg

SEQ ID NO: 9516 - DNA, 20 bp, Artificial Sequence
  Description of Artificial Sequence: Synthetic oligonucleotide
  Target: DMPK; (-) strand; PAM type: NRG; PAM sequence: GGG
cctccacttcttccaccccc

SEQ ID NO: 9517 - DNA, 20 bp, Artificial Sequence
  Description of Artificial Sequence: Synthetic oligonucleotide
  Target: DMPK; (-) strand; PAM type: NRG; PAM sequence: CGG
gcctccacttcttccacccc

SEQ ID NO: 9518 - DNA, 20 bp, Artificial Sequence
  Description of Artificial Sequence: Synthetic oligonucleotide
  Target: DMPK; (-) strand; PAM type: NRG; PAM sequence: CAG
cggaacccctctctttcctc

SEQ ID NO: 9519 - DNA, 20 bp, Artificial Sequence
  Description of Artificial Sequence: Synthetic oligonucleotide
  Target: DMPK; (-) strand; PAM type: NRG; PAM sequence: CGG
cccactctcccggaaccccc

SEQ ID NO: 9520 - DNA, 20 bp, Artificial Sequence
  Description of Artificial Sequence: Synthetic oligonucleotide
  Target: DMPK; (-) strand; PAM type: NRG; PAM sequence: CGG
tccctgctggcccactctcc

SEQ ID NO: 9521 - DNA, 20 bp, Artificial Sequence
  Description of Artificial Sequence: Synthetic oligonucleotide
  Target: DMPK; (-) strand; PAM type: NRG; PAM sequence: TGG
cctggctggttcgtccctgc

SEQ ID NO: 9522 - DNA, 20 bp, Artificial Sequence
  Description of Artificial Sequence: Synthetic oligonucleotide
  Target: DMPK; (-) strand; PAM type: NRG; PAM sequence: TGG
cccccgtcctcagccctggc

SEQ ID NO: 9523 - DNA, 20 bp, Artificial Sequence
  Description of Artificial Sequence: Synthetic oligonucleotide
  Target: DMPK; (-) strand; PAM type: NRG; PAM sequence: TGG
ccctcccccgtcctcagccc

SEQ ID NO: 9524 - DNA, 20 bp, Artificial Sequence
  Description of Artificial Sequence: Synthetic oligonucleotide
  Target: DMPK; (-) strand; PAM type: NRG; PAM sequence: CAG
tctcctccctcccccgtcct

SEQ ID NO: 9525 - DNA, 20 bp, Artificial Sequence
  Description of Artificial Sequence: Synthetic oligonucleotide
  Target: DMPK; (-) strand; PAM type: NRG; PAM sequence: TGG
cttaaaagggctcaatgtct

SEQ ID NO: 9526 - DNA, 20 bp, Artificial Sequence
  Description of Artificial Sequence: Synthetic oligonucleotide
  Target: DMPK; (-) strand; PAM type: NRG; PAM sequence: GGG
gggttcctgctgccttaaaa

SEQ ID NO: 9527 - DNA, 20 bp, Artificial Sequence
  Description of Artificial Sequence: Synthetic oligonucleotide
  Target: DMPK; (-) strand; PAM type: NRG; PAM sequence: AGG
agggttcctgctgccttaaa

SEQ ID NO: 9528 - DNA, 20 bp, Artificial Sequence
  Description of Artificial Sequence: Synthetic oligonucleotide
  Target: DMPK; (-) strand; PAM type: NRG; PAM sequence: AAG
cagggttcctgctgccttaa

SEQ ID NO: 9529 - DNA, 20 bp, Artificial Sequence
  Description of Artificial Sequence: Synthetic oligonucleotide
  Target: DMPK; (-) strand; PAM type: NRG; PAM sequence: GGG
tggggcgggggagggggcca

SEQ ID NO: 9530 - DNA, 20 bp, Artificial Sequence
  Description of Artificial Sequence: Synthetic oligonucleotide
  Target: DMPK; (-) strand; PAM type: NRG; PAM sequence: AGG
ctggggcgggggagggggcc

SEQ ID NO: 9531 - DNA, 20 bp, Artificial Sequence
  Description of Artificial Sequence: Synthetic oligonucleotide
  Target: DMPK; (-) strand; PAM type: NRG; PAM sequence: CAG
cctggggcgggggagggggc

SEQ ID NO: 9532 - DNA, 20 bp, Artificial Sequence
  Description of Artificial Sequence: Synthetic oligonucleotide
  Target: DMPK; (-) strand; PAM type: NRG; PAM sequence: GGG
caggcctggggcgggggagg

SEQ ID NO: 9533 - DNA, 20 bp, Artificial Sequence
  Description of Artificial Sequence: Synthetic oligonucleotide
  Target: DMPK; (-) strand; PAM type: NRG; PAM sequence: GGG
ccaggcctggggcgggggag

SEQ ID NO: 9534 - DNA, 20 bp, Artificial Sequence
  Description of Artificial Sequence: Synthetic oligonucleotide
  Target: DMPK; (-) strand; PAM type: NRG; PAM sequence: GGG
gccaggcctggggcggggga

SEQ ID NO: 9535 - DNA, 20 bp, Artificial Sequence
  Description of Artificial Sequence: Synthetic oligonucleotide
  Target: DMPK; (-) strand; PAM type: NRG; PAM sequence: AGG
tgccaggcctggggcggggg

SEQ ID NO: 9536 - DNA, 20 bp, Artificial Sequence
  Description of Artificial Sequence: Synthetic oligonucleotide
  Target: DMPK; (-) strand; PAM type: NRG; PAM sequence: GAG
ctgccaggcctggggcgggg

SEQ ID NO: 9537 - DNA, 20 bp, Artificial Sequence
  Description of Artificial Sequence: Synthetic oligonucleotide
  Target: DMPK; (-) strand; PAM type: NRG; PAM sequence: GGG
ccctgccaggcctggggcgg

SEQ ID NO: 9538 - DNA, 20 bp, Artificial Sequence
  Description of Artificial Sequence: Synthetic oligonucleotide
  Target: DMPK; (-) strand; PAM type: NRG; PAM sequence: GGG
cccctgccaggcctggggcg

SEQ ID NO: 9539 - DNA, 20 bp, Artificial Sequence
  Description of Artificial Sequence: Synthetic oligonucleotide
  Target: DMPK; (-) strand; PAM type: NRG; PAM sequence: GGG
tcccctgccaggcctggggc

SEQ ID NO: 9540 - DNA, 20 bp, Artificial Sequence
  Description of Artificial Sequence: Synthetic oligonucleotide
  Target: DMPK; (-) strand; PAM type: NRG; PAM sequence: CGG
ctcccctgccaggcctgggg

SEQ ID NO: 9541 - DNA, 20 bp, Artificial Sequence
  Description of Artificial Sequence: Synthetic oligonucleotide
  Target: DMPK; (-) strand; PAM type: NRG; PAM sequence: GGG
cccctcccctgccaggcctg

SEQ ID NO: 9542 - DNA, 20 bp, Artificial Sequence
  Description of Artificial Sequence: Synthetic oligonucleotide
  Target: DMPK; (-) strand; PAM type: NRG; PAM sequence: GGG
gcccctcccctgccaggcct

SEQ ID NO: 9543 - DNA, 20 bp, Artificial Sequence
  Description of Artificial Sequence: Synthetic oligonucleotide
  Target: DMPK; (-) strand; PAM type: NRG; PAM sequence: TGG
ggcccctcccctgccaggcc

SEQ ID NO: 9544 - DNA, 20 bp, Artificial Sequence
  Description of Artificial Sequence: Synthetic oligonucleotide
  Target: DMPK; (-) strand; PAM type: NRG; PAM sequence: AGG
ctcgcggcccctcccctgcc

SEQ ID NO: 9545 - DNA, 20 bp, Artificial Sequence
  Description of Artificial Sequence: Synthetic oligonucleotide
  Target: DMPK; (-) strand; PAM type: NRG; PAM sequence: CAG
tctcgcggcccctcccctgc

SEQ ID NO: 9546 - DNA, 20 bp, Artificial Sequence
  Description of Artificial Sequence: Synthetic oligonucleotide
  Target: DMPK; (-) strand; PAM type: NRG; PAM sequence: CGG
gtggcccgagctgcatctcg

SEQ ID NO: 9547 - DNA, 20 bp, Artificial Sequence
  Description of Artificial Sequence: Synthetic oligonucleotide
  Target: DMPK; (-) strand; PAM type: NRG; PAM sequence: GAG
gagcactccttttgtggccc

SEQ ID NO: 9548 - DNA, 20 bp, Artificial Sequence
  Description of Artificial Sequence: Synthetic oligonucleotide
  Target: DMPK; (-) strand; PAM type: NRG; PAM sequence: TGG
cgggaggagcactccttttg

SEQ ID NO: 9549 - DNA, 20 bp, Artificial Sequence
  Description of Artificial Sequence: Synthetic oligonucleotide
  Target: DMPK; (-) strand; PAM type: NRG; PAM sequence: GAG
gggtctggcgctcccgggag

SEQ ID NO: 9550 - DNA, 20 bp, Artificial Sequence
  Description of Artificial Sequence: Synthetic oligonucleotide
  Target: DMPK; (-) strand; PAM type: NRG; PAM sequence: AGG
aggggtctggcgctcccggg

SEQ ID NO: 9551 - DNA, 20 bp, Artificial Sequence
  Description of Artificial Sequence: Synthetic oligonucleotide
  Target: DMPK; (-) strand; PAM type: NRG; PAM sequence: GAG
taggggtctggcgctcccgg

SEQ ID NO: 9552 - DNA, 20 bp, Artificial Sequence
  Description of Artificial Sequence: Synthetic oligonucleotide
  Target: DMPK; (-) strand; PAM type: NRG; PAM sequence: GGG
ggtaggggtctggcgctccc

SEQ ID NO: 9553 - DNA, 20 bp, Artificial Sequence
  Description of Artificial Sequence: Synthetic oligonucleotide
  Target: DMPK; (-) strand; PAM type: NRG; PAM sequence: CGG
gggtaggggtctggcgctcc

SEQ ID NO: 9554 - DNA, 20 bp, Artificial Sequence
  Description of Artificial Sequence: Synthetic oligonucleotide
  Target: DMPK; (-) strand; PAM type: NRG; PAM sequence: TGG
gaccgggtggggtaggggtc

SEQ ID NO: 9555 - DNA, 20 bp, Artificial Sequence
  Description of Artificial Sequence: Synthetic oligonucleotide
  Target: DMPK; (-) strand; PAM type: NRG; PAM sequence: GGG
actgagaccgggtggggtag

SEQ ID NO: 9556 - DNA, 20 bp, Artificial Sequence
  Description of Artificial Sequence: Synthetic oligonucleotide
  Target: DMPK; (-) strand; PAM type: NRG; PAM sequence: GGG
aactgagaccgggtggggta

SEQ ID NO: 9557 - DNA, 20 bp, Artificial Sequence
  Description of Artificial Sequence: Synthetic oligonucleotide
  Target: DMPK; (-) strand; PAM type: NRG; PAM sequence: AGG
aaactgagaccgggtggggt

SEQ ID NO: 9558 - DNA, 20 bp, Artificial Sequence
  Description of Artificial Sequence: Synthetic oligonucleotide
  Target: DMPK; (-) strand; PAM type: NRG; PAM sequence: TAG
taaactgagaccgggtgggg

SEQ ID NO: 9559 - DNA, 20 bp, Artificial Sequence
  Description of Artificial Sequence: Synthetic oligonucleotide
  Target: DMPK; (-) strand; PAM type: NRG; PAM sequence: GGG
gggtaaactgagaccgggtg

SEQ ID NO: 9560 - DNA, 20 bp, Artificial Sequence
  Description of Artificial Sequence: Synthetic oligonucleotide
  Target: DMPK; (-) strand; PAM type: NRG; PAM sequence: GGG
agggtaaactgagaccgggt

SEQ ID NO: 9561 - DNA, 20 bp, Artificial Sequence
  Description of Artificial Sequence: Synthetic oligonucleotide
  Target: DMPK; (-) strand; PAM type: NRG; PAM sequence: TGG
cagggtaaactgagaccggg

SEQ ID NO: 9562 - DNA, 20 bp, Artificial Sequence
  Description of Artificial Sequence: Synthetic oligonucleotide
  Target: DMPK; (-) strand; PAM type: NRG; PAM sequence: GGG
tggcagggtaaactgagacc

SEQ ID NO: 9563 - DNA, 20 bp, Artificial Sequence
  Description of Artificial Sequence: Synthetic oligonucleotide
  Target: DMPK; (-) strand; PAM type: NRG; PAM sequence: CGG
ttggcagggtaaactgagac

SEQ ID NO: 9564 - DNA, 20 bp, Artificial Sequence
  Description of Artificial Sequence: Synthetic oligonucleotide
  Target: DMPK; (-) strand; PAM type: NRG; PAM sequence: GAG
ttgggttggcagggtaaact

SEQ ID NO: 9565 - DNA, 20 bp, Artificial Sequence
  Description of Artificial Sequence: Synthetic oligonucleotide
  Target: DMPK; (-) strand; PAM type: NRG; PAM sequence: GGG
aggatgaagttgggttggca

SEQ ID NO: 9566 - DNA, 20 bp, Artificial Sequence
  Description of Artificial Sequence: Synthetic oligonucleotide
  Target: DMPK; (-) strand; PAM type: NRG; PAM sequence: AGG
gaggatgaagttgggttggc

SEQ ID NO: 9567 - DNA, 20 bp, Artificial Sequence
  Description of Artificial Sequence: Synthetic oligonucleotide
  Target: DMPK; (-) strand; PAM type: NRG; PAM sequence: CAG
agaggatgaagttgggttgg

SEQ ID NO: 9568 - DNA, 20 bp, Artificial Sequence
  Description of Artificial Sequence: Synthetic oligonucleotide
  Target: DMPK; (-) strand; PAM type: NRG; PAM sequence: TGG
agtagaggatgaagttgggt

SEQ ID NO: 9569 - DNA, 20 bp, Artificial Sequence
  Description of Artificial Sequence: Synthetic oligonucleotide
  Target: DMPK; (-) strand; PAM type: NRG; PAM sequence: GGG
ctttagtagaggatgaagtt

SEQ ID NO: 9570 - DNA, 20 bp, Artificial Sequence
  Description of Artificial Sequence: Synthetic oligonucleotide
  Target: DMPK; (-) strand; PAM type: NRG; PAM sequence: TGG
cctttagtagaggatgaagt

SEQ ID NO: 9571 - DNA, 20 bp, Artificial Sequence
  Description of Artificial Sequence: Synthetic oligonucleotide
  Target: DMPK; (-) strand; PAM type: NRG; PAM sequence: AAG
cctccctttagtagaggatg

SEQ ID NO: 9572 - DNA, 20 bp, Artificial Sequence
  Description of Artificial Sequence: Synthetic oligonucleotide
  Target: DMPK; (-) strand; PAM type: NRG; PAM sequence: AGG
tcctggcctccctttagtag

SEQ ID NO: 9573 - DNA, 20 bp, Artificial Sequence
  Description of Artificial Sequence: Synthetic oligonucleotide
  Target: DMPK; (-) strand; PAM type: NRG; PAM sequence: GAG
ctcctggcctccctttagta

SEQ ID NO: 9574 - DNA, 20 bp, Artificial Sequence
  Description of Artificial Sequence: Synthetic oligonucleotide
  Target: DMPK; (-) strand; PAM type: NRG; PAM sequence: TAG
ctctcctggcctccctttag

SEQ ID NO: 9575 - DNA, 20 bp, Artificial Sequence
  Description of Artificial Sequence: Synthetic oligonucleotide
  Target: DMPK; (-) strand; PAM type: NRG; PAM sequence: TAG
tgactctcctggcctccctt

SEQ ID NO: 9576 - DNA, 20 bp, Artificial Sequence
  Description of Artificial Sequence: Synthetic oligonucleotide
  Target: DMPK; (-) strand; PAM type: NRG; PAM sequence: TGG
acagcccctaatgactctcc

SEQ ID NO: 9577 - DNA, 20 bp, Artificial Sequence
  Description of Artificial Sequence: Synthetic oligonucleotide
  Target: DMPK; (-) strand; PAM type: NRG; PAM sequence: CAG
aaccttctcccaacctccca

SEQ ID NO: 9578 - DNA, 20 bp, Artificial Sequence
  Description of Artificial Sequence: Synthetic oligonucleotide
  Target: DMPK; (-) strand; PAM type: NRG; PAM sequence: TGG
gggccaggccattcagcctc

SEQ ID NO: 9579 - DNA, 20 bp, Artificial Sequence
  Description of Artificial Sequence: Synthetic oligonucleotide
  Target: DMPK; (-) strand; PAM type: NRG; PAM sequence: CAG
ccaagaagggccaggccatt

SEQ ID NO: 9580 - DNA, 20 bp, Artificial Sequence
  Description of Artificial Sequence: Synthetic oligonucleotide
  Target: DMPK; (-) strand; PAM type: NRG; PAM sequence: AGG
ggtggaggccaagaagggcc

SEQ ID NO: 9581 - DNA, 20 bp, Artificial Sequence
  Description of Artificial Sequence: Synthetic oligonucleotide
  Target: DMPK; (-) strand; PAM type: NRG; PAM sequence: CAG
aggtggaggccaagaagggc

SEQ ID NO: 9582 - DNA, 20 bp, Artificial Sequence
  Description of Artificial Sequence: Synthetic oligonucleotide
  Target: DMPK; (-) strand; PAM type: NRG; PAM sequence: GGG
gggaaggtggaggccaagaa

SEQ ID NO: 9583 - DNA, 20 bp, Artificial Sequence
  Description of Artificial Sequence: Synthetic oligonucleotide
  Target: DMPK; (-) strand; PAM type: NRG; PAM sequence: AGG
tgggaaggtggaggccaaga

SEQ ID NO: 9584 - DNA, 20 bp, Artificial Sequence
  Description of Artificial Sequence: Synthetic oligonucleotide
  Target: DMPK; (-) strand; PAM type: NRG; PAM sequence: AAG
atgggaaggtggaggccaag

SEQ ID NO: 9585 - DNA, 20 bp, Artificial Sequence
  Description of Artificial Sequence: Synthetic oligonucleotide
  Target: DMPK; (-) strand; PAM type: NRG; PAM sequence: AAG
cagatgggaaggtggaggcc

SEQ ID NO: 9586 - DNA, 20 bp, Artificial Sequence
  Description of Artificial Sequence: Synthetic oligonucleotide
  Target: DMPK; (-) strand; PAM type: NRG; PAM sequence: AGG
tttcacagatgggaaggtgg

SEQ ID NO: 9587 - DNA, 20 bp, Artificial Sequence
  Description of Artificial Sequence: Synthetic oligonucleotide
  Target: DMPK; (-) strand; PAM type: NRG; PAM sequence: GAG
atttcacagatgggaaggtg

SEQ ID NO: 9588 - DNA, 20 bp, Artificial Sequence
  Description of Artificial Sequence: Synthetic oligonucleotide
  Target: DMPK; (-) strand; PAM type: NRG; PAM sequence: TGG
ccatttcacagatgggaagg

SEQ ID NO: 9589 - DNA, 20 bp, Artificial Sequence
  Description of Artificial Sequence: Synthetic oligonucleotide
  Target: DMPK; (-) strand; PAM type: NRG; PAM sequence: AGG
ctcccatttcacagatggga

SEQ ID NO: 9590 - DNA, 20 bp, Artificial Sequence
  Description of Artificial Sequence: Synthetic oligonucleotide
  Target: DMPK; (-) strand; PAM type: NRG; PAM sequence: AAG
cctcccatttcacagatggg

SEQ ID NO: 9591 - DNA, 20 bp, Artificial Sequence
  Description of Artificial Sequence: Synthetic oligonucleotide
  Target: DMPK; (-) strand; PAM type: NRG; PAM sequence: GGG
cctcctcccatttcacagat

SEQ ID NO: 9592 - DNA, 20 bp, Artificial Sequence
  Description of Artificial Sequence: Synthetic oligonucleotide
  Target: DMPK; (-) strand; PAM type: NRG; PAM sequence: TGG
tcctcctcccatttcacaga

SEQ ID NO: 9593 - DNA, 20 bp, Artificial Sequence
  Description of Artificial Sequence: Synthetic oligonucleotide
  Target: DMPK; (-) strand; PAM type: NRG; PAM sequence: CAG
tccctcctcctcccatttca

SEQ ID NO: 9594 - DNA, 20 bp, Artificial Sequence
  Description of Artificial Sequence: Synthetic oligonucleotide
  Target: DMPK; (-) strand; PAM type: NRG; PAM sequence: TGG
atctctttctgacccaggcc

SEQ ID NO: 9595 - DNA, 20 bp, Artificial Sequence
  Description of Artificial Sequence: Synthetic oligonucleotide
  Target: DMPK; (-) strand; PAM type: NRG; PAM sequence: AGG
tgtccatctctttctgaccc

SEQ ID NO: 9596 - DNA, 20 bp, Artificial Sequence
  Description of Artificial Sequence: Synthetic oligonucleotide
  Target: DMPK; (-) strand; PAM type: NRG; PAM sequence: CAG
gtgtccatctctttctgacc

SEQ ID NO: 9597 - DNA, 20 bp, Artificial Sequence
  Description of Artificial Sequence: Synthetic oligonucleotide
  Target: DMPK; (-) strand; PAM type: NRG; PAM sequence: TGG
agtgactggtgtttggtttt

SEQ ID NO: 9598 - DNA, 20 bp, Artificial Sequence
  Description of Artificial Sequence: Synthetic oligonucleotide
  Target: DMPK; (-) strand; PAM type: NRG; PAM sequence: TGG
ggccctcagtgactggtgtt

SEQ ID NO: 9599 - DNA, 20 bp, Artificial Sequence
  Description of Artificial Sequence: Synthetic oligonucleotide
  Target: DMPK; (-) strand; PAM type: NRG; PAM sequence: TGG
tatgtctggccctcagtgac

SEQ ID NO: 9600 - DNA, 20 bp, Artificial Sequence
  Description of Artificial Sequence: Synthetic oligonucleotide
  Target: DMPK; (-) strand; PAM type: NRG; PAM sequence: CAG
gccctcatatgtctggccct

SEQ ID NO: 9601 - DNA, 20 bp, Artificial Sequence
  Description of Artificial Sequence: Synthetic oligonucleotide
  Target: DMPK; (-) strand; PAM type: NRG; PAM sequence: TGG
ccctctggccctcatatgtc

SEQ ID NO: 9602 - DNA, 20 bp, Artificial Sequence
  Description of Artificial Sequence: Synthetic oligonucleotide
  Target: DMPK; (-) strand; PAM type: NRG; PAM sequence: TGG
ttcccagcaccctgcccctc

SEQ ID NO: 9603 - DNA, 20 bp, Artificial Sequence
  Description of Artificial Sequence: Synthetic oligonucleotide
  Target: DMPK; (-) strand; PAM type: NRG; PAM sequence: CAG
tcactggtttctttcattcc

SEQ ID NO: 9604 - DNA, 20 bp, Artificial Sequence
  Description of Artificial Sequence: Synthetic oligonucleotide
  Target: DMPK; (-) strand; PAM type: NRG; PAM sequence: TGG
gactcgggctcactggtcac

SEQ ID NO: 9605 - DNA, 20 bp, Artificial Sequence
  Description of Artificial Sequence: Synthetic oligonucleotide
  Target: DMPK; (-) strand; PAM type: NRG; PAM sequence: TGG
agcccaggactcgggctcac

SEQ ID NO: 9606 - DNA, 20 bp, Artificial Sequence
  Description of Artificial Sequence: Synthetic oligonucleotide
  Target: DMPK; (-) strand; PAM type: NRG; PAM sequence: GGG
cctccccaagcccaggactc

SEQ ID NO: 9607 - DNA, 20 bp, Artificial Sequence
  Description of Artificial Sequence: Synthetic oligonucleotide
  Target: DMPK; (-) strand; PAM type: NRG; PAM sequence: CGG
tcctccccaagcccaggact

SEQ ID NO: 9608 - DNA, 20 bp, Artificial Sequence
  Description of Artificial Sequence: Synthetic oligonucleotide
  Target: DMPK; (-) strand; PAM type: NRG; PAM sequence: AGG
cccacctcctccccaagccc

SEQ ID NO: 9609 - DNA, 20 bp, Artificial Sequence
  Description of Artificial Sequence: Synthetic oligonucleotide
  Target: DMPK; (-) strand; PAM type: NRG; PAM sequence: CAG
gcccacctcctccccaagcc

SEQ ID NO: 9610 - DNA, 20 bp, Artificial Sequence
  Description of Artificial Sequence: Synthetic oligonucleotide
  Target: DMPK; (-) strand; PAM type: NRG; PAM sequence: AAG
tgtctgcccacctcctcccc

SEQ ID NO: 9611 - DNA, 20 bp, Artificial Sequence
  Description of Artificial Sequence: Synthetic oligonucleotide
  Target: DMPK; (-) strand; PAM type: NRG; PAM sequence: CAG
gaggatgcttccgcttctgc

SEQ ID NO: 9612 - DNA, 20 bp, Artificial Sequence
  Description of Artificial Sequence: Synthetic oligonucleotide
  Target: DMPK; (-) strand; PAM type: NRG; PAM sequence: AGG
ctggggccagggctggaagg

SEQ ID NO: 9613 - DNA, 20 bp, Artificial Sequence
  Description of Artificial Sequence: Synthetic oligonucleotide
  Target: DMPK; (-) strand; PAM type: NRG; PAM sequence: GAG
cctggggccagggctggaag

SEQ ID NO: 9614 - DNA, 20 bp, Artificial Sequence
  Description of Artificial Sequence: Synthetic oligonucleotide
  Target: DMPK; (-) strand; PAM type: NRG; PAM sequence: AGG
ggcctggggccagggctgga

SEQ ID NO: 9615 - DNA, 20 bp, Artificial Sequence
  Description of Artificial Sequence: Synthetic oligonucleotide
  Target: DMPK; (-) strand; PAM type: NRG; PAM sequence: AAG
gggcctggggccagggctgg

SEQ ID NO: 9616 - DNA, 20 bp, Artificial Sequence
  Description of Artificial Sequence: Synthetic oligonucleotide
  Target: DMPK; (-) strand; PAM type: NRG; PAM sequence: TGG
ccagggcctggggccagggc

SEQ ID NO: 9617 - DNA, 20 bp, Artificial Sequence
  Description of Artificial Sequence: Synthetic oligonucleotide
  Target: DMPK; (-) strand; PAM type: NRG; PAM sequence: GGG
ctttccagggcctggggcca

SEQ ID NO: 9618 - DNA, 20 bp, Artificial Sequence
  Description of Artificial Sequence: Synthetic oligonucleotide
  Target: DMPK; (-) strand; PAM type: NRG; PAM sequence: AGG
gctttccagggcctggggcc

SEQ ID NO: 9619 - DNA, 20 bp, Artificial Sequence
  Description of Artificial Sequence: Synthetic oligonucleotide
  Target: DMPK; (-) strand; PAM type: NRG; PAM sequence: CAG
ggctttccagggcctggggc

SEQ ID NO: 9620 - DNA, 20 bp, Artificial Sequence
  Description of Artificial Sequence: Synthetic oligonucleotide
  Target: DMPK; (-) strand; PAM type: NRG; PAM sequence: GGG
caagggctttccagggcctg

SEQ ID NO: 9621 - DNA, 20 bp, Artificial Sequence
  Description of Artificial Sequence: Synthetic oligonucleotide
  Target: DMPK; (-) strand; PAM type: NRG; PAM sequence: GGG
gcaagggctttccagggcct

SEQ ID NO: 9622 - DNA, 20 bp, Artificial Sequence
  Description of Artificial Sequence: Synthetic oligonucleotide
  Target: DMPK; (-) strand; PAM type: NRG; PAM sequence: TGG
tgcaagggctttccagggcc

SEQ ID NO: 9623 - DNA, 20 bp, Artificial Sequence
  Description of Artificial Sequence: Synthetic oligonucleotide
  Target: DMPK; (-) strand; PAM type: NRG; PAM sequence: GGG
cttcttgcaagggctttcca

SEQ ID NO: 9624 - DNA, 20 bp, Artificial Sequence
  Description of Artificial Sequence: Synthetic oligonucleotide
  Target: DMPK; (-) strand; PAM type: NRG; PAM sequence: AGG
ccttcttgcaagggctttcc

SEQ ID NO: 9625 - DNA, 20 bp, Artificial Sequence
  Description of Artificial Sequence: Synthetic oligonucleotide
  Target: DMPK; (-) strand; PAM type: NRG; PAM sequence: CAG
cccttcttgcaagggctttc

SEQ ID NO: 9626 - DNA, 20 bp, Artificial Sequence
  Description of Artificial Sequence: Synthetic oligonucleotide
  Target: DMPK; (-) strand; PAM type: NRG; PAM sequence: GGG
cacaaaaccccttcttgcaa

SEQ ID NO: 9627 - DNA, 20 bp, Artificial Sequence
  Description of Artificial Sequence: Synthetic oligonucleotide
  Target: DMPK; (-) strand; PAM type: NRG; PAM sequence: AGG
ccacaaaaccccttcttgca

SEQ ID NO: 9628 - DNA, 20 bp, Artificial Sequence
  Description of Artificial Sequence: Synthetic oligonucleotide
  Target: DMPK; (-) strand; PAM type: NRG; PAM sequence: AAG
cccacaaaaccccttcttgc

SEQ ID NO: 9629 - DNA, 20 bp, Artificial Sequence
  Description of Artificial Sequence: Synthetic oligonucleotide
  Target: DMPK; (-) strand; PAM type: NRG; PAM sequence: CAG
gcccagggcctccaaccttc

SEQ ID NO: 9630 - DNA, 20 bp, Artificial Sequence
  Description of Artificial Sequence: Synthetic oligonucleotide
  Target: DMPK; (-) strand; PAM type: NRG; PAM sequence: GGG
cctttagttctcctggccca

SEQ ID NO: 9631 - DNA, 20 bp, Artificial Sequence
  Description of Artificial Sequence: Synthetic oligonucleotide
  Target: DMPK; (-) strand; PAM type: NRG; PAM sequence: AGG
tcctttagttctcctggccc

SEQ ID NO: 9632 - DNA, 20 bp, Artificial Sequence
  Description of Artificial Sequence: Synthetic oligonucleotide
  Target: DMPK; (-) strand; PAM type: NRG; PAM sequence: CAG
gtcctttagttctcctggcc

SEQ ID NO: 9633 - DNA, 20 bp, Artificial Sequence
  Description of Artificial Sequence: Synthetic oligonucleotide
  Target: DMPK; (-) strand; PAM type: NRG; PAM sequence: TGG
cctgcgtcctttagttctcc

SEQ ID NO: 9634 - DNA, 20 bp, Artificial Sequence
  Description of Artificial Sequence: Synthetic oligonucleotide
  Target: DMPK; (-) strand; PAM type: NRG; PAM sequence: TAG
ccccgggtccctgcgtcctt

SEQ ID NO: 9635 - DNA, 20 bp, Artificial Sequence
  Description of Artificial Sequence: Synthetic oligonucleotide
  Target: DMPK; (-) strand; PAM type: NRG; PAM sequence: GGG
gccaccattcccgccacccc

SEQ ID NO: 9636 - DNA, 20 bp, Artificial Sequence
  Description of Artificial Sequence: Synthetic oligonucleotide
  Target: DMPK; (-) strand; PAM type: NRG; PAM sequence: CGG
agccaccattcccgccaccc

SEQ ID NO: 9637 - DNA, 20 bp, Artificial Sequence
  Description of Artificial Sequence: Synthetic oligonucleotide
  Target: DMPK; (-) strand; PAM type: NRG; PAM sequence: CAG
ttcctatgagccgtgtgggt

SEQ ID NO: 9638 - DNA, 20 bp, Artificial Sequence
  Description of Artificial Sequence: Synthetic oligonucleotide
  Target: DMPK; (-) strand; PAM type: NRG; PAM sequence: GGG
tcggttcctatgagccgtgt

SEQ ID NO: 9639 - DNA, 20 bp, Artificial Sequence
  Description of Artificial Sequence: Synthetic oligonucleotide
  Target: DMPK; (-) strand; PAM type: NRG; PAM sequence: TGG
ctcggttcctatgagccgtg

SEQ ID NO: 9640 - DNA, 20 bp, Artificial Sequence
  Description of Artificial Sequence: Synthetic oligonucleotide
  Target: DMPK; (-) strand; PAM type: NRG; PAM sequence: GAG
cccaaagtctcggttcctat

SEQ ID NO: 9641 - DNA, 20 bp, Artificial Sequence
  Description of Artificial Sequence: Synthetic oligonucleotide
  Target: DMPK; (-) strand; PAM type: NRG; PAM sequence: CGG
cacccccagccccaaagtct

SEQ ID NO: 9642 - DNA, 20 bp, Artificial Sequence
  Description of Artificial Sequence: Synthetic oligonucleotide
  Target: DMPK; (-) strand; PAM type: NRG; PAM sequence: AAG
cacccccacccccagcccca

SEQ ID NO: 9643 - DNA, 20 bp, Artificial Sequence
  Description of Artificial Sequence: Synthetic oligonucleotide
  Target: DMPK; (-) strand; PAM type: NRG; PAM sequence: CAG
tctgcacccacccccacccc

SEQ ID NO: 9644 - DNA, 20 bp, Artificial Sequence
  Description of Artificial Sequence: Synthetic oligonucleotide
  Target: DMPK; (-) strand; PAM type: NRG; PAM sequence: AGG
ggtgtgtctccttcttttgt

SEQ ID NO: 9645 - DNA, 20 bp, Artificial Sequence
  Description of Artificial Sequence: Synthetic oligonucleotide
  Target: DMPK; (-) strand; PAM type: NRG; PAM sequence: TAG
gggtgtgtctccttcttttg

SEQ ID NO: 9646 - DNA, 20 bp, Artificial Sequence
  Description of Artificial Sequence: Synthetic oligonucleotide
  Target: DMPK; (-) strand; PAM type: NRG; PAM sequence: GGG
ggacaactttgggttcttct

SEQ ID NO: 9647 - DNA, 20 bp, Artificial Sequence
  Description of Artificial Sequence: Synthetic oligonucleotide
  Target: DMPK; (-) strand; PAM type: NRG; PAM sequence: TGG
gggacaactttgggttcttc

SEQ ID NO: 9648 - DNA, 20 bp, Artificial Sequence
  Description of Artificial Sequence: Synthetic oligonucleotide
  Target: DMPK; (-) strand; PAM type: NRG; PAM sequence: GGG
gatccaggagggacaacttt

SEQ ID NO: 9649 - DNA, 20 bp, Artificial Sequence
  Description of Artificial Sequence: Synthetic oligonucleotide
  Target: DMPK; (-) strand; PAM type: NRG; PAM sequence: TGG
cgatccaggagggacaactt

SEQ ID NO: 9650 - DNA, 20 bp, Artificial Sequence
  Description of Artificial Sequence: Synthetic oligonucleotide
  Target: DMPK; (-) strand; PAM type: NRG; PAM sequence: GGG
ccctcctctgcgatccagga

SEQ ID NO: 9651 - DNA, 20 bp, Artificial Sequence
  Description of Artificial Sequence: Synthetic oligonucleotide
  Target: DMPK; (-) strand; PAM type: NRG; PAM sequence: AGG
cccctcctctgcgatccagg

SEQ ID NO: 9652 - DNA, 20 bp, Artificial Sequence
  Description of Artificial Sequence: Synthetic oligonucleotide
  Target: DMPK; (-) strand; PAM type: NRG; PAM sequence: GAG
ccccctcctctgcgatccag

SEQ ID NO: 9653 - DNA, 20 bp, Artificial Sequence
  Description of Artificial Sequence: Synthetic oligonucleotide
  Target: DMPK; (-) strand; PAM type: NRG; PAM sequence: AGG
tgccccctcctctgcgatcc

SEQ ID NO: 9654 - DNA, 20 bp, Artificial Sequence
  Description of Artificial Sequence: Synthetic oligonucleotide
  Target: DMPK; (-) strand; PAM type: NRG; PAM sequence: CAG
gtgccccctcctctgcgatc

SEQ ID NO: 9655 - DNA, 20 bp, Artificial Sequence
  Description of Artificial Sequence: Synthetic oligonucleotide
  Target: DMPK; (-) strand; PAM type: NRG; PAM sequence: CAG
gctttgcagacaggcgccac

SEQ ID NO: 9656 - DNA, 20 bp, Artificial Sequence
  Description of Artificial Sequence: Synthetic oligonucleotide
  Target: DMPK; (-) strand; PAM type: NRG; PAM sequence: AGG
ggagaaccagctttgcagac

SEQ ID NO: 9657 - DNA, 20 bp, Artificial Sequence
  Description of Artificial Sequence: Synthetic oligonucleotide
  Target: DMPK; (-) strand; PAM type: NRG; PAM sequence: CAG
gggagaaccagctttgcaga

SEQ ID NO: 9658 - DNA, 20 bp, Artificial Sequence
  Description of Artificial Sequence: Synthetic oligonucleotide
  Target: DMPK; (-) strand; PAM type: NRG; PAM sequence: CAG
ctgtgggagaaccagctttg

SEQ ID NO: 9659 - DNA, 20 bp, Artificial Sequence
  Description of Artificial Sequence: Synthetic oligonucleotide
  Target: DMPK; (-) strand; PAM type: NRG; PAM sequence: CAG
cgcgggccctgtgggagaac

SEQ ID NO: 9660 - DNA, 20 bp, Artificial Sequence
  Description of Artificial Sequence: Synthetic oligonucleotide
  Target: DMPK; (-) strand; PAM type: NRG; PAM sequence: GAG
gactcacgcgggccctgtgg

SEQ ID NO: 9661 - DNA, 20 bp, Artificial Sequence
  Description of Artificial Sequence: Synthetic oligonucleotide
  Target: DMPK; (-) strand; PAM type: NRG; PAM sequence: GGG
gtgactcacgcgggccctgt

SEQ ID NO: 9662 - DNA, 20 bp, Artificial Sequence
  Description of Artificial Sequence: Synthetic oligonucleotide
  Target: DMPK; (-) strand; PAM type: NRG; PAM sequence: TGG
ggtgactcacgcgggccctg

SEQ ID NO: 9663 - DNA, 20 bp, Artificial Sequence
  Description of Artificial Sequence: Synthetic oligonucleotide
  Target: DMPK; (-) strand; PAM type: NRG; PAM sequence: GGG
gggagggcggtgactcacgc

SEQ ID NO: 9664 - DNA, 20 bp, Artificial Sequence
  Description of Artificial Sequence: Synthetic oligonucleotide
  Target: DMPK; (-) strand; PAM type: NRG; PAM sequence: CGG
tgggagggcggtgactcacg

SEQ ID NO: 9665 - DNA, 20 bp, Artificial Sequence
  Description of Artificial Sequence: Synthetic oligonucleotide
  Target: DMPK; (-) strand; PAM type: NRG; PAM sequence: CGG
gtgcccaggcactgggaggg

SEQ ID NO: 9666 - DNA, 20 bp, Artificial Sequence
  Description of Artificial Sequence: Synthetic oligonucleotide
  Target: DMPK; (-) strand; PAM type: NRG; PAM sequence: GGG
caggtgcccaggcactggga

SEQ ID NO: 9667 - DNA, 20 bp, Artificial Sequence
  Description of Artificial Sequence: Synthetic oligonucleotide
  Target: DMPK; (-) strand; PAM type: NRG; PAM sequence: AGG
acaggtgcccaggcactggg

SEQ ID NO: 9668 - DNA, 20 bp, Artificial Sequence
  Description of Artificial Sequence: Synthetic oligonucleotide
  Target: DMPK; (-) strand; PAM type: NRG; PAM sequence: GAG
aacaggtgcccaggcactgg

SEQ ID NO: 9669 - DNA, 20 bp, Artificial Sequence
  Description of Artificial Sequence: Synthetic oligonucleotide
  Target: DMPK; (-) strand; PAM type: NRG; PAM sequence: GGG
ccaacaggtgcccaggcact

SEQ ID NO: 9670 - DNA, 20 bp, Artificial Sequence
  Description of Artificial Sequence: Synthetic oligonucleotide
  Target: DMPK; (-) strand; PAM type: NRG; PAM sequence: TGG
cccaacaggtgcccaggcac

SEQ ID NO: 9671 - DNA, 20 bp, Artificial Sequence
  Description of Artificial Sequence: Synthetic oligonucleotide
  Target: DMPK; (-) strand; PAM type: NRG; PAM sequence: AGG
agctgccccaacaggtgccc

SEQ ID NO: 9672 - DNA, 20 bp, Artificial Sequence
  Description of Artificial Sequence: Synthetic oligonucleotide
  Target: DMPK; (-) strand; PAM type: NRG; PAM sequence: CAG
cagctgccccaacaggtgcc

SEQ ID NO: 9673 - DNA, 20 bp, Artificial Sequence
  Description of Artificial Sequence: Synthetic oligonucleotide
  Target: DMPK; (-) strand; PAM type: NRG; PAM sequence: AGG
gcctctccagctgccccaac

SEQ ID NO: 9674 - DNA, 20 bp, Artificial Sequence
  Description of Artificial Sequence: Synthetic oligonucleotide
  Target: DMPK; (-) strand; PAM type: NRG; PAM sequence: CAG
agcctctccagctgccccaa

SEQ ID NO: 9675 - DNA, 20 bp, Artificial Sequence
  Description of Artificial Sequence: Synthetic oligonucleotide
  Target: DMPK; (-) strand; PAM type: NRG; PAM sequence: CAG
gtgttcggcgccagcctctc

SEQ ID NO: 9676 - DNA, 20 bp, Artificial Sequence
  Description of Artificial Sequence: Synthetic oligonucleotide
  Target: DMPK; (-) strand; PAM type: NRG; PAM sequence: CAG
gacaggcaggtgttcggcgc

SEQ ID NO: 9677 - DNA, 20 bp, Artificial Sequence
  Description of Artificial Sequence: Synthetic oligonucleotide
  Target: DMPK; (-) strand; PAM type: NRG; PAM sequence: CGG
gcagccgacaggcaggtgtt

SEQ ID NO: 9678 - DNA, 20 bp, Artificial Sequence
  Description of Artificial Sequence: Synthetic oligonucleotide
  Target: DMPK; (-) strand; PAM type: NRG; PAM sequence: AGG
caggggcgcagccgacaggc

SEQ ID NO: 9679 - DNA, 20 bp, Artificial Sequence
  Description of Artificial Sequence: Synthetic oligonucleotide
  Target: DMPK; (-) strand; PAM type: NRG; PAM sequence: CAG
ccaggggcgcagccgacagg

SEQ ID NO: 9680 - DNA, 20 bp, Artificial Sequence
  Description of Artificial Sequence: Synthetic oligonucleotide
  Target: DMPK; (-) strand; PAM type: NRG; PAM sequence: AGG
ctgccaggggcgcagccgac

SEQ ID NO: 9681 - DNA, 20 bp, Artificial Sequence
  Description of Artificial Sequence: Synthetic oligonucleotide
  Target: DMPK; (-) strand; PAM type: NRG; PAM sequence: CAG
gctgccaggggcgcagccga

SEQ ID NO: 9682 - DNA, 20 bp, Artificial Sequence
  Description of Artificial Sequence: Synthetic oligonucleotide
  Target: DMPK; (-) strand; PAM type: NRG; PAM sequence: CAG
tggggcagctgccaggggcg

SEQ ID NO: 9683 - DNA, 20 bp, Artificial Sequence
  Description of Artificial Sequence: Synthetic oligonucleotide
  Target: DMPK; (-) strand; PAM type: NRG; PAM sequence: GGG
cagcatggggcagctgccag

SEQ ID NO: 9684 - DNA, 20 bp, Artificial Sequence
  Description of Artificial Sequence: Synthetic oligonucleotide
  Target: DMPK; (-) strand; PAM type: NRG; PAM sequence: GGG
ccagcatggggcagctgcca

SEQ ID NO: 9685 - DNA, 20 bp, Artificial Sequence
  Description of Artificial Sequence: Synthetic oligonucleotide
  Target: DMPK; (-) strand; PAM type: NRG; PAM sequence: AGG
gccagcatggggcagctgcc

SEQ ID NO: 9686 - DNA, 20 bp, Artificial Sequence
  Description of Artificial Sequence: Synthetic oligonucleotide
  Target: DMPK; (-) strand; PAM type: NRG; PAM sequence: CAG
ggccagcatggggcagctgc

SEQ ID NO: 9687 - DNA, 20 bp, Artificial Sequence
  Description of Artificial Sequence: Synthetic oligonucleotide
  Target: DMPK; (-) strand; PAM type: NRG; PAM sequence: CAG
ccaggagggccagcatgggg

SEQ ID NO: 9688 - DNA, 20 bp, Artificial Sequence
  Description of Artificial Sequence: Synthetic oligonucleotide
  Target: DMPK; (-) strand; PAM type: NRG; PAM sequence: GGG
aagccaggagggccagcatg

SEQ ID NO: 9689 - DNA, 20 bp, Artificial Sequence
  Description of Artificial Sequence: Synthetic oligonucleotide
  Target: DMPK; (-) strand; PAM type: NRG; PAM sequence: GGG
caagccaggagggccagcat

SEQ ID NO: 9690 - DNA, 20 bp, Artificial Sequence
  Description of Artificial Sequence: Synthetic oligonucleotide
  Target: DMPK; (-) strand; PAM type: NRG; PAM sequence: TGG
gcaagccaggagggccagca

SEQ ID NO: 9691 - DNA, 20 bp, Artificial Sequence
  Description of Artificial Sequence: Synthetic oligonucleotide
  Target: DMPK; (-) strand; PAM type: NRG; PAM sequence: CAG
ctggggcaagccaggagggc

SEQ ID NO: 9692 - DNA, 20 bp, Artificial Sequence
  Description of Artificial Sequence: Synthetic oligonucleotide
  Target: DMPK; (-) strand; PAM type: NRG; PAM sequence: GGG
tggcctggggcaagccagga

SEQ ID NO: 9693 - DNA, 20 bp, Artificial Sequence
  Description of Artificial Sequence: Synthetic oligonucleotide
  Target: DMPK; (-) strand; PAM type: NRG; PAM sequence: AGG
gtggcctggggcaagccagg

SEQ ID NO: 9694 - DNA, 20 bp, Artificial Sequence
  Description of Artificial Sequence: Synthetic oligonucleotide
  Target: DMPK; (-) strand; PAM type: NRG; PAM sequence: GAG
tgtggcctggggcaagccag

SEQ ID NO: 9695 - DNA, 20 bp, Artificial Sequence
  Description of Artificial Sequence: Synthetic oligonucleotide
  Target: DMPK; (-) strand; PAM type: NRG; PAM sequence: AGG
cctgtggcctggggcaagcc

SEQ ID NO: 9696 - DNA, 20 bp, Artificial Sequence
  Description of Artificial Sequence: Synthetic oligonucleotide
  Target: DMPK; (-) strand; PAM type: NRG; PAM sequence: CAG
tcctgtggcctggggcaagc

SEQ ID NO: 9697 - DNA, 20 bp, Artificial Sequence
  Description of Artificial Sequence: Synthetic oligonucleotide
  Target: DMPK; (-) strand; PAM type: NRG; PAM sequence: AAG
ggtttcctgtggcctggggc

SEQ ID NO: 9698 - DNA, 20 bp, Artificial Sequence
  Description of Artificial Sequence: Synthetic oligonucleotide
  Target: DMPK; (-) strand; PAM type: NRG; PAM sequence: GGG
ccctggtttcctgtggcctg

SEQ ID NO: 9699 - DNA, 20 bp, Artificial Sequence
  Description of Artificial Sequence: Synthetic oligonucleotide
  Target: DMPK; (-) strand; PAM type: NRG; PAM sequence: GGG
cccctggtttcctgtggcct

SEQ ID NO: 9700 - DNA, 20 bp, Artificial Sequence
  Description of Artificial Sequence: Synthetic oligonucleotide
  Target: DMPK; (-) strand; PAM type: NRG; PAM sequence: TGG
tcccctggtttcctgtggcc

SEQ ID NO: 9701 - DNA, 20 bp, Artificial Sequence
  Description of Artificial Sequence: Synthetic oligonucleotide
  Target: DMPK; (-) strand; PAM type: NRG; PAM sequence: TGG
ccctctcccctggtttcctg

SEQ ID NO: 9702 - DNA, 20 bp, Artificial Sequence
  Description of Artificial Sequence: Synthetic oligonucleotide
  Target: DMPK; (-) strand; PAM type: NRG; PAM sequence: TGG
ggctctatggccctctcccc

SEQ ID NO: 9703 - DNA, 20 bp, Artificial Sequence
  Description of Artificial Sequence: Synthetic oligonucleotide
  Target: DMPK; (-) strand; PAM type: NRG; PAM sequence: TGG
ccccccaaaagtgggctcta

SEQ ID NO: 9704 - DNA, 20 bp, Artificial Sequence
  Description of Artificial Sequence: Synthetic oligonucleotide
  Target: DMPK; (-) strand; PAM type: NRG; PAM sequence: GGG
aggaccctccccccaaaagt

SEQ ID NO: 9705 - DNA, 20 bp, Artificial Sequence
  Description of Artificial Sequence: Synthetic oligonucleotide
  Target: DMPK; (-) strand; PAM type: NRG; PAM sequence: TGG
taggaccctccccccaaaag

SEQ ID NO: 9706 - DNA, 20 bp, Artificial Sequence
  Description of Artificial Sequence: Synthetic oligonucleotide
  Target: DMPK; (-) strand; PAM type: NRG; PAM sequence: AAG
tcctaggaccctccccccaa

SEQ ID NO: 9707 - DNA, 20 bp, Artificial Sequence
  Description of Artificial Sequence: Synthetic oligonucleotide
  Target: DMPK; (-) strand; PAM type: NRG; PAM sequence: AGG
tgctgggagctccctctcct

SEQ ID NO: 9708 - DNA, 20 bp, Artificial Sequence
  Description of Artificial Sequence: Synthetic oligonucleotide
  Target: DMPK; (-) strand; PAM type: NRG; PAM sequence: TAG
atgctgggagctccctctcc

SEQ ID NO: 9709 - DNA, 20 bp, Artificial Sequence
  Description of Artificial Sequence: Synthetic oligonucleotide
  Target: DMPK; (-) strand; PAM type: NRG; PAM sequence: GAG
cagggtcagggtcatgctgg

SEQ ID NO: 9710 - DNA, 20 bp, Artificial Sequence
  Description of Artificial Sequence: Synthetic oligonucleotide
  Target: DMPK; (-) strand; PAM type: NRG; PAM sequence: GGG
gtcagggtcagggtcatgct

SEQ ID NO: 9711 - DNA, 20 bp, Artificial Sequence
  Description of Artificial Sequence: Synthetic oligonucleotide
  Target: DMPK; (-) strand; PAM type: NRG; PAM sequence: TGG
ggtcagggtcagggtcatgc

SEQ ID NO: 9712 - DNA, 20 bp, Artificial Sequence
  Description of Artificial Sequence: Synthetic oligonucleotide
  Target: DMPK; (-) strand; PAM type: NRG; PAM sequence: GGG
ccgcctcagggtcagggtca

SEQ ID NO: 9713 - DNA, 20 bp, Artificial Sequence
  Description of Artificial Sequence: Synthetic oligonucleotide
  Target: DMPK; (-) strand; PAM type: NRG; PAM sequence: AGG
cccgcctcagggtcagggtc

SEQ ID NO: 9714 - DNA, 20 bp, Artificial Sequence
  Description of Artificial Sequence: Synthetic oligonucleotide
  Target: DMPK; (-) strand; PAM type: NRG; PAM sequence: CAG
ccccgcctcagggtcagggt

SEQ ID NO: 9715 - DNA, 20 bp, Artificial Sequence
  Description of Artificial Sequence: Synthetic oligonucleotide
  Target: DMPK; (-) strand; PAM type: NRG; PAM sequence: GGG
tgcaccccgcctcagggtca

SEQ ID NO: 9716 - DNA, 20 bp, Artificial Sequence
  Description of Artificial Sequence: Synthetic oligonucleotide
  Target: DMPK; (-) strand; PAM type: NRG; PAM sequence: AGG
ctgcaccccgcctcagggtc

SEQ ID NO: 9717 - DNA, 20 bp, Artificial Sequence
  Description of Artificial Sequence: Synthetic oligonucleotide
  Target: DMPK; (-) strand; PAM type: NRG; PAM sequence: CAG
tctgcaccccgcctcagggt

SEQ ID NO: 9718 - DNA, 20 bp, Artificial Sequence
  Description of Artificial Sequence: Synthetic oligonucleotide
  Target: DMPK; (-) strand; PAM type: NRG; PAM sequence: GGG
cctctctgcaccccgcctca

SEQ ID NO: 9719 - DNA, 20 bp, Artificial Sequence
  Description of Artificial Sequence: Synthetic oligonucleotide
  Target: DMPK; (-) strand; PAM type: NRG; PAM sequence: AGG
gcctctctgcaccccgcctc

SEQ ID NO: 9720 - DNA, 20 bp, Artificial Sequence
  Description of Artificial Sequence: Synthetic oligonucleotide
  Target: DMPK; (-) strand; PAM type: NRG; PAM sequence: CAG
ggcctctctgcaccccgcct

SEQ ID NO: 9721 - DNA, 20 bp, Artificial Sequence
  Description of Artificial Sequence: Synthetic oligonucleotide
  Target: DMPK; (-) strand; PAM type: NRG; PAM sequence: TGG
aggctgccaacagcctccca

SEQ ID NO: 9722 - DNA, 20 bp, Artificial Sequence
  Description of Artificial Sequence: Synthetic oligonucleotide
  Target: DMPK; (-) strand; PAM type: NRG; PAM sequence: CAG
acagcaggctaggctgccaa

SEQ ID NO: 9723 - DNA, 20 bp, Artificial Sequence
  Description of Artificial Sequence: Synthetic oligonucleotide
  Target: DMPK; (-) strand; PAM type: NRG; PAM sequence: AGG
cttaggagtcacagcaggct

SEQ ID NO: 9724 - DNA, 20 bp, Artificial Sequence
  Description of Artificial Sequence: Synthetic oligonucleotide
  Target: DMPK; (-) strand; PAM type: NRG; PAM sequence: TAG
gcttaggagtcacagcaggc

SEQ ID NO: 9725 - DNA, 20 bp, Artificial Sequence
  Description of Artificial Sequence: Synthetic oligonucleotide
  Target: DMPK; (-) strand; PAM type: NRG; PAM sequence: AGG
catggcttaggagtcacagc

SEQ ID NO: 9726 - DNA, 20 bp, Artificial Sequence
  Description of Artificial Sequence: Synthetic oligonucleotide
  Target: DMPK; (-) strand; PAM type: NRG; PAM sequence: CAG
ccatggcttaggagtcacag

SEQ ID NO: 9727 - DNA, 20 bp, Artificial Sequence
  Description of Artificial Sequence: Synthetic oligonucleotide
  Target: DMPK; (-) strand; PAM type: NRG; PAM sequence: CAG
gagccatggcttaggagtca

SEQ ID NO: 9728 - DNA, 20 bp, Artificial Sequence
  Description of Artificial Sequence: Synthetic oligonucleotide
  Target: DMPK; (-) strand; PAM type: NRG; PAM sequence: GAG
gactcagagccatggcttag

SEQ ID NO: 9729 - DNA, 20 bp, Artificial Sequence
  Description of Artificial Sequence: Synthetic oligonucleotide
  Target: DMPK; (-) strand; PAM type: NRG; PAM sequence: AGG
gtgactcagagccatggctt

SEQ ID NO: 9730 - DNA, 20 bp, Artificial Sequence
  Description of Artificial Sequence: Synthetic oligonucleotide
  Target: DMPK; (-) strand; PAM type: NRG; PAM sequence: TAG
tgtgactcagagccatggct

SEQ ID NO: 9731 - DNA, 20 bp, Artificial Sequence
  Description of Artificial Sequence: Synthetic oligonucleotide
  Target: DMPK; (-) strand; PAM type: NRG; PAM sequence: TGG
gtggctgtgactcagagcca

SEQ ID NO: 9732 - DNA, 20 bp, Artificial Sequence
  Description of Artificial Sequence: Synthetic oligonucleotide
  Target: DMPK; (-) strand; PAM type: NRG; PAM sequence: GAG
gctagggtggctgtgactca

SEQ ID NO: 9733 - DNA, 20 bp, Artificial Sequence
  Description of Artificial Sequence: Synthetic oligonucleotide
  Target: DMPK; (-) strand; PAM type: NRG; PAM sequence: CAG
aggctagggtggctgtgact

SEQ ID NO: 9734 - DNA, 20 bp, Artificial Sequence
  Description of Artificial Sequence: Synthetic oligonucleotide
  Target: DMPK; (-) strand; PAM type: NRG; PAM sequence: TGG
aaggtcagcagaggctaggg

SEQ ID NO: 9735 - DNA, 20 bp, Artificial Sequence
  Description of Artificial Sequence: Synthetic oligonucleotide
  Target: DMPK; (-) strand; PAM type: NRG; PAM sequence: GGG
agtaaggtcagcagaggcta

SEQ ID NO: 9736 - DNA, 20 bp, Artificial Sequence
  Description of Artificial Sequence: Synthetic oligonucleotide
  Target: DMPK; (-) strand; PAM type: NRG; PAM sequence: AGG
gagtaaggtcagcagaggct

SEQ ID NO: 9737 - DNA, 20 bp, Artificial Sequence
  Description of Artificial Sequence: Synthetic oligonucleotide
  Target: DMPK; (-) strand; PAM type: NRG; PAM sequence: TAG
agagtaaggtcagcagaggc

SEQ ID NO: 9738 - DNA, 20 bp, Artificial Sequence
  Description of Artificial Sequence: Synthetic oligonucleotide
  Target: DMPK; (-) strand; PAM type: NRG; PAM sequence: AGG
gggcagagtaaggtcagcag

SEQ ID NO: 9739 - DNA, 20 bp, Artificial Sequence
  Description of Artificial Sequence: Synthetic oligonucleotide
  Target: DMPK; (-) strand; PAM type: NRG; PAM sequence: GAG
ggggcagagtaaggtcagca

SEQ ID NO: 9740 - DNA, 20 bp, Artificial Sequence
  Description of Artificial Sequence: Synthetic oligonucleotide
  Target: DMPK; (-) strand; PAM type: NRG; PAM sequence: CAG
gaggggcagagtaaggtcag

SEQ ID NO: 9741 - DNA, 20 bp, Artificial Sequence
  Description of Artificial Sequence: Synthetic oligonucleotide
  Target: DMPK; (-) strand; PAM type: NRG; PAM sequence: CAG
ctggaggggcagagtaaggt

SEQ ID NO: 9742 - DNA, 20 bp, Artificial Sequence
  Description of Artificial Sequence: Synthetic oligonucleotide
  Target: DMPK; (-) strand; PAM type: NRG; PAM sequence: AGG
cactctggaggggcagagta

SEQ ID NO: 9743 - DNA, 20 bp, Artificial Sequence
  Description of Artificial Sequence: Synthetic oligonucleotide
  Target: DMPK; (-) strand; PAM type: NRG; PAM sequence: AAG
ccactctggaggggcagagt

SEQ ID NO: 9744 - DNA, 20 bp, Artificial Sequence
  Description of Artificial Sequence: Synthetic oligonucleotide
  Target: DMPK; (-) strand; PAM type: NRG; PAM sequence: GAG
gccaccactctggaggggca

SEQ ID NO: 9745 - DNA, 20 bp, Artificial Sequence
  Description of Artificial Sequence: Synthetic oligonucleotide
  Target: DMPK; (-) strand; PAM type: NRG; PAM sequence: CAG
atgccaccactctggagggg

SEQ ID NO: 9746 - DNA, 20 bp, Artificial Sequence
  Description of Artificial Sequence: Synthetic oligonucleotide
  Target: DMPK; (-) strand; PAM type: NRG; PAM sequence: GGG
cctatgccaccactctggag

SEQ ID NO: 9747 - DNA, 20 bp, Artificial Sequence
  Description of Artificial Sequence: Synthetic oligonucleotide
  Target: DMPK; (-) strand; PAM type: NRG; PAM sequence: GGG
tcctatgccaccactctgga

SEQ ID NO: 9748 - DNA, 20 bp, Artificial Sequence
  Description of Artificial Sequence: Synthetic oligonucleotide
  Target: DMPK; (-) strand; PAM type: NRG; PAM sequence: AGG
gtcctatgccaccactctgg

SEQ ID NO: 9749 - DNA, 20 bp, Artificial Sequence
  Description of Artificial Sequence: Synthetic oligonucleotide
  Target: DMPK; (-) strand; PAM type: NRG; PAM sequence: GAG
tgtcctatgccaccactctg

SEQ ID NO: 9750 - DNA, 20 bp, Artificial Sequence
  Description of Artificial Sequence: Synthetic oligonucleotide
  Target: DMPK; (-) strand; PAM type: NRG; PAM sequence: TGG
tctgtcctatgccaccactc

SEQ ID NO: 9751 - DNA, 20 bp, Artificial Sequence
  Description of Artificial Sequence: Synthetic oligonucleotide
  Target: DMPK; (-) strand; PAM type: NRG; PAM sequence: GGG
gagtgtggacctgggccctg

SEQ ID NO: 9752 - DNA, 20 bp, Artificial Sequence
  Description of Artificial Sequence: Synthetic oligonucleotide
  Target: DMPK; (-) strand; PAM type: NRG; PAM sequence: GGG
agagtgtggacctgggccct

SEQ ID NO: 9753 - DNA, 20 bp, Artificial Sequence
  Description of Artificial Sequence: Synthetic oligonucleotide
  Target: DMPK; (-) strand; PAM type: NRG; PAM sequence: TGG
cagagtgtggacctgggccc

SEQ ID NO: 9754 - DNA, 20 bp, Artificial Sequence
  Description of Artificial Sequence: Synthetic oligonucleotide
  Target: DMPK; (-) strand; PAM type: NRG; PAM sequence: GGG
ggggctcagagtgtggacct

SEQ ID NO: 9755 - DNA, 20 bp, Artificial Sequence
  Description of Artificial Sequence: Synthetic oligonucleotide
  Target: DMPK; (-) strand; PAM type: NRG; PAM sequence: TGG
tggggctcagagtgtggacc

SEQ ID NO: 9756 - DNA, 20 bp, Artificial Sequence
  Description of Artificial Sequence: Synthetic oligonucleotide
  Target: DMPK; (-) strand; PAM type: NRG; PAM sequence: TGG
ccatcctggggctcagagtg

SEQ ID NO: 9757 - DNA, 20 bp, Artificial Sequence
  Description of Artificial Sequence: Synthetic oligonucleotide
  Target: DMPK; (-) strand; PAM type: NRG; PAM sequence: GAG
tcctcccatcctggggctca

SEQ ID NO: 9758 - DNA, 20 bp, Artificial Sequence
  Description of Artificial Sequence: Synthetic oligonucleotide
  Target: DMPK; (-) strand; PAM type: NRG; PAM sequence: CAG
gatcctcccatcctggggct

SEQ ID NO: 9759 - DNA, 20 bp, Artificial Sequence
  Description of Artificial Sequence: Synthetic oligonucleotide
  Target: DMPK; (-) strand; PAM type: NRG; PAM sequence: GGG
ggggagatcctcccatcctg

SEQ ID NO: 9760 - DNA, 20 bp, Artificial Sequence
  Description of Artificial Sequence: Synthetic oligonucleotide
  Target: DMPK; (-) strand; PAM type: NRG; PAM sequence: GGG
tggggagatcctcccatcct

SEQ ID NO: 9761 - DNA, 20 bp, Artificial Sequence
  Description of Artificial Sequence: Synthetic oligonucleotide
  Target: DMPK; (-) strand; PAM type: NRG; PAM sequence: TGG
atggggagatcctcccatcc

SEQ ID NO: 9762 - DNA, 20 bp, Artificial Sequence
  Description of Artificial Sequence: Synthetic oligonucleotide
  Target: DMPK; (-) strand; PAM type: NRG; PAM sequence: GAG
gatggcaggatgggcatggg

SEQ ID NO: 9763 - DNA, 20 bp, Artificial Sequence
  Description of Artificial Sequence: Synthetic oligonucleotide
  Target: DMPK; (-) strand; PAM type: NRG; PAM sequence: GGG
aggatggcaggatgggcatg

SEQ ID NO: 9764 - DNA, 20 bp, Artificial Sequence
  Description of Artificial Sequence: Synthetic oligonucleotide
  Target: DMPK; (-) strand; PAM type: NRG; PAM sequence: GGG
caggatggcaggatgggcat

SEQ ID NO: 9765 - DNA, 20 bp, Artificial Sequence
  Description of Artificial Sequence: Synthetic oligonucleotide
  Target: DMPK; (-) strand; PAM type: NRG; PAM sequence: TGG
gcaggatggcaggatgggca

SEQ ID NO: 9766 - DNA, 20 bp, Artificial Sequence
  Description of Artificial Sequence: Synthetic oligonucleotide
  Target: DMPK; (-) strand; PAM type: NRG; PAM sequence: GGG
ggggggcaggatggcaggat

SEQ ID NO: 9767 - DNA, 20 bp, Artificial Sequence
  Description of Artificial Sequence: Synthetic oligonucleotide
  Target: DMPK; (-) strand; PAM type: NRG; PAM sequence: TGG
gggggggcaggatggcagga

SEQ ID NO: 9768 - DNA, 20 bp, Artificial Sequence
  Description of Artificial Sequence: Synthetic oligonucleotide
  Target: DMPK; (-) strand; PAM type: NRG; PAM sequence: AGG
tgttgggggggcaggatggc

SEQ ID NO: 9769 - DNA, 20 bp, Artificial Sequence
  Description of Artificial Sequence: Synthetic oligonucleotide
  Target: DMPK; (-) strand; PAM type: NRG; PAM sequence: CAG
ctgttgggggggcaggatgg

SEQ ID NO: 9770 - DNA, 20 bp, Artificial Sequence
  Description of Artificial Sequence: Synthetic oligonucleotide
  Target: DMPK; (-) strand; PAM type: NRG; PAM sequence: TGG
tggctgttgggggggcagga

SEQ ID NO: 9771 - DNA, 20 bp, Artificial Sequence
  Description of Artificial Sequence: Synthetic oligonucleotide
  Target: DMPK; (-) strand; PAM type: NRG; PAM sequence: AGG
ggcctggctgttgggggggc

SEQ ID NO: 9772 - DNA, 20 bp, Artificial Sequence
  Description of Artificial Sequence: Synthetic oligonucleotide
  Target: DMPK; (-) strand; PAM type: NRG; PAM sequence: CAG
aggcctggctgttggggggg

SEQ ID NO: 9773 - DNA, 20 bp, Artificial Sequence
  Description of Artificial Sequence: Synthetic oligonucleotide
  Target: DMPK; (-) strand; PAM type: NRG; PAM sequence: GGG
cagaggcctggctgttgggg

SEQ ID NO: 9774 - DNA, 20 bp, Artificial Sequence
  Description of Artificial Sequence: Synthetic oligonucleotide
  Target: DMPK; (-) strand; PAM type: NRG; PAM sequence: GGG
acagaggcctggctgttggg

SEQ ID NO: 9775 - DNA, 20 bp, Artificial Sequence
  Description of Artificial Sequence: Synthetic oligonucleotide
  Target: DMPK; (-) strand; PAM type: NRG; PAM sequence: GGG
cacagaggcctggctgttgg

SEQ ID NO: 9776 - DNA, 20 bp, Artificial Sequence
  Description of Artificial Sequence: Synthetic oligonucleotide
  Target: DMPK; (-) strand; PAM type: NRG; PAM sequence: GGG
gcacagaggcctggctgttg

SEQ ID NO: 9777 - DNA, 20 bp, Artificial Sequence
  Description of Artificial Sequence: Synthetic oligonucleotide
  Target: DMPK; (-) strand; PAM type: NRG; PAM sequence: GGG
ggcacagaggcctggctgtt

SEQ ID NO: 9778 - DNA, 20 bp, Artificial Sequence
  Description of Artificial Sequence: Synthetic oligonucleotide
  Target: DMPK; (-) strand; PAM type: NRG; PAM sequence: TGG
gggcacagaggcctggctgt

SEQ ID NO: 9779 - DNA, 20 bp, Artificial Sequence
  Description of Artificial Sequence: Synthetic oligonucleotide
  Target: DMPK; (-) strand; PAM type: NRG; PAM sequence: TGG
caggtctgggcacagaggcc

SEQ ID NO: 9780 - DNA, 20 bp, Artificial Sequence
  Description of Artificial Sequence: Synthetic oligonucleotide
  Target: DMPK; (-) strand; PAM type: NRG; PAM sequence: AGG
ggagacaggtctgggcacag

SEQ ID NO: 9781 - DNA, 20 bp, Artificial Sequence
  Description of Artificial Sequence: Synthetic oligonucleotide
  Target: DMPK; (-) strand; PAM type: NRG; PAM sequence: GAG
aggagacaggtctgggcaca

SEQ ID NO: 9782 - DNA, 20 bp, Artificial Sequence
  Description of Artificial Sequence: Synthetic oligonucleotide
  Target: DMPK; (-) strand; PAM type: NRG; PAM sequence: CAG
gcaggagacaggtctgggca

SEQ ID NO: 9783 - DNA, 20 bp, Artificial Sequence
  Description of Artificial Sequence: Synthetic oligonucleotide
  Target: DMPK; (-) strand; PAM type: NRG; PAM sequence: GGG
gtggggcaggagacaggtct

SEQ ID NO: 9784 - DNA, 20 bp, Artificial Sequence
  Description of Artificial Sequence: Synthetic oligonucleotide
  Target: DMPK; (-) strand; PAM type: NRG; PAM sequence: TGG
ggtggggcaggagacaggtc

SEQ ID NO: 9785 - DNA, 20 bp, Artificial Sequence
  Description of Artificial Sequence: Synthetic oligonucleotide
  Target: DMPK; (-) strand; PAM type: NRG; PAM sequence: AGG
gtgggggtggggcaggagac

SEQ ID NO: 9786 - DNA, 20 bp, Artificial Sequence
  Description of Artificial Sequence: Synthetic oligonucleotide
  Target: DMPK; (-) strand; PAM type: NRG; PAM sequence: CAG
ggtgggggtggggcaggaga

SEQ ID NO: 9787 - DNA, 20 bp, Artificial Sequence
  Description of Artificial Sequence: Synthetic oligonucleotide
  Target: DMPK; (-) strand; PAM type: NRG; PAM sequence: GAG
atggggtgggggtggggcag

SEQ ID NO: 9788 - DNA, 20 bp, Artificial Sequence
  Description of Artificial Sequence: Synthetic oligonucleotide
  Target: DMPK; (-) strand; PAM type: NRG; PAM sequence: AGG
agatggggtgggggtggggc

SEQ ID NO: 9789 - DNA, 20 bp, Artificial Sequence
  Description of Artificial Sequence: Synthetic oligonucleotide
  Target: DMPK; (-) strand; PAM type: NRG; PAM sequence: CAG
cagatggggtgggggtgggg

SEQ ID NO: 9790 - DNA, 20 bp, Artificial Sequence
  Description of Artificial Sequence: Synthetic oligonucleotide
  Target: DMPK; (-) strand; PAM type: NRG; PAM sequence: GGG
ctgcagatggggtgggggtg

SEQ ID NO: 9791 - DNA, 20 bp, Artificial Sequence
  Description of Artificial Sequence: Synthetic oligonucleotide
  Target: DMPK; (-) strand; PAM type: NRG; PAM sequence: GGG
cctgcagatggggtgggggt

SEQ ID NO: 9792 - DNA, 20 bp, Artificial Sequence
  Description of Artificial Sequence: Synthetic oligonucleotide
  Target: DMPK; (-) strand; PAM type: NRG; PAM sequence: TGG
tcctgcagatggggtggggg

SEQ ID NO: 9793 - DNA, 20 bp, Artificial Sequence
  Description of Artificial Sequence: Synthetic oligonucleotide
  Target: DMPK; (-) strand; PAM type: NRG; PAM sequence: GGG
ggctcctgcagatggggtgg

SEQ ID NO: 9794 - DNA, 20 bp, Artificial Sequence
  Description of Artificial Sequence: Synthetic oligonucleotide
  Target: DMPK; (-) strand; PAM type: NRG; PAM sequence: GGG
gggctcctgcagatggggtg

SEQ ID NO: 9795 - DNA, 20 bp, Artificial Sequence
  Description of Artificial Sequence: Synthetic oligonucleotide
  Target: DMPK; (-) strand; PAM type: NRG; PAM sequence: GGG
ggggctcctgcagatggggt

SEQ ID NO: 9796 - DNA, 20 bp, Artificial Sequence
  Description of Artificial Sequence: Synthetic oligonucleotide
  Target: DMPK; (-) strand; PAM type: NRG; PAM sequence: TGG
cggggctcctgcagatgggg

SEQ ID NO: 9797 - DNA, 20 bp, Artificial Sequence
  Description of Artificial Sequence: Synthetic oligonucleotide
  Target: DMPK; (-) strand; PAM type: NRG; PAM sequence: GGG
cctcggggctcctgcagatg

SEQ ID NO: 9798 - DNA, 20 bp, Artificial Sequence
  Description of Artificial Sequence: Synthetic oligonucleotide
  Target: DMPK; (-) strand; PAM type: NRG; PAM sequence: GGG
ccctcggggctcctgcagat

SEQ ID NO: 9799 - DNA, 20 bp, Artificial Sequence
  Description of Artificial Sequence: Synthetic oligonucleotide
  Target: DMPK; (-) strand; PAM type: NRG; PAM sequence: TGG
accctcggggctcctgcaga

SEQ ID NO: 9800 - DNA, 20 bp, Artificial Sequence
  Description of Artificial Sequence: Synthetic oligonucleotide
  Target: DMPK; (-) strand; PAM type: NRG; PAM sequence: CAG
gcctaccctcggggctcctg

SEQ ID NO: 9801 - DNA, 20 bp, Artificial Sequence
  Description of Artificial Sequence: Synthetic oligonucleotide
  Target: DMPK; (-) strand; PAM type: NRG; PAM sequence: GGG
ggggtgagtgcctaccctcg

SEQ ID NO: 9802 - DNA, 20 bp, Artificial Sequence
  Description of Artificial Sequence: Synthetic oligonucleotide
  Target: DMPK; (-) strand; PAM type: NRG; PAM sequence: GGG
tggggtgagtgcctaccctc

SEQ ID NO: 9803 - DNA, 20 bp, Artificial Sequence
  Description of Artificial Sequence: Synthetic oligonucleotide
  Target: DMPK; (-) strand; PAM type: NRG; PAM sequence: CGG
gtggggtgagtgcctaccct

SEQ ID NO: 9804 - DNA, 20 bp, Artificial Sequence
  Description of Artificial Sequence: Synthetic oligonucleotide
  Target: DMPK; (-) strand; PAM type: NRG; PAM sequence: GAG
ccgacttcttgcagtggggt

SEQ ID NO: 9805 - DNA, 20 bp, Artificial Sequence
  Description of Artificial Sequence: Synthetic oligonucleotide
  Target: DMPK; (-) strand; PAM type: NRG; PAM sequence: GGG
gtggccgacttcttgcagtg

SEQ ID NO: 9806 - DNA, 20 bp, Artificial Sequence
  Description of Artificial Sequence: Synthetic oligonucleotide
  Target: DMPK; (-) strand; PAM type: NRG; PAM sequence: GGG
cgtggccgacttcttgcagt

SEQ ID NO: 9807 - DNA, 20 bp, Artificial Sequence
  Description of Artificial Sequence: Synthetic oligonucleotide
  Target: DMPK; (-) strand; PAM type: NRG; PAM sequence: TGG
acgtggccgacttcttgcag

SEQ ID NO: 9808 - DNA, 20 bp, Artificial Sequence
  Description of Artificial Sequence: Synthetic oligonucleotide
  Target: DMPK; (-) strand; PAM type: NRG; PAM sequence: CAG
agtacgtggccgacttcttg

SEQ ID NO: 9809 - DNA, 20 bp, Artificial Sequence
  Description of Artificial Sequence: Synthetic oligonucleotide
  Target: DMPK; (-) strand; PAM type: NRG; PAM sequence: TGG
actggcccaggacaagtacg

SEQ ID NO: 9810 - DNA, 20 bp, Artificial Sequence
  Description of Artificial Sequence: Synthetic oligonucleotide
  Target: DMPK; (-) strand; PAM type: NRG; PAM sequence: AAG
cctccgaactggcccaggac

SEQ ID NO: 9811 - DNA, 20 bp, Artificial Sequence
  Description of Artificial Sequence: Synthetic oligonucleotide
  Target: DMPK; (-) strand; PAM type: NRG; PAM sequence: AGG
gggcgcctccgaactggccc

SEQ ID NO: 9812 - DNA, 20 bp, Artificial Sequence
  Description of Artificial Sequence: Synthetic oligonucleotide
  Target: DMPK; (-) strand; PAM type: NRG; PAM sequence: CAG
tgggcgcctccgaactggcc

SEQ ID NO: 9813 - DNA, 20 bp, Artificial Sequence
  Description of Artificial Sequence: Synthetic oligonucleotide
  Target: DMPK; (-) strand; PAM type: NRG; PAM sequence: TGG
ggagctgggcgcctccgaac

SEQ ID NO: 9814 - DNA, 20 bp, Artificial Sequence
  Description of Artificial Sequence: Synthetic oligonucleotide
  Target: DMPK; (-) strand; PAM type: NRG; PAM sequence: GGG
ctgggcgtccaccaggagct

SEQ ID NO: 9815 - DNA, 20 bp, Artificial Sequence
  Description of Artificial Sequence: Synthetic oligonucleotide
  Target: DMPK; (-) strand; PAM type: NRG; PAM sequence: TGG
cctgggcgtccaccaggagc

SEQ ID NO: 9816 - DNA, 20 bp, Artificial Sequence
  Description of Artificial Sequence: Synthetic oligonucleotide
  Target: DMPK; (-) strand; PAM type: NRG; PAM sequence: GAG
ttctcctgggcgtccaccag

SEQ ID NO: 9817 - DNA, 20 bp, Artificial Sequence
  Description of Artificial Sequence: Synthetic oligonucleotide
  Target: DMPK; (-) strand; PAM type: NRG; PAM sequence: AGG
ccttctcctgggcgtccacc

SEQ ID NO: 9818 - DNA, 20 bp, Artificial Sequence
  Description of Artificial Sequence: Synthetic oligonucleotide
  Target: DMPK; (-) strand; PAM type: NRG; PAM sequence: CAG
accttctcctgggcgtccac

SEQ ID NO: 9819 - DNA, 20 bp, Artificial Sequence
  Description of Artificial Sequence: Synthetic oligonucleotide
  Target: DMPK; (-) strand; PAM type: NRG; PAM sequence: GGG
cccctgctcgaccttctcct

SEQ ID NO: 9820 - DNA, 20 bp, Artificial Sequence
  Description of Artificial Sequence: Synthetic oligonucleotide
  Target: DMPK; (-) strand; PAM type: NRG; PAM sequence: TGG
gcccctgctcgaccttctcc

SEQ ID NO: 9821 - DNA, 20 bp, Artificial Sequence
  Description of Artificial Sequence: Synthetic oligonucleotide
  Target: DMPK; (-) strand; PAM type: NRG; PAM sequence: GAG
acccgggcttcctggggctg

SEQ ID NO: 9822 - DNA, 20 bp, Artificial Sequence
  Description of Artificial Sequence: Synthetic oligonucleotide
  Target: DMPK; (-) strand; PAM type: NRG; PAM sequence: TGG
ggacccgggcttcctggggc

SEQ ID NO: 9823 - DNA, 20 bp, Artificial Sequence
  Description of Artificial Sequence: Synthetic oligonucleotide
  Target: DMPK; (-) strand; PAM type: NRG; PAM sequence: GGG
tgttggacccgggcttcctg

SEQ ID NO: 9824 - DNA, 20 bp, Artificial Sequence
  Description of Artificial Sequence: Synthetic oligonucleotide
  Target: DMPK; (-) strand; PAM type: NRG; PAM sequence: GGG
gtgttggacccgggcttcct

SEQ ID NO: 9825 - DNA, 20 bp, Artificial Sequence
  Description of Artificial Sequence: Synthetic oligonucleotide
  Target: DMPK; (-) strand; PAM type: NRG; PAM sequence: TGG
ggtgttggacccgggcttcc

SEQ ID NO: 9826 - DNA, 20 bp, Artificial Sequence
  Description of Artificial Sequence: Synthetic oligonucleotide
  Target: DMPK; (-) strand; PAM type: NRG; PAM sequence: GGG
cagcagctggtgttggaccc

SEQ ID NO: 9827 - DNA, 20 bp, Artificial Sequence
  Description of Artificial Sequence: Synthetic oligonucleotide
  Target: DMPK; (-) strand; PAM type: NRG; PAM sequence: CGG
ccagcagctggtgttggacc

SEQ ID NO: 9828 - DNA, 20 bp, Artificial Sequence
  Description of Artificial Sequence: Synthetic oligonucleotide
  Target: DMPK; (-) strand; PAM type: NRG; PAM sequence: TGG
gcggctccagcagctggtgt

SEQ ID NO: 9829 - DNA, 20 bp, Artificial Sequence
  Description of Artificial Sequence: Synthetic oligonucleotide
  Target: DMPK; (-) strand; PAM type: NRG; PAM sequence: TGG
gctgaggcggctccagcagc

SEQ ID NO: 9830 - DNA, 20 bp, Artificial Sequence
  Description of Artificial Sequence: Synthetic oligonucleotide
  Target: DMPK; (-) strand; PAM type: NRG; PAM sequence: CAG
tgcggctgaggcggctccag

SEQ ID NO: 9831 - DNA, 20 bp, Artificial Sequence
  Description of Artificial Sequence: Synthetic oligonucleotide
  Target: DMPK; (-) strand; PAM type: NRG; PAM sequence: CAG
aggtgcggctgaggcggctc

SEQ ID NO: 9832 - DNA, 20 bp, Artificial Sequence
  Description of Artificial Sequence: Synthetic oligonucleotide
  Target: DMPK; (-) strand; PAM type: NRG; PAM sequence: CGG
cagccgaggtgcggctgagg

SEQ ID NO: 9833 - DNA, 20 bp, Artificial Sequence
  Description of Artificial Sequence: Synthetic oligonucleotide
  Target: DMPK; (-) strand; PAM type: NRG; PAM sequence: AGG
tgtcagccgaggtgcggctg

SEQ ID NO: 9834 - DNA, 20 bp, Artificial Sequence
  Description of Artificial Sequence: Synthetic oligonucleotide
  Target: DMPK; (-) strand; PAM type: NRG; PAM sequence: GAG
atgtcagccgaggtgcggct

SEQ ID NO: 9835 - DNA, 20 bp, Artificial Sequence
  Description of Artificial Sequence: Synthetic oligonucleotide
  Target: DMPK; (-) strand; PAM type: NRG; PAM sequence: CGG
ccaacatgtcagccgaggtg

SEQ ID NO: 9836 - DNA, 20 bp, Artificial Sequence
  Description of Artificial Sequence: Synthetic oligonucleotide
  Target: DMPK; (-) strand; PAM type: NRG; PAM sequence: AGG
cctgtccaacatgtcagccg

SEQ ID NO: 9837 - DNA, 20 bp, Artificial Sequence
  Description of Artificial Sequence: Synthetic oligonucleotide
  Target: DMPK; (-) strand; PAM type: NRG; PAM sequence: GAG
gcctgtccaacatgtcagcc

SEQ ID NO: 9838 - DNA, 20 bp, Artificial Sequence
  Description of Artificial Sequence: Synthetic oligonucleotide
  Target: DMPK; (-) strand; PAM type: NRG; PAM sequence: CAG
gtgctgcctgtccaacatgt

SEQ ID NO: 9839 - DNA, 20 bp, Artificial Sequence
  Description of Artificial Sequence: Synthetic oligonucleotide
  Target: DMPK; (-) strand; PAM type: NRG; PAM sequence: TGG
cccggcccggggaggggcca

SEQ ID NO: 9840 - DNA, 20 bp, Artificial Sequence
  Description of Artificial Sequence: Synthetic oligonucleotide
  Target: DMPK; (-) strand; PAM type: NRG; PAM sequence: GGG
cgagcccccggcccggggag

SEQ ID NO: 9841 - DNA, 20 bp, Artificial Sequence
  Description of Artificial Sequence: Synthetic oligonucleotide
  Target: DMPK; (-) strand; PAM type: NRG; PAM sequence: GGG
ccgagcccccggcccgggga

SEQ ID NO: 9842 - DNA, 20 bp, Artificial Sequence
  Description of Artificial Sequence: Synthetic oligonucleotide
  Target: DMPK; (-) strand; PAM type: NRG; PAM sequence: AGG
cccgagcccccggcccgggg

SEQ ID NO: 9843 - DNA, 20 bp, Artificial Sequence
  Description of Artificial Sequence: Synthetic oligonucleotide
  Target: DMPK; (-) strand; PAM type: NRG; PAM sequence: GAG
ccccgagcccccggcccggg

SEQ ID NO: 9844 - DNA, 20 bp, Artificial Sequence
  Description of Artificial Sequence: Synthetic oligonucleotide
  Target: DMPK; (-) strand; PAM type: NRG; PAM sequence: GGG
gaccccgagcccccggcccg

SEQ ID NO: 9845 - DNA, 20 bp, Artificial Sequence
  Description of Artificial Sequence: Synthetic oligonucleotide
  Target: DMPK; (-) strand; PAM type: NRG; PAM sequence: GGG
ggaccccgagcccccggccc

SEQ ID NO: 9846 - DNA, 20 bp, Artificial Sequence
  Description of Artificial Sequence: Synthetic oligonucleotide
  Target: DMPK; (-) strand; PAM type: NRG; PAM sequence: CGG
aggaccccgagcccccggcc

SEQ ID NO: 9847 - DNA, 20 bp, Artificial Sequence
  Description of Artificial Sequence: Synthetic oligonucleotide
  Target: DMPK; (-) strand; PAM type: NRG; PAM sequence: CGG
acaggaggaccccgagcccc

SEQ ID NO: 9848 - DNA, 20 bp, Artificial Sequence
  Description of Artificial Sequence: Synthetic oligonucleotide
  Target: DMPK; (-) strand; PAM type: NRG; PAM sequence: GAG
ccctgtgacaggaggacccc

SEQ ID NO: 9849 - DNA, 20 bp, Artificial Sequence
  Description of Artificial Sequence: Synthetic oligonucleotide
  Target: DMPK; (-) strand; PAM type: NRG; PAM sequence: AGG
ctgccaggccctgtgacagg

SEQ ID NO: 9850 - DNA, 20 bp, Artificial Sequence
  Description of Artificial Sequence: Synthetic oligonucleotide
  Target: DMPK; (-) strand; PAM type: NRG; PAM sequence: GAG
gctgccaggccctgtgacag

SEQ ID NO: 9851 - DNA, 20 bp, Artificial Sequence
  Description of Artificial Sequence: Synthetic oligonucleotide
  Target: DMPK; (-) strand; PAM type: NRG; PAM sequence: AGG
gggctgccaggccctgtgac

SEQ ID NO: 9852 - DNA, 20 bp, Artificial Sequence
  Description of Artificial Sequence: Synthetic oligonucleotide
  Target: DMPK; (-) strand; PAM type: NRG; PAM sequence: CAG
ggggctgccaggccctgtga

SEQ ID NO: 9853 - DNA, 20 bp, Artificial Sequence
  Description of Artificial Sequence: Synthetic oligonucleotide
  Target: DMPK; (-) strand; PAM type: NRG; PAM sequence: AGG
gggcctggacaggggctgcc

SEQ ID NO: 9854 - DNA, 20 bp, Artificial Sequence
  Description of Artificial Sequence: Synthetic oligonucleotide
  Target: DMPK; (-) strand; PAM type: NRG; PAM sequence: CAG
agggcctggacaggggctgc

SEQ ID NO: 9855 - DNA, 20 bp, Artificial Sequence
  Description of Artificial Sequence: Synthetic oligonucleotide
  Target: DMPK; (-) strand; PAM type: NRG; PAM sequence: GGG
gggctccagggcctggacag

SEQ ID NO: 9856 - DNA, 20 bp, Artificial Sequence
  Description of Artificial Sequence: Synthetic oligonucleotide
  Target: DMPK; (-) strand; PAM type: NRG; PAM sequence: GGG
agggctccagggcctggaca

SEQ ID NO: 9857 - DNA, 20 bp, Artificial Sequence
  Description of Artificial Sequence: Synthetic oligonucleotide
  Target: DMPK; (-) strand; PAM type: NRG; PAM sequence: AGG
cagggctccagggcctggac

SEQ ID NO: 9858 - DNA, 20 bp, Artificial Sequence
  Description of Artificial Sequence: Synthetic oligonucleotide
  Target: DMPK; (-) strand; PAM type: NRG; PAM sequence: CAG
ccagggctccagggcctgga

SEQ ID NO: 9859 - DNA, 20 bp, Artificial Sequence
  Description of Artificial Sequence: Synthetic oligonucleotide
  Target: DMPK; (-) strand; PAM type: NRG; PAM sequence: TGG
gcagccagggctccagggcc

SEQ ID NO: 9860 - DNA, 20 bp, Artificial Sequence
  Description of Artificial Sequence: Synthetic oligonucleotide
  Target: DMPK; (-) strand; PAM type: NRG; PAM sequence: GGG
gacatgcagccagggctcca

SEQ ID NO: 9861 - DNA, 20 bp, Artificial Sequence
  Description of Artificial Sequence: Synthetic oligonucleotide
  Target: DMPK; (-) strand; PAM type: NRG; PAM sequence: AGG
agacatgcagccagggctcc

SEQ ID NO: 9862 - DNA, 20 bp, Artificial Sequence
  Description of Artificial Sequence: Synthetic oligonucleotide
  Target: DMPK; (-) strand; PAM type: NRG; PAM sequence: CAG
cagacatgcagccagggctc

SEQ ID NO: 9863 - DNA, 20 bp, Artificial Sequence
  Description of Artificial Sequence: Synthetic oligonucleotide
  Target: DMPK; (-) strand; PAM type: NRG; PAM sequence: GGG
gacaggcagacatgcagcca

SEQ ID NO: 9864 - DNA, 20 bp, Artificial Sequence
  Description of Artificial Sequence: Synthetic oligonucleotide
  Target: DMPK; (-) strand; PAM type: NRG; PAM sequence: AGG
ggacaggcagacatgcagcc

SEQ ID NO: 9865 - DNA, 20 bp, Artificial Sequence
  Description of Artificial Sequence: Synthetic oligonucleotide
  Target: DMPK; (-) strand; PAM type: NRG; PAM sequence: CAG
gggacaggcagacatgcagc

SEQ ID NO: 9866 - DNA, 20 bp, Artificial Sequence
  Description of Artificial Sequence: Synthetic oligonucleotide
  Target: DMPK; (-) strand; PAM type: NRG; PAM sequence: CAG
gccagggacaggcagacatg

SEQ ID NO: 9867 - DNA, 20 bp, Artificial Sequence
  Description of Artificial Sequence: Synthetic oligonucleotide
  Target: DMPK; (-) strand; PAM type: NRG; PAM sequence: CAG
aggggacagccagggacagg

SEQ ID NO: 9868 - DNA, 20 bp, Artificial Sequence
  Description of Artificial Sequence: Synthetic oligonucleotide
  Target: DMPK; (-) strand; PAM type: NRG; PAM sequence: AGG
cccaggggacagccagggac

SEQ ID NO: 9869 - DNA, 20 bp, Artificial Sequence
  Description of Artificial Sequence: Synthetic oligonucleotide
  Target: DMPK; (-) strand; PAM type: NRG; PAM sequence: CAG
gcccaggggacagccaggga

SEQ ID NO: 9870 - DNA, 20 bp, Artificial Sequence
  Description of Artificial Sequence: Synthetic oligonucleotide
  Target: DMPK; (-) strand; PAM type: NRG; PAM sequence: GGG
agaggcccaggggacagcca

SEQ ID NO: 9871 - DNA, 20 bp, Artificial Sequence
  Description of Artificial Sequence: Synthetic oligonucleotide
  Target: DMPK; (-) strand; PAM type: NRG; PAM sequence: AGG
gagaggcccaggggacagcc

SEQ ID NO: 9872 - DNA, 20 bp, Artificial Sequence
  Description of Artificial Sequence: Synthetic oligonucleotide
  Target: DMPK; (-) strand; PAM type: NRG; PAM sequence: CAG
agagaggcccaggggacagc

SEQ ID NO: 9873 - DNA, 20 bp, Artificial Sequence
  Description of Artificial Sequence: Synthetic oligonucleotide
  Target: DMPK; (-) strand; PAM type: NRG; PAM sequence: CAG
ggccagagaggcccagggga

SEQ ID NO: 9874 - DNA, 20 bp, Artificial Sequence
  Description of Artificial Sequence: Synthetic oligonucleotide
  Target: DMPK; (-) strand; PAM type: NRG; PAM sequence: GGG
aagtggccagagaggcccag

SEQ ID NO: 9875 - DNA, 20 bp, Artificial Sequence
  Description of Artificial Sequence: Synthetic oligonucleotide
  Target: DMPK; (-) strand; PAM type: NRG; PAM sequence: GGG
gaagtggccagagaggccca

SEQ ID NO: 9876 - DNA, 20 bp, Artificial Sequence
  Description of Artificial Sequence: Synthetic oligonucleotide
  Target: DMPK; (-) strand; PAM type: NRG; PAM sequence: AGG
agaagtggccagagaggccc

SEQ ID NO: 9877 - DNA, 20 bp, Artificial Sequence
  Description of Artificial Sequence: Synthetic oligonucleotide
  Target: DMPK; (-) strand; PAM type: NRG; PAM sequence: CAG
gagaagtggccagagaggcc

SEQ ID NO: 9878 - DNA, 20 bp, Artificial Sequence
  Description of Artificial Sequence: Synthetic oligonucleotide
  Target: DMPK; (-) strand; PAM type: NRG; PAM sequence: AGG
gcagagagaagtggccagag

SEQ ID NO: 9879 - DNA, 20 bp, Artificial Sequence
  Description of Artificial Sequence: Synthetic oligonucleotide
  Target: DMPK; (-) strand; PAM type: NRG; PAM sequence: GAG
cgcagagagaagtggccaga

SEQ ID NO: 9880 - DNA, 20 bp, Artificial Sequence
  Description of Artificial Sequence: Synthetic oligonucleotide
  Target: DMPK; (-) strand; PAM type: NRG; PAM sequence: GAG
gccgcagagagaagtggcca

SEQ ID NO: 9881 - DNA, 20 bp, Artificial Sequence
  Description of Artificial Sequence: Synthetic oligonucleotide
  Target: DMPK; (-) strand; PAM type: NRG; PAM sequence: CAG
cggccgcagagagaagtggc

SEQ ID NO: 9882 - DNA, 20 bp, Artificial Sequence
  Description of Artificial Sequence: Synthetic oligonucleotide
  Target: DMPK; (-) strand; PAM type: NRG; PAM sequence: TGG
cggccggccgcagagagaag

SEQ ID NO: 9883 - DNA, 20 bp, Artificial Sequence
  Description of Artificial Sequence: Synthetic oligonucleotide
  Target: DMPK; (-) strand; PAM type: NRG; PAM sequence: AAG
cctcggccggccgcagagag

SEQ ID NO: 9884 - DNA, 20 bp, Artificial Sequence
  Description of Artificial Sequence: Synthetic oligonucleotide
  Target: DMPK; (-) strand; PAM type: NRG; PAM sequence: GAG
aggcctcggccggccgcaga

SEQ ID NO: 9885 - DNA, 20 bp, Artificial Sequence
  Description of Artificial Sequence: Synthetic oligonucleotide
  Target: DMPK; (-) strand; PAM type: NRG; PAM sequence: GAG
ggaggcctcggccggccgca

SEQ ID NO: 9886 - DNA, 20 bp, Artificial Sequence
  Description of Artificial Sequence: Synthetic oligonucleotide
  Target: DMPK; (-) strand; PAM type: NRG; PAM sequence: CAG
gaggaggcctcggccggccg

SEQ ID NO: 9887 - DNA, 20 bp, Artificial Sequence
  Description of Artificial Sequence: Synthetic oligonucleotide
  Target: DMPK; (-) strand; PAM type: NRG; PAM sequence: CGG
gaaggggaggaggcctcggc

SEQ ID NO: 9888 - DNA, 20 bp, Artificial Sequence
  Description of Artificial Sequence: Synthetic oligonucleotide
  Target: DMPK; (-) strand; PAM type: NRG; PAM sequence: CGG
gggagaaggggaggaggcct

SEQ ID NO: 9889 - DNA, 20 bp, Artificial Sequence
  Description of Artificial Sequence: Synthetic oligonucleotide
  Target: DMPK; (-) strand; PAM type: NRG; PAM sequence: AGG
ggggtggggagaaggggagg

SEQ ID NO: 9890 - DNA, 20 bp, Artificial Sequence
  Description of Artificial Sequence: Synthetic oligonucleotide
  Target: DMPK; (-) strand; PAM type: NRG; PAM sequence: GAG
aggggtggggagaaggggag

SEQ ID NO: 9891 - DNA, 20 bp, Artificial Sequence
  Description of Artificial Sequence: Synthetic oligonucleotide
  Target: DMPK; (-) strand; PAM type: NRG; PAM sequence: AGG
caaggggtggggagaagggg

SEQ ID NO: 9892 - DNA, 20 bp, Artificial Sequence
  Description of Artificial Sequence: Synthetic oligonucleotide
  Target: DMPK; (-) strand; PAM type: NRG; PAM sequence: GAG
ccaaggggtggggagaaggg

SEQ ID NO: 9893 - DNA, 20 bp, Artificial Sequence
  Description of Artificial Sequence: Synthetic oligonucleotide
  Target: DMPK; (-) strand; PAM type: NRG; PAM sequence: GGG
gaccaaggggtggggagaag

SEQ ID NO: 9894 - DNA, 20 bp, Artificial Sequence
  Description of Artificial Sequence: Synthetic oligonucleotide
  Target: DMPK; (-) strand; PAM type: NRG; PAM sequence: GGG
ggaccaaggggtggggagaa

SEQ ID NO: 9895 - DNA, 20 bp, Artificial Sequence
  Description of Artificial Sequence: Synthetic oligonucleotide
  Target: DMPK; (-) strand; PAM type: NRG; PAM sequence: AGG
tggaccaaggggtggggaga

SEQ ID NO: 9896 - DNA, 20 bp, Artificial Sequence
  Description of Artificial Sequence: Synthetic oligonucleotide
  Target: DMPK; (-) strand; PAM type: NRG; PAM sequence: AAG
ctggaccaaggggtggggag

SEQ ID NO: 9897 - DNA, 20 bp, Artificial Sequence
  Description of Artificial Sequence: Synthetic oligonucleotide
  Target: DMPK; (-) strand; PAM type: NRG; PAM sequence: GAG
gggctggaccaaggggtggg

SEQ ID NO: 9898 - DNA, 20 bp, Artificial Sequence
  Description of Artificial Sequence: Synthetic oligonucleotide
  Target: DMPK; (-) strand; PAM type: NRG; PAM sequence: GGG
gggggctggaccaaggggtg

SEQ ID NO: 9899 - DNA, 20 bp, Artificial Sequence
  Description of Artificial Sequence: Synthetic oligonucleotide
  Target: DMPK; (-) strand; PAM type: NRG; PAM sequence: GGG
ggggggctggaccaaggggt

SEQ ID NO: 9900 - DNA, 20 bp, Artificial Sequence
  Description of Artificial Sequence: Synthetic oligonucleotide
  Target: DMPK; (-) strand; PAM type: NRG; PAM sequence: TGG
aggggggctggaccaagggg

SEQ ID NO: 9901 - DNA, 20 bp, Artificial Sequence
  Description of Artificial Sequence: Synthetic oligonucleotide
  Target: DMPK; (-) strand; PAM type: NRG; PAM sequence: GGG
gggaggggggctggaccaag

SEQ ID NO: 9902 - DNA, 20 bp, Artificial Sequence
  Description of Artificial Sequence: Synthetic oligonucleotide
  Target: DMPK; (-) strand; PAM type: NRG; PAM sequence: GGG
cgggaggggggctggaccaa

SEQ ID NO: 9903 - DNA, 20 bp, Artificial Sequence
  Description of Artificial Sequence: Synthetic oligonucleotide
  Target: DMPK; (-) strand; PAM type: NRG; PAM sequence: AGG
gcgggaggggggctggacca

SEQ ID NO: 9904 - DNA, 20 bp, Artificial Sequence
  Description of Artificial Sequence: Synthetic oligonucleotide
  Target: DMPK; (-) strand; PAM type: NRG; PAM sequence: AAG
ggcgggaggggggctggacc

SEQ ID NO: 9905 - DNA, 20 bp, Artificial Sequence
  Description of Artificial Sequence: Synthetic oligonucleotide
  Target: DMPK; (-) strand; PAM type: NRG; PAM sequence: TGG
ctgggaggcgggaggggggc

SEQ ID NO: 9906 - DNA, 20 bp, Artificial Sequence
  Description of Artificial Sequence: Synthetic oligonucleotide
  Target: DMPK; (-) strand; PAM type: NRG; PAM sequence: GGG
aaggctgggaggcgggaggg

SEQ ID NO: 9907 - DNA, 20 bp, Artificial Sequence
  Description of Artificial Sequence: Synthetic oligonucleotide
  Target: DMPK; (-) strand; PAM type: NRG; PAM sequence: GGG
taaggctgggaggcgggagg

SEQ ID NO: 9908 - DNA, 20 bp, Artificial Sequence
  Description of Artificial Sequence: Synthetic oligonucleotide
  Target: DMPK; (-) strand; PAM type: NRG; PAM sequence: GGG
ttaaggctgggaggcgggag

SEQ ID NO: 9909 - DNA, 20 bp, Artificial Sequence
  Description of Artificial Sequence: Synthetic oligonucleotide
  Target: DMPK; (-) strand; PAM type: NRG; PAM sequence: GGG
gttaaggctgggaggcggga

SEQ ID NO: 9910 - DNA, 20 bp, Artificial Sequence
  Description of Artificial Sequence: Synthetic oligonucleotide
  Target: DMPK; (-) strand; PAM type: NRG; PAM sequence: AGG
ggttaaggctgggaggcggg

SEQ ID NO: 9911 - DNA, 20 bp, Artificial Sequence
  Description of Artificial Sequence: Synthetic oligonucleotide
  Target: DMPK; (-) strand; PAM type: NRG; PAM sequence: GAG
gggttaaggctgggaggcgg

SEQ ID NO: 9912 - DNA, 20 bp, Artificial Sequence
  Description of Artificial Sequence: Synthetic oligonucleotide
  Target: DMPK; (-) strand; PAM type: NRG; PAM sequence: GGG
aggggttaaggctgggaggc

SEQ ID NO: 9913 - DNA, 20 bp, Artificial Sequence
  Description of Artificial Sequence: Synthetic oligonucleotide
  Target: DMPK; (-) strand; PAM type: NRG; PAM sequence: CGG
gaggggttaaggctgggagg

SEQ ID NO: 9914 - DNA, 20 bp, Artificial Sequence
  Description of Artificial Sequence: Synthetic oligonucleotide
  Target: DMPK; (-) strand; PAM type: NRG; PAM sequence: AGG
tgtgaggggttaaggctggg

SEQ ID NO: 9915 - DNA, 20 bp, Artificial Sequence
  Description of Artificial Sequence: Synthetic oligonucleotide
  Target: DMPK; (-) strand; PAM type: NRG; PAM sequence: GAG
ttgtgaggggttaaggctgg

SEQ ID NO: 9916 - DNA, 20 bp, Artificial Sequence
  Description of Artificial Sequence: Synthetic oligonucleotide
  Target: DMPK; (-) strand; PAM type: NRG; PAM sequence: GGG
gcttgtgaggggttaaggct

SEQ ID NO: 9917 - DNA, 20 bp, Artificial Sequence
  Description of Artificial Sequence: Synthetic oligonucleotide
  Target: DMPK; (-) strand; PAM type: NRG; PAM sequence: TGG
ggcttgtgaggggttaaggc

SEQ ID NO: 9918 - DNA, 20 bp, Artificial Sequence
  Description of Artificial Sequence: Synthetic oligonucleotide
  Target: DMPK; (-) strand; PAM type: NRG; PAM sequence: AGG
ggctggcttgtgaggggtta

SEQ ID NO: 9919 - DNA, 20 bp, Artificial Sequence
  Description of Artificial Sequence: Synthetic oligonucleotide
  Target: DMPK; (-) strand; PAM type: NRG; PAM sequence: AAG
gggctggcttgtgaggggtt

SEQ ID NO: 9920 - DNA, 20 bp, Artificial Sequence
  Description of Artificial Sequence: Synthetic oligonucleotide
  Target: DMPK; (-) strand; PAM type: NRG; PAM sequence: GGG
ttggggggctggcttgtgag

SEQ ID NO: 9921 - DNA, 20 bp, Artificial Sequence
  Description of Artificial Sequence: Synthetic oligonucleotide
  Target: DMPK; (-) strand; PAM type: NRG; PAM sequence: GGG
cttggggggctggcttgtga

SEQ ID NO: 9922 - DNA, 20 bp, Artificial Sequence
  Description of Artificial Sequence: Synthetic oligonucleotide
  Target: DMPK; (-) strand; PAM type: NRG; PAM sequence: AGG
gcttggggggctggcttgtg

SEQ ID NO: 9923 - DNA, 20 bp, Artificial Sequence
  Description of Artificial Sequence: Synthetic oligonucleotide
  Target: DMPK; (-) strand; PAM type: NRG; PAM sequence: GAG
agcttggggggctggcttgt

SEQ ID NO: 9924 - DNA, 20 bp, Artificial Sequence
  Description of Artificial Sequence: Synthetic oligonucleotide
  Target: DMPK; (-) strand; PAM type: NRG; PAM sequence: TGG
aaggagggagcttggggggc

SEQ ID NO: 9925 - DNA, 20 bp, Artificial Sequence
  Description of Artificial Sequence: Synthetic oligonucleotide
  Target: DMPK; (-) strand; PAM type: NRG; PAM sequence: GGG
ctggaaggagggagcttggg

SEQ ID NO: 9926 - DNA, 20 bp, Artificial Sequence
  Description of Artificial Sequence: Synthetic oligonucleotide
  Target: DMPK; (-) strand; PAM type: NRG; PAM sequence: GGG
cctggaaggagggagcttgg

SEQ ID NO: 9927 - DNA, 20 bp, Artificial Sequence
  Description of Artificial Sequence: Synthetic oligonucleotide
  Target: DMPK; (-) strand; PAM type: NRG; PAM sequence: GGG
ccctggaaggagggagcttg

SEQ ID NO: 9928 - DNA, 20 bp, Artificial Sequence
  Description of Artificial Sequence: Synthetic oligonucleotide
  Target: DMPK; (-) strand; PAM type: NRG; PAM sequence: GGG
gccctggaaggagggagctt

SEQ ID NO: 9929 - DNA, 20 bp, Artificial Sequence
  Description of Artificial Sequence: Synthetic oligonucleotide
  Target: DMPK; (-) strand; PAM type: NRG; PAM sequence: TGG
ggccctggaaggagggagct

SEQ ID NO: 9930 - DNA, 20 bp, Artificial Sequence
  Description of Artificial Sequence: Synthetic oligonucleotide
  Target: DMPK; (-) strand; PAM type: NRG; PAM sequence: GAG
tgaagggccctggaaggagg

SEQ ID NO: 9931 - DNA, 20 bp, Artificial Sequence
  Description of Artificial Sequence: Synthetic oligonucleotide
  Target: DMPK; (-) strand; PAM type: NRG; PAM sequence: GGG
tctgaagggccctggaagga

SEQ ID NO: 9932 - DNA, 20 bp, Artificial Sequence
  Description of Artificial Sequence: Synthetic oligonucleotide
  Target: DMPK; (-) strand; PAM type: NRG; PAM sequence: AGG
ttctgaagggccctggaagg

SEQ ID NO: 9933 - DNA, 20 bp, Artificial Sequence
  Description of Artificial Sequence: Synthetic oligonucleotide
  Target: DMPK; (-) strand; PAM type: NRG; PAM sequence: GAG
gttctgaagggccctggaag

SEQ ID NO: 9934 - DNA, 20 bp, Artificial Sequence
  Description of Artificial Sequence: Synthetic oligonucleotide
  Target: DMPK; (-) strand; PAM type: NRG; PAM sequence: AGG
gggttctgaagggccctgga

SEQ ID NO: 9935 - DNA, 20 bp, Artificial Sequence
  Description of Artificial Sequence: Synthetic oligonucleotide
  Target: DMPK; (-) strand; PAM type: NRG; PAM sequence: AAG
agggttctgaagggccctgg

SEQ ID NO: 9936 - DNA, 20 bp, Artificial Sequence
  Description of Artificial Sequence: Synthetic oligonucleotide
  Target: DMPK; (-) strand; PAM type: NRG; PAM sequence: TGG
tgaagggttctgaagggccc

SEQ ID NO: 9937 - DNA, 20 bp, Artificial Sequence
  Description of Artificial Sequence: Synthetic oligonucleotide
  Target: DMPK; (-) strand; PAM type: NRG; PAM sequence: GGG
tagcactgaagggttctgaa

SEQ ID NO: 9938 - DNA, 20 bp, Artificial Sequence
  Description of Artificial Sequence: Synthetic oligonucleotide
  Target: DMPK; (-) strand; PAM type: NRG; PAM sequence: AGG
ctagcactgaagggttctga

SEQ ID NO: 9939 - DNA, 20 bp, Artificial Sequence
  Description of Artificial Sequence: Synthetic oligonucleotide
  Target: DMPK; (-) strand; PAM type: NRG; PAM sequence: AAG
tctagcactgaagggttctg

SEQ ID NO: 9940 - DNA, 20 bp, Artificial Sequence
  Description of Artificial Sequence: Synthetic oligonucleotide
  Target: DMPK; (-) strand; PAM type: NRG; PAM sequence: GGG
ccccctactctagcactgaa

SEQ ID NO: 9941 - DNA, 20 bp, Artificial Sequence
  Description of Artificial Sequence: Synthetic oligonucleotide
  Target: DMPK; (-) strand; PAM type: NRG; PAM sequence: AGG
tccccctactctagcactga

SEQ ID NO: 9942 - DNA, 20 bp, Artificial Sequence
  Description of Artificial Sequence: Synthetic oligonucleotide
  Target: DMPK; (-) strand; PAM type: NRG; PAM sequence: AAG
ttccccctactctagcactg

SEQ ID NO: 9943 - DNA, 20 bp, Artificial Sequence
  Description of Artificial Sequence: Synthetic oligonucleotide
  Target: DMPK; (-) strand; PAM type: NRG; PAM sequence: TAG
tccatgcattccccctactc

SEQ ID NO: 9944 - DNA, 20 bp, Artificial Sequence
  Description of Artificial Sequence: Synthetic oligonucleotide
  Target: DMPK; (-) strand; PAM type: NRG; PAM sequence: GAG
ggggtgacagtgtgacagct

SEQ ID NO: 9945 - DNA, 20 bp, Artificial Sequence
  Description of Artificial Sequence: Synthetic oligonucleotide
  Target: DMPK; (-) strand; PAM type: NRG; PAM sequence: CAG
ttattggggtgacagtgtga

SEQ ID NO: 9946 - DNA, 20 bp, Artificial Sequence
  Description of Artificial Sequence: Synthetic oligonucleotide
  Target: DMPK; (-) strand; PAM type: NRG; PAM sequence: CAG
ctacctttttattggggtga

SEQ ID NO: 9947 - DNA, 20 bp, Artificial Sequence
  Description of Artificial Sequence: Synthetic oligonucleotide
  Target: DMPK; (-) strand; PAM type: NRG; PAM sequence: GGG
tgtgctctacctttttattg

SEQ ID NO: 9948 - DNA, 20 bp, Artificial Sequence
  Description of Artificial Sequence: Synthetic oligonucleotide
  Target: DMPK; (-) strand; PAM type: NRG; PAM sequence: GGG
ctgtgctctacctttttatt

SEQ ID NO: 9949 - DNA, 20 bp, Artificial Sequence
  Description of Artificial Sequence: Synthetic oligonucleotide
  Target: DMPK; (-) strand; PAM type: NRG; PAM sequence: TGG
tctgtgctctacctttttat

SEQ ID NO: 9950 - DNA, 20 bp, Artificial Sequence
  Description of Artificial Sequence: Synthetic oligonucleotide
  Target: DMPK; (-) strand; PAM type: NRG; PAM sequence: TGG
cttgaaattcatcacacctg

SEQ ID NO: 9951 - DNA, 20 bp, Artificial Sequence
  Description of Artificial Sequence: Synthetic oligonucleotide
  Target: DMPK; (-) strand; PAM type: NRG; PAM sequence: AGG
gccctgtttcagcaatgggc

SEQ ID NO: 9952 - DNA, 20 bp, Artificial Sequence
  Description of Artificial Sequence: Synthetic oligonucleotide
  Target: DMPK; (-) strand; PAM type: NRG; PAM sequence: CAG
ggccctgtttcagcaatggg

SEQ ID NO: 9953 - DNA, 20 bp, Artificial Sequence
  Description of Artificial Sequence: Synthetic oligonucleotide
  Target: DMPK; (-) strand; PAM type: NRG; PAM sequence: GGG
attggccctgtttcagcaat

SEQ ID NO: 9954 - DNA, 20 bp, Artificial Sequence
  Description of Artificial Sequence: Synthetic oligonucleotide
  Target: DMPK; (-) strand; PAM type: NRG; PAM sequence: TGG
aattggccctgtttcagcaa

SEQ ID NO: 9955 - DNA, 20 bp, Artificial Sequence
  Description of Artificial Sequence: Synthetic oligonucleotide
  Target: DMPK; (-) strand; PAM type: NRG; PAM sequence: CAG
agcctcaattggccctgttt

SEQ ID NO: 9956 - DNA, 20 bp, Artificial Sequence
  Description of Artificial Sequence: Synthetic oligonucleotide
  Target: DMPK; (-) strand; PAM type: NRG; PAM sequence: TGG
ctgggtcactcagcctcaat

SEQ ID NO: 9957 - DNA, 20 bp, Artificial Sequence
  Description of Artificial Sequence: Synthetic oligonucleotide
  Target: DMPK; (-) strand; PAM type: NRG; PAM sequence: CAG
gtggttgctactgggtcact

SEQ ID NO: 9958 - DNA, 20 bp, Artificial Sequence
  Description of Artificial Sequence: Synthetic oligonucleotide
  Target: DMPK; (-) strand; PAM type: NRG; PAM sequence: GGG
gcaagggggtggttgctact

SEQ ID NO: 9959 - DNA, 20 bp, Artificial Sequence
  Description of Artificial Sequence: Synthetic oligonucleotide
  Target: DMPK; (-) strand; PAM type: NRG; PAM sequence: TGG
agcaagggggtggttgctac

SEQ ID NO: 9960 - DNA, 20 bp, Artificial Sequence
  Description of Artificial Sequence: Synthetic oligonucleotide
  Target: DMPK; (-) strand; PAM type: NRG; PAM sequence: TGG
gcttgtcgggagcaaggggg

SEQ ID NO: 9961 - DNA, 20 bp, Artificial Sequence
  Description of Artificial Sequence: Synthetic oligonucleotide
  Target: DMPK; (-) strand; PAM type: NRG; PAM sequence: GGG
ggagcttgtcgggagcaagg

SEQ ID NO: 9962 - DNA, 20 bp, Artificial Sequence
  Description of Artificial Sequence: Synthetic oligonucleotide
  Target: DMPK; (-) strand; PAM type: NRG; PAM sequence: GGG
tggagcttgtcgggagcaag

SEQ ID NO: 9963 - DNA, 20 bp, Artificial Sequence
  Description of Artificial Sequence: Synthetic oligonucleotide
  Target: DMPK; (-) strand; PAM type: NRG; PAM sequence: GGG
ctggagcttgtcgggagcaa

SEQ ID NO: 9964 - DNA, 20 bp, Artificial Sequence
  Description of Artificial Sequence: Synthetic oligonucleotide
  Target: DMPK; (-) strand; PAM type: NRG; PAM sequence: AGG
tctggagcttgtcgggagca

SEQ ID NO: 9965 - DNA, 20 bp, Artificial Sequence
  Description of Artificial Sequence: Synthetic oligonucleotide
  Target: DMPK; (-) strand; PAM type: NRG; PAM sequence: AAG
ttctggagcttgtcgggagc

SEQ ID NO: 9966 - DNA, 20 bp, Artificial Sequence
  Description of Artificial Sequence: Synthetic oligonucleotide
  Target: DMPK; (-) strand; PAM type: NRG; PAM sequence: GAG
ccagttctggagcttgtcgg

SEQ ID NO: 9967 - DNA, 20 bp, Artificial Sequence
  Description of Artificial Sequence: Synthetic oligonucleotide
  Target: DMPK; (-) strand; PAM type: NRG; PAM sequence: GGG
ccccagttctggagcttgtc

SEQ ID NO: 9968 - DNA, 20 bp, Artificial Sequence
  Description of Artificial Sequence: Synthetic oligonucleotide
  Target: DMPK; (-) strand; PAM type: NRG; PAM sequence: CGG
cccccagttctggagcttgt

SEQ ID NO: 9969 - DNA, 20 bp, Artificial Sequence
  Description of Artificial Sequence: Synthetic oligonucleotide
  Target: DMPK; (-) strand; PAM type: NRG; PAM sequence: GAG
ccccctagcccccagttctg

SEQ ID NO: 9970 - DNA, 20 bp, Artificial Sequence
  Description of Artificial Sequence: Synthetic oligonucleotide
  Target: DMPK; (-) strand; PAM type: NRG; PAM sequence: TGG
caccccctagcccccagttc

SEQ ID NO: 9971 - DNA, 20 bp, Artificial Sequence
  Description of Artificial Sequence: Synthetic oligonucleotide
  Target: DMPK; (-) strand; PAM type: NRG; PAM sequence: CAG
agccctcaccccctagcccc

SEQ ID NO: 9972 - DNA, 20 bp, Artificial Sequence
  Description of Artificial Sequence: Synthetic oligonucleotide
  Target: DMPK; (-) strand; PAM type: NRG; PAM sequence: TAG
aacccccagccctcaccccc

SEQ ID NO: 9973 - DNA, 20 bp, Artificial Sequence
  Description of Artificial Sequence: Synthetic oligonucleotide
  Target: DMPK; (-) strand; PAM type: NRG; PAM sequence: CAG
tcccacccagccccaacccc

SEQ ID NO: 9974 - DNA, 20 bp, Artificial Sequence
  Description of Artificial Sequence: Synthetic oligonucleotide
  Target: DMPK; (-) strand; PAM type: NRG; PAM sequence: CAG
ctcaacccctttctcccacc

SEQ ID NO: 9975 - DNA, 20 bp, Artificial Sequence
  Description of Artificial Sequence: Synthetic oligonucleotide
  Target: DMPK; (-) strand; PAM type: NRG; PAM sequence: AGG
tggcctcccgtccccttccc

SEQ ID NO: 9976 - DNA, 20 bp, Artificial Sequence
  Description of Artificial Sequence: Synthetic oligonucleotide
  Target: DMPK; (-) strand; PAM type: NRG; PAM sequence: CAG
ctggcctcccgtccccttcc

SEQ ID NO: 9977 - DNA, 20 bp, Artificial Sequence
  Description of Artificial Sequence: Synthetic oligonucleotide
  Target: DMPK; (-) strand; PAM type: NRG; PAM sequence: TGG
agtcacccaagaagctgccc

SEQ ID NO: 9978 - DNA, 20 bp, Artificial Sequence
  Description of Artificial Sequence: Synthetic oligonucleotide
  Target: DMPK; (-) strand; PAM type: NRG; PAM sequence: AAG
ccatctctgagtcacccaag

SEQ ID NO: 9979 - DNA, 20 bp, Artificial Sequence
  Description of Artificial Sequence: Synthetic oligonucleotide
  Target: DMPK; (-) strand; PAM type: NRG; PAM sequence: AAG
aatccatctctgagtcaccc

SEQ ID NO: 9980 - DNA, 20 bp, Artificial Sequence
  Description of Artificial Sequence: Synthetic oligonucleotide
  Target: DMPK; (-) strand; PAM type: NRG; PAM sequence: GAG
ccgagtcggaatccatctct

SEQ ID NO: 9981 - DNA, 20 bp, Artificial Sequence
  Description of Artificial Sequence: Synthetic oligonucleotide
  Target: DMPK; (-) strand; PAM type: NRG; PAM sequence: CGG
ctaaatttaactgtccgagt

SEQ ID NO: 9982 - DNA, 20 bp, Artificial Sequence
  Description of Artificial Sequence: Synthetic oligonucleotide
  Target: DMPK; (-) strand; PAM type: NRG; PAM sequence: GAG
agggctaaatttaactgtcc

SEQ ID NO: 9983 - DNA, 20 bp, Artificial Sequence
  Description of Artificial Sequence: Synthetic oligonucleotide
  Target: DMPK; (-) strand; PAM type: NRG; PAM sequence: GGG
gtataaagcagagagcctga

SEQ ID NO: 9984 - DNA, 20 bp, Artificial Sequence
  Description of Artificial Sequence: Synthetic oligonucleotide
  Target: DMPK; (-) strand; PAM type: NRG; PAM sequence: AGG
ggtataaagcagagagcctg

SEQ ID NO: 9985 - DNA, 20 bp, Artificial Sequence
  Description of Artificial Sequence: Synthetic oligonucleotide
  Target: DMPK; (-) strand; PAM type: NRG; PAM sequence: GAG
tggtataaagcagagagcct

SEQ ID NO: 9986 - DNA, 20 bp, Artificial Sequence
  Description of Artificial Sequence: Synthetic oligonucleotide
  Target: DMPK; (-) strand; PAM type: NRG; PAM sequence: GAG
aaaagctggtataaagcaga

SEQ ID NO: 9987 - DNA, 20 bp, Artificial Sequence
  Description of Artificial Sequence: Synthetic oligonucleotide
  Target: DMPK; (-) strand; PAM type: NRG; PAM sequence: GAG
aaaaaagctggtataaagca

SEQ ID NO: 9988 - DNA, 20 bp, Artificial Sequence
  Description of Artificial Sequence: Synthetic oligonucleotide
  Target: DMPK; (-) strand; PAM type: NRG; PAM sequence: CAG
aaaaaaaagctggtataaag

SEQ ID NO: 9989 - DNA, 20 bp, Artificial Sequence
  Description of Artificial Sequence: Synthetic oligonucleotide
  Target: DMPK; (-) strand; PAM type: NRG; PAM sequence: AAG
aaaaaaaaaaagctggtata

SEQ ID NO: 9990 - DNA, 20 bp, Artificial Sequence
  Description of Artificial Sequence: Synthetic oligonucleotide
  Target: DMPK; (-) strand; PAM type: NRG; PAM sequence: TGG
aaaaaaaaaaaaaaaaaagc

SEQ ID NO: 9991 - DNA, 20 bp, Artificial Sequence
  Description of Artificial Sequence: Synthetic oligonucleotide
  Target: DMPK; (-) strand; PAM type: NRG; PAM sequence: AAG
aaaaaaaaaaaaaaaaaaaa

SEQ ID NO: 9992 - DNA, 20 bp, Artificial Sequence
  Description of Artificial Sequence: Synthetic oligonucleotide
  Target: DMPK; (-) strand; PAM type: NRG; PAM sequence: GGG
ccaccccttccccacctcct

SEQ ID NO: 9993 - DNA, 20 bp, Artificial Sequence
  Description of Artificial Sequence: Synthetic oligonucleotide
  Target: DMPK; (-) strand; PAM type: NRG; PAM sequence: TGG
accaccccttccccacctcc

SEQ ID NO: 9994 - DNA, 20 bp, Artificial Sequence
  Description of Artificial Sequence: Synthetic oligonucleotide
  Target: DMPK; (-) strand; PAM type: NRG; PAM sequence: TGG
gctctgagggtgccccctcc

SEQ ID NO: 9995 - DNA, 20 bp, Artificial Sequence
  Description of Artificial Sequence: Synthetic oligonucleotide
  Target: DMPK; (-) strand; PAM type: NRG; PAM sequence: GGG
cacccctgttcaggctctga

SEQ ID NO: 9996 - DNA, 20 bp, Artificial Sequence
  Description of Artificial Sequence: Synthetic oligonucleotide
  Target: DMPK; (-) strand; PAM type: NRG; PAM sequence: AGG
tcacccctgttcaggctctg

SEQ ID NO: 9997 - DNA, 20 bp, Artificial Sequence
  Description of Artificial Sequence: Synthetic oligonucleotide
  Target: DMPK; (-) strand; PAM type: NRG; PAM sequence: GAG
gtcacccctgttcaggctct

SEQ ID NO: 9998 - DNA, 20 bp, Artificial Sequence
  Description of Artificial Sequence: Synthetic oligonucleotide
  Target: DMPK; (-) strand; PAM type: NRG; PAM sequence: AGG
gcagcaggtcacccctgttc

SEQ ID NO: 9999 - DNA, 20 bp, Artificial Sequence
  Description of Artificial Sequence: Synthetic oligonucleotide
  Target: DMPK; (-) strand; PAM type: NRG; PAM sequence: CAG
ggcagcaggtcacccctgtt

SEQ ID NO: 10000 - DNA, 20 bp, Artificial Sequence
  Description of Artificial Sequence: Synthetic oligonucleotide
  Target: DMPK; (-) strand; PAM type: NRG; PAM sequence: AGG
tcccccagcctttgggcagc

SEQ ID NO: 10001 - DNA, 20 bp, Artificial Sequence
  Description of Artificial Sequence: Synthetic oligonucleotide
  Target: DMPK; (-) strand; PAM type: NRG; PAM sequence: CAG
ctcccccagcctttgggcag

SEQ ID NO: 10002 - DNA, 20 bp, Artificial Sequence
  Description of Artificial Sequence: Synthetic oligonucleotide
  Target: DMPK; (-) strand; PAM type: NRG; PAM sequence: CAG
ttcctcccccagcctttggg

SEQ ID NO: 10003 - DNA, 20 bp, Artificial Sequence
  Description of Artificial Sequence: Synthetic oligonucleotide
  Target: DMPK; (-) strand; PAM type: NRG; PAM sequence: GGG
actttcctcccccagccttt

SEQ ID NO: 10004 - DNA, 20 bp, Artificial Sequence
  Description of Artificial Sequence: Synthetic oligonucleotide
  Target: DMPK; (-) strand; PAM type: NRG; PAM sequence: TGG
cactttcctcccccagcctt

SEQ ID NO: 10005 - DNA, 20 bp, Artificial Sequence
  Description of Artificial Sequence: Synthetic oligonucleotide
  Target: DMPK; (-) strand; PAM type: NRG; PAM sequence: CAG
gctccaccactttcctcccc

SEQ ID NO: 10006 - DNA, 20 bp, Artificial Sequence
  Description of Artificial Sequence: Synthetic oligonucleotide
  Target: DMPK; (-) strand; PAM type: NRG; PAM sequence: TGG
tcgtttgcccagggagggct

SEQ ID NO: 10007 - DNA, 20 bp, Artificial Sequence
  Description of Artificial Sequence: Synthetic oligonucleotide
  Target: DMPK; (-) strand; PAM type: NRG; PAM sequence: GGG
gggtctcgtttgcccaggga

SEQ ID NO: 10008 - DNA, 20 bp, Artificial Sequence
  Description of Artificial Sequence: Synthetic oligonucleotide
  Target: DMPK; (-) strand; PAM type: NRG; PAM sequence: AGG
ggggtctcgtttgcccaggg

SEQ ID NO: 10009 - DNA, 20 bp, Artificial Sequence
  Description of Artificial Sequence: Synthetic oligonucleotide
  Target: DMPK; (-) strand; PAM type: NRG; PAM sequence: GAG
tggggtctcgtttgcccagg

SEQ ID NO: 10010 - DNA, 20 bp, Artificial Sequence
  Description of Artificial Sequence: Synthetic oligonucleotide
  Target: DMPK; (-) strand; PAM type: NRG; PAM sequence: GGG
tttggggtctcgtttgccca

SEQ ID NO: 10011 - DNA, 20 bp, Artificial Sequence
  Description of Artificial Sequence: Synthetic oligonucleotide
  Target: DMPK; (-) strand; PAM type: NRG; PAM sequence: AGG
ttttggggtctcgtttgccc

SEQ ID NO: 10012 - DNA, 20 bp, Artificial Sequence
  Description of Artificial Sequence: Synthetic oligonucleotide
  Target: DMPK; (-) strand; PAM type: NRG; PAM sequence: CAG
attttggggtctcgtttgcc

SEQ ID NO: 10013 - DNA, 20 bp, Artificial Sequence
  Description of Artificial Sequence: Synthetic oligonucleotide
  Target: DMPK; (-) strand; PAM type: NRG; PAM sequence: GGG
ggggccaaggagctattttg

SEQ ID NO: 10014 - DNA, 20 bp, Artificial Sequence
  Description of Artificial Sequence: Synthetic oligonucleotide
  Target: DMPK; (-) strand; PAM type: NRG; PAM sequence: GGG
aggggccaaggagctatttt

SEQ ID NO: 10015 - DNA, 20 bp, Artificial Sequence
  Description of Artificial Sequence: Synthetic oligonucleotide
  Target: DMPK; (-) strand; PAM type: NRG; PAM sequence: TGG
caggggccaaggagctattt

SEQ ID NO: 10016 - DNA, 20 bp, Artificial Sequence
  Description of Artificial Sequence: Synthetic oligonucleotide
  Target: DMPK; (-) strand; PAM type: NRG; PAM sequence: GAG
ctccccggccaggggccaag

SEQ ID NO: 10017 - DNA, 20 bp, Artificial Sequence
  Description of Artificial Sequence: Synthetic oligonucleotide
  Target: DMPK; (-) strand; PAM type: NRG; PAM sequence: AGG
ggctccccggccaggggcca

SEQ ID NO: 10018 - DNA, 20 bp, Artificial Sequence
  Description of Artificial Sequence: Synthetic oligonucleotide
  Target: DMPK; (-) strand; PAM type: NRG; PAM sequence: AAG
tggctccccggccaggggcc

SEQ ID NO: 10019 - DNA, 20 bp, Artificial Sequence
  Description of Artificial Sequence: Synthetic oligonucleotide
  Target: DMPK; (-) strand; PAM type: NRG; PAM sequence: GGG
gaatgtggctccccggccag

SEQ ID NO: 10020 - DNA, 20 bp, Artificial Sequence
  Description of Artificial Sequence: Synthetic oligonucleotide
  Target: DMPK; (-) strand; PAM type: NRG; PAM sequence: GGG
ggaatgtggctccccggcca

SEQ ID NO: 10021 - DNA, 20 bp, Artificial Sequence
  Description of Artificial Sequence: Synthetic oligonucleotide
  Target: DMPK; (-) strand; PAM type: NRG; PAM sequence: AGG
aggaatgtggctccccggcc

SEQ ID NO: 10022 - DNA, 20 bp, Artificial Sequence
  Description of Artificial Sequence: Synthetic oligonucleotide
  Target: DMPK; (-) strand; PAM type: NRG; PAM sequence: CAG
caggaatgtggctccccggc

SEQ ID NO: 10023 - DNA, 20 bp, Artificial Sequence
  Description of Artificial Sequence: Synthetic oligonucleotide
  Target: DMPK; (-) strand; PAM type: NRG; PAM sequence: CGG
tgggcaggaatgtggctccc

SEQ ID NO: 10024 - DNA, 20 bp, Artificial Sequence
  Description of Artificial Sequence: Synthetic oligonucleotide
  Target: DMPK; (-) strand; PAM type: NRG; PAM sequence: TGG
tcccagcctgggcaggaatg

SEQ ID NO: 10025 - DNA, 20 bp, Artificial Sequence
  Description of Artificial Sequence: Synthetic oligonucleotide
  Target: DMPK; (-) strand; PAM type: NRG; PAM sequence: AGG
tttctaatcccagcctgggc

SEQ ID NO: 10026 - DNA, 20 bp, Artificial Sequence
  Description of Artificial Sequence: Synthetic oligonucleotide
  Target: DMPK; (-) strand; PAM type: NRG; PAM sequence: CAG
gtttctaatcccagcctggg

SEQ ID NO: 10027 - DNA, 20 bp, Artificial Sequence
  Description of Artificial Sequence: Synthetic oligonucleotide
  Target: DMPK; (-) strand; PAM type: NRG; PAM sequence: GGG
tctgtttctaatcccagcct

SEQ ID NO: 10028 - DNA, 20 bp, Artificial Sequence
  Description of Artificial Sequence: Synthetic oligonucleotide
  Target: DMPK; (-) strand; PAM type: NRG; PAM sequence: TGG
ttctgtttctaatcccagcc

SEQ ID NO: 10029 - DNA, 20 bp, Artificial Sequence
  Description of Artificial Sequence: Synthetic oligonucleotide
  Target: DMPK; (-) strand; PAM type: NRG; PAM sequence: CAG
aatgtttctgtttctaatcc

SEQ ID NO: 10030 - DNA, 20 bp, Artificial Sequence
  Description of Artificial Sequence: Synthetic oligonucleotide
  Target: DMPK; (-) strand; PAM type: NRG; PAM sequence: GAG
ttggctctcggagccgcagg

SEQ ID NO: 10031 - DNA, 20 bp, Artificial Sequence
  Description of Artificial Sequence: Synthetic oligonucleotide
  Target: DMPK; (-) strand; PAM type: NRG; PAM sequence: GGG
tcttggctctcggagccgca

SEQ ID NO: 10032 - DNA, 20 bp, Artificial Sequence
  Description of Artificial Sequence: Synthetic oligonucleotide
  Target: DMPK; (-) strand; PAM type: NRG; PAM sequence: AGG
ctcttggctctcggagccgc

SEQ ID NO: 10033 - DNA, 20 bp, Artificial Sequence
  Description of Artificial Sequence: Synthetic oligonucleotide
  Target: DMPK; (-) strand; PAM type: NRG; PAM sequence: CAG
cctcttggctctcggagccg

SEQ ID NO: 10034 - DNA, 20 bp, Artificial Sequence
  Description of Artificial Sequence: Synthetic oligonucleotide
  Target: DMPK; (-) strand; PAM type: NRG; PAM sequence: GAG
cagattcctcttggctctcg

SEQ ID NO: 10035 - DNA, 20 bp, Artificial Sequence
  Description of Artificial Sequence: Synthetic oligonucleotide
  Target: DMPK; (-) strand; PAM type: NRG; PAM sequence: CGG
ctcagattcctcttggctct

SEQ ID NO: 10036 - DNA, 20 bp, Artificial Sequence
  Description of Artificial Sequence: Synthetic oligonucleotide
  Target: DMPK; (-) strand; PAM type: NRG; PAM sequence: TGG
agaagagctcagattcctct

SEQ ID NO: 10037 - DNA, 20 bp, Artificial Sequence
  Description of Artificial Sequence: Synthetic oligonucleotide
  Target: DMPK; (-) strand; PAM type: NRG; PAM sequence: CAG
ccaccctggaaagaagagct

SEQ ID NO: 10038 - DNA, 20 bp, Artificial Sequence
  Description of Artificial Sequence: Synthetic oligonucleotide
  Target: DMPK; (-) strand; PAM type: NRG; PAM sequence: GAG
accgtccaccctggaaagaa

SEQ ID NO: 10039 - DNA, 20 bp, Artificial Sequence
  Description of Artificial Sequence: Synthetic oligonucleotide
  Target: DMPK; (-) strand; PAM type: NRG; PAM sequence: AAG
gaaccgtccaccctggaaag

SEQ ID NO: 10040 - DNA, 20 bp, Artificial Sequence
  Description of Artificial Sequence: Synthetic oligonucleotide
  Target: DMPK; (-) strand; PAM type: NRG; PAM sequence: AAG
ggagaaccgtccaccctgga

SEQ ID NO: 10041 - DNA, 20 bp, Artificial Sequence
  Description of Artificial Sequence: Synthetic oligonucleotide
  Target: DMPK; (-) strand; PAM type: NRG; PAM sequence: TGG
ctctggagaaccgtccaccc

SEQ ID NO: 10042 - DNA, 20 bp, Artificial Sequence
  Description of Artificial Sequence: Synthetic oligonucleotide
  Target: DMPK; (-) strand; PAM type: NRG; PAM sequence: GAG
aggccccgacttccactctg

SEQ ID NO: 10043 - DNA, 20 bp, Artificial Sequence
  Description of Artificial Sequence: Synthetic oligonucleotide
  Target: DMPK; (-) strand; PAM type: NRG; PAM sequence: TGG
ggaggccccgacttccactc

SEQ ID NO: 10044 - DNA, 20 bp, Artificial Sequence
  Description of Artificial Sequence: Synthetic oligonucleotide
  Target: DMPK; (-) strand; PAM type: NRG; PAM sequence: AGG
aggcaccccaggccggttgg

SEQ ID NO: 10045 - DNA, 20 bp, Artificial Sequence
  Description of Artificial Sequence: Synthetic oligonucleotide
  Target: DMPK; (-) strand; PAM type: NRG; PAM sequence: GAG
caggcaccccaggccggttg

SEQ ID NO: 10046 - DNA, 20 bp, Artificial Sequence
  Description of Artificial Sequence: Synthetic oligonucleotide
  Target: DMPK; (-) strand; PAM type: NRG; PAM sequence: TGG
cccaggcaccccaggccggt

SEQ ID NO: 10047 - DNA, 20 bp, Artificial Sequence
  Description of Artificial Sequence: Synthetic oligonucleotide
  Target: DMPK; (-) strand; PAM type: NRG; PAM sequence: CGG
aaggcccaggcaccccaggc

SEQ ID NO: 10048 - DNA, 20 bp, Artificial Sequence
  Description of Artificial Sequence: Synthetic oligonucleotide
  Target: DMPK; (-) strand; PAM type: NRG; PAM sequence: AGG
tctcaaggcccaggcacccc

SEQ ID NO: 10049 - DNA, 20 bp, Artificial Sequence
  Description of Artificial Sequence: Synthetic oligonucleotide
  Target: DMPK; (-) strand; PAM type: NRG; PAM sequence: CAG
ctctcaaggcccaggcaccc

SEQ ID NO: 10050 - DNA, 20 bp, Artificial Sequence
  Description of Artificial Sequence: Synthetic oligonucleotide
  Target: DMPK; (-) strand; PAM type: NRG; PAM sequence: AGG
gcctggccctctcaaggccc

SEQ ID NO: 10051 - DNA, 20 bp, Artificial Sequence
  Description of Artificial Sequence: Synthetic oligonucleotide
  Target: DMPK; (-) strand; PAM type: NRG; PAM sequence: CAG
ggcctggccctctcaaggcc

SEQ ID NO: 10052 - DNA, 20 bp, Artificial Sequence
  Description of Artificial Sequence: Synthetic oligonucleotide
  Target: DMPK; (-) strand; PAM type: NRG; PAM sequence: AGG
tctcaggcctggccctctca

SEQ ID NO: 10053 - DNA, 20 bp, Artificial Sequence
  Description of Artificial Sequence: Synthetic oligonucleotide
  Target: DMPK; (-) strand; PAM type: NRG; PAM sequence: AAG
ttctcaggcctggccctctc

SEQ ID NO: 10054 - DNA, 20 bp, Artificial Sequence
  Description of Artificial Sequence: Synthetic oligonucleotide
  Target: DMPK; (-) strand; PAM type: NRG; PAM sequence: TGG
gcctcctagtttctcaggcc

SEQ ID NO: 10055 - DNA, 20 bp, Artificial Sequence
  Description of Artificial Sequence: Synthetic oligonucleotide
  Target: DMPK; (-) strand; PAM type: NRG; PAM sequence: AGG
tccttgcctcctagtttctc

SEQ ID NO: 10056 - DNA, 20 bp, Artificial Sequence
  Description of Artificial Sequence: Synthetic oligonucleotide
  Target: DMPK; (-) strand; PAM type: NRG; PAM sequence: CAG
gtccttgcctcctagtttct

SEQ ID NO: 10057 - DNA, 20 bp, Artificial Sequence
  Description of Artificial Sequence: Synthetic oligonucleotide
  Target: DMPK; (-) strand; PAM type: NRG; PAM sequence: TAG
actcctcggtccttgcctcc

SEQ ID NO: 10058 - DNA, 20 bp, Artificial Sequence
  Description of Artificial Sequence: Synthetic oligonucleotide
  Target: DMPK; (-) strand; PAM type: NRG; PAM sequence: CGG
cctgcccagctgggactcct

SEQ ID NO: 10059 - DNA, 20 bp, Artificial Sequence
  Description of Artificial Sequence: Synthetic oligonucleotide
  Target: DMPK; (-) strand; PAM type: NRG; PAM sequence: GGG
ttcccaggccctgcccagct

SEQ ID NO: 10060 - DNA, 20 bp, Artificial Sequence
  Description of Artificial Sequence: Synthetic oligonucleotide
  Target: DMPK; (-) strand; PAM type: NRG; PAM sequence: TGG
tttcccaggccctgcccagc

SEQ ID NO: 10061 - DNA, 20 bp, Artificial Sequence
  Description of Artificial Sequence: Synthetic oligonucleotide
  Target: DMPK; (-) strand; PAM type: NRG; PAM sequence: CAG
cacgtttcccaggccctgcc

SEQ ID NO: 10062 - DNA, 20 bp, Artificial Sequence
  Description of Artificial Sequence: Synthetic oligonucleotide
  Target: DMPK; (-) strand; PAM type: NRG; PAM sequence: AGG
tgcccaggaccacgtttccc

SEQ ID NO: 10063 - DNA, 20 bp, Artificial Sequence
  Description of Artificial Sequence: Synthetic oligonucleotide
  Target: DMPK; (-) strand; PAM type: NRG; PAM sequence: CAG
ctgcccaggaccacgtttcc

SEQ ID NO: 10064 - DNA, 20 bp, Artificial Sequence
  Description of Artificial Sequence: Synthetic oligonucleotide
  Target: DMPK; (-) strand; PAM type: NRG; PAM sequence: AGG
ttaaattatcagaactgccc

SEQ ID NO: 10065 - DNA, 20 bp, Artificial Sequence
  Description of Artificial Sequence: Synthetic oligonucleotide
  Target: DMPK; (-) strand; PAM type: NRG; PAM sequence: CAG
tttaaattatcagaactgcc

SEQ ID NO: 10066 - DNA, 20 bp, Artificial Sequence
  Description of Artificial Sequence: Synthetic oligonucleotide
  Target: DMPK; (-) strand; PAM type: NRG; PAM sequence: CAG
ctcggtgttttttaaattat

SEQ ID NO: 10067 - DNA, 20 bp, Artificial Sequence
  Description of Artificial Sequence: Synthetic oligonucleotide
  Target: DMPK; (-) strand; PAM type: NRG; PAM sequence: CGG
gggcccctcatcaaagtcct

SEQ ID NO: 10068 - DNA, 20 bp, Artificial Sequence
  Description of Artificial Sequence: Synthetic oligonucleotide
  Target: DMPK; (-) strand; PAM type: NRG; PAM sequence: AAG
gcagccagggcccctcatca

SEQ ID NO: 10069 - DNA, 20 bp, Artificial Sequence
  Description of Artificial Sequence: Synthetic oligonucleotide
  Target: DMPK; (-) strand; PAM type: NRG; PAM sequence: GGG
gagcatcctgcccgcagcca

SEQ ID NO: 10070 - DNA, 20 bp, Artificial Sequence
  Description of Artificial Sequence: Synthetic oligonucleotide
  Target: DMPK; (-) strand; PAM type: NRG; PAM sequence: AGG
agagcatcctgcccgcagcc

SEQ ID NO: 10071 - DNA, 20 bp, Artificial Sequence
  Description of Artificial Sequence: Synthetic oligonucleotide
  Target: DMPK; (-) strand; PAM type: NRG; PAM sequence: CAG
aagagcatcctgcccgcagc

SEQ ID NO: 10072 - DNA, 20 bp, Artificial Sequence
  Description of Artificial Sequence: Synthetic oligonucleotide
  Target: DMPK; (-) strand; PAM type: NRG; PAM sequence: CAG
ggagaagagcatcctgcccg

SEQ ID NO: 10073 - DNA, 20 bp, Artificial Sequence
  Description of Artificial Sequence: Synthetic oligonucleotide
  Target: DMPK; (-) strand; PAM type: NRG; PAM sequence: GAG
caggaccctcttggggagaa

SEQ ID NO: 10074 - DNA, 20 bp, Artificial Sequence
  Description of Artificial Sequence: Synthetic oligonucleotide
  Target: DMPK; (-) strand; PAM type: NRG; PAM sequence: AAG
agcaggaccctcttggggag

SEQ ID NO: 10075 - DNA, 20 bp, Artificial Sequence
  Description of Artificial Sequence: Synthetic oligonucleotide
  Target: DMPK; (-) strand; PAM type: NRG; PAM sequence: GAG
tggagcaggaccctcttggg

SEQ ID NO: 10076 - DNA, 20 bp, Artificial Sequence
  Description of Artificial Sequence: Synthetic oligonucleotide
  Target: DMPK; (-) strand; PAM type: NRG; PAM sequence: GGG
gctggagcaggaccctcttg

SEQ ID NO: 10077 - DNA, 20 bp, Artificial Sequence
  Description of Artificial Sequence: Synthetic oligonucleotide
  Target: DMPK; (-) strand; PAM type: NRG; PAM sequence: GGG
ggctggagcaggaccctctt

SEQ ID NO: 10078 - DNA, 20 bp, Artificial Sequence
  Description of Artificial Sequence: Synthetic oligonucleotide
  Target: DMPK; (-) strand; PAM type: NRG; PAM sequence: TGG
cggctggagcaggaccctct

SEQ ID NO: 10079 - DNA, 20 bp, Artificial Sequence
  Description of Artificial Sequence: Synthetic oligonucleotide
  Target: DMPK; (-) strand; PAM type: NRG; PAM sequence: AGG
cccacaccagcggctggagc

SEQ ID NO: 10080 - DNA, 20 bp, Artificial Sequence
  Description of Artificial Sequence: Synthetic oligonucleotide
  Target: DMPK; (-) strand; PAM type: NRG; PAM sequence: CAG
acccacaccagcggctggag

SEQ ID NO: 10081 - DNA, 20 bp, Artificial Sequence
  Description of Artificial Sequence: Synthetic oligonucleotide
  Target: DMPK; (-) strand; PAM type: NRG; PAM sequence: GAG
gtgacccacaccagcggctg

SEQ ID NO: 10082 - DNA, 20 bp, Artificial Sequence
  Description of Artificial Sequence: Synthetic oligonucleotide
  Target: DMPK; (-) strand; PAM type: NRG; PAM sequence: TGG
tggtgacccacaccagcggc

SEQ ID NO: 10083 - DNA, 20 bp, Artificial Sequence
  Description of Artificial Sequence: Synthetic oligonucleotide
  Target: DMPK; (-) strand; PAM type: NRG; PAM sequence: CGG
caactggtgacccacaccag

SEQ ID NO: 10084 - DNA, 20 bp, Artificial Sequence
  Description of Artificial Sequence: Synthetic oligonucleotide
  Target: DMPK; (-) strand; PAM type: NRG; PAM sequence: CAG
acacaactggtgacccacac

SEQ ID NO: 10085 - DNA, 20 bp, Artificial Sequence
  Description of Artificial Sequence: Synthetic oligonucleotide
  Target: DMPK; (-) strand; PAM type: NRG; PAM sequence: TGG
ggacctgcgagtcacacaac

SEQ ID NO: 10086 - DNA, 20 bp, Artificial Sequence
  Description of Artificial Sequence: Synthetic oligonucleotide
  Target: DMPK; (-) strand; PAM type: NRG; PAM sequence: GAG
cagggagggaacggacctgc

SEQ ID NO: 10087 - DNA, 20 bp, Artificial Sequence
  Description of Artificial Sequence: Synthetic oligonucleotide
  Target: DMPK; (-) strand; PAM type: NRG; PAM sequence: CGG
gccggagcccagggagggaa

SEQ ID NO: 10088 - DNA, 20 bp, Artificial Sequence
  Description of Artificial Sequence: Synthetic oligonucleotide
  Target: DMPK; (-) strand; PAM type: NRG; PAM sequence: GGG
gaaaagccggagcccaggga

SEQ ID NO: 10089 - DNA, 20 bp, Artificial Sequence
  Description of Artificial Sequence: Synthetic oligonucleotide
  Target: DMPK; (-) strand; PAM type: NRG; PAM sequence: AGG
ggaaaagccggagcccaggg

SEQ ID NO: 10090 - DNA, 20 bp, Artificial Sequence
  Description of Artificial Sequence: Synthetic oligonucleotide
  Target: DMPK; (-) strand; PAM type: NRG; PAM sequence: GAG
aggaaaagccggagcccagg

SEQ ID NO: 10091 - DNA, 20 bp, Artificial Sequence
  Description of Artificial Sequence: Synthetic oligonucleotide
  Target: DMPK; (-) strand; PAM type: NRG; PAM sequence: GGG
gcaggaaaagccggagccca

SEQ ID NO: 10092 - DNA, 20 bp, Artificial Sequence
  Description of Artificial Sequence: Synthetic oligonucleotide
  Target: DMPK; (-) strand; PAM type: NRG; PAM sequence: AGG
agcaggaaaagccggagccc

SEQ ID NO: 10093 - DNA, 20 bp, Artificial Sequence
  Description of Artificial Sequence: Synthetic oligonucleotide
  Target: DMPK; (-) strand; PAM type: NRG; PAM sequence: CAG
tagcaggaaaagccggagcc

SEQ ID NO: 10094 - DNA, 20 bp, Artificial Sequence
  Description of Artificial Sequence: Synthetic oligonucleotide
  Target: DMPK; (-) strand; PAM type: NRG; PAM sequence: GAG
tttcatagcaggaaaagccg

SEQ ID NO: 10095 - DNA, 20 bp, Artificial Sequence
  Description of Artificial Sequence: Synthetic oligonucleotide
  Target: DMPK; (-) strand; PAM type: NRG; PAM sequence: CGG
cttttcatagcaggaaaagc

SEQ ID NO: 10096 - DNA, 20 bp, Artificial Sequence
  Description of Artificial Sequence: Synthetic oligonucleotide
  Target: DMPK; (-) strand; PAM type: NRG; PAM sequence: AAG
accccttttcatagcaggaa

SEQ ID NO: 10097 - DNA, 20 bp, Artificial Sequence
  Description of Artificial Sequence: Synthetic oligonucleotide
  Target: DMPK; (-) strand; PAM type: NRG; PAM sequence: AGG
ctcccaccccttttcatagc

SEQ ID NO: 10098 - DNA, 20 bp, Artificial Sequence
  Description of Artificial Sequence: Synthetic oligonucleotide
  Target: DMPK; (-) strand; PAM type: NRG; PAM sequence: CAG
cctcccaccccttttcatag

SEQ ID NO: 10099 - DNA, 20 bp, Artificial Sequence
  Description of Artificial Sequence: Synthetic oligonucleotide
  Target: DMPK; (-) strand; PAM type: NRG; PAM sequence: TAG
gcgcctcccaccccttttca

SEQ ID NO: 10100 - DNA, 20 bp, Artificial Sequence
  Description of Artificial Sequence: Synthetic oligonucleotide
  Target: DMPK; (-) strand; PAM type: NRG; PAM sequence: CAG
gtgcaggcctgctcccagcc

SEQ ID NO: 10101 - DNA, 20 bp, Artificial Sequence
  Description of Artificial Sequence: Synthetic oligonucleotide
  Target: DMPK; (-) strand; PAM type: NRG; PAM sequence: CAG
gaggagtgcaggcctgctcc

SEQ ID NO: 10102 - DNA, 20 bp, Artificial Sequence
  Description of Artificial Sequence: Synthetic oligonucleotide
  Target: DMPK; (-) strand; PAM type: NRG; PAM sequence: AGG
tttccccagaggaggagtgc

SEQ ID NO: 10103 - DNA, 20 bp, Artificial Sequence
  Description of Artificial Sequence: Synthetic oligonucleotide
  Target: DMPK; (-) strand; PAM type: NRG; PAM sequence: CAG
ctttccccagaggaggagtg

SEQ ID NO: 10104 - DNA, 20 bp, Artificial Sequence
  Description of Artificial Sequence: Synthetic oligonucleotide
  Target: DMPK; (-) strand; PAM type: NRG; PAM sequence: GAG
gtccgctttccccagaggag

SEQ ID NO: 10105 - DNA, 20 bp, Artificial Sequence
  Description of Artificial Sequence: Synthetic oligonucleotide
  Target: DMPK; (-) strand; PAM type: NRG; PAM sequence: AGG
cagtccgctttccccagagg

SEQ ID NO: 10106 - DNA, 20 bp, Artificial Sequence
  Description of Artificial Sequence: Synthetic oligonucleotide
  Target: DMPK; (-) strand; PAM type: NRG; PAM sequence: GAG
gcagtccgctttccccagag

SEQ ID NO: 10107 - DNA, 20 bp, Artificial Sequence
  Description of Artificial Sequence: Synthetic oligonucleotide
  Target: DMPK; (-) strand; PAM type: NRG; PAM sequence: AGG
aggcagtccgctttccccag

SEQ ID NO: 10108 - DNA, 20 bp, Artificial Sequence
  Description of Artificial Sequence: Synthetic oligonucleotide
  Target: DMPK; (-) strand; PAM type: NRG; PAM sequence: GAG
taggcagtccgctttcccca

SEQ ID NO: 10109 - DNA, 20 bp, Artificial Sequence
  Description of Artificial Sequence: Synthetic oligonucleotide
  Target: DMPK; (-) strand; PAM type: NRG; PAM sequence: CAG
tctaggcagtccgctttccc

SEQ ID NO: 10110 - DNA, 20 bp, Artificial Sequence
  Description of Artificial Sequence: Synthetic oligonucleotide
  Target: DMPK; (-) strand; PAM type: NRG; PAM sequence: CAG
gtgtactctgtggttctagg

SEQ ID NO: 10111 - DNA, 20 bp, Artificial Sequence
  Description of Artificial Sequence: Synthetic oligonucleotide
  Target: DMPK; (-) strand; PAM type: NRG; PAM sequence: AGG
tgtgtgtactctgtggttct

SEQ ID NO: 10112 - DNA, 20 bp, Artificial Sequence
  Description of Artificial Sequence: Synthetic oligonucleotide
  Target: DMPK; (-) strand; PAM type: NRG; PAM sequence: TAG
gtgtgtgtactctgtggttc

SEQ ID NO: 10113 - DNA, 20 bp, Artificial Sequence
  Description of Artificial Sequence: Synthetic oligonucleotide
  Target: DMPK; (-) strand; PAM type: NRG; PAM sequence: TGG
ggacctgtgtgtgtactctg

SEQ ID NO: 10114 - DNA, 20 bp, Artificial Sequence
  Description of Artificial Sequence: Synthetic oligonucleotide
  Target: DMPK; (-) strand; PAM type: NRG; PAM sequence: AGG
cttcggaggagatgatgtag

SEQ ID NO: 10115 - DNA, 20 bp, Artificial Sequence
  Description of Artificial Sequence: Synthetic oligonucleotide
  Target: DMPK; (-) strand; PAM type: NRG; PAM sequence: GAG
ccttcggaggagatgatgta

SEQ ID NO: 10116 - DNA, 20 bp, Artificial Sequence
  Description of Artificial Sequence: Synthetic oligonucleotide
  Target: DMPK; (-) strand; PAM type: NRG; PAM sequence: TAG
ccccttcggaggagatgatg

SEQ ID NO: 10117 - DNA, 20 bp, Artificial Sequence
  Description of Artificial Sequence: Synthetic oligonucleotide
  Target: DMPK; (-) strand; PAM type: NRG; PAM sequence: GAG
cgggtctgtccccttcggag

SEQ ID NO: 10118 - DNA, 20 bp, Artificial Sequence
  Description of Artificial Sequence: Synthetic oligonucleotide
  Target: DMPK; (-) strand; PAM type: NRG; PAM sequence: AGG
agcgggtctgtccccttcgg

SEQ ID NO: 10119 - DNA, 20 bp, Artificial Sequence
  Description of Artificial Sequence: Synthetic oligonucleotide
  Target: DMPK; (-) strand; PAM type: NRG; PAM sequence: GAG
cagcgggtctgtccccttcg

SEQ ID NO: 10120 - DNA, 20 bp, Artificial Sequence
  Description of Artificial Sequence: Synthetic oligonucleotide
  Target: DMPK; (-) strand; PAM type: NRG; PAM sequence: CGG
ctcagcgggtctgtcccctt

SEQ ID NO: 10121 - DNA, 20 bp, Artificial Sequence
  Description of Artificial Sequence: Synthetic oligonucleotide
  Target: DMPK; (-) strand; PAM type: NRG; PAM sequence: GGG
aagttccctgttttctcagc

SEQ ID NO: 10122 - DNA, 20 bp, Artificial Sequence
  Description of Artificial Sequence: Synthetic oligonucleotide
  Target: DMPK; (-) strand; PAM type: NRG; PAM sequence: CGG
aaagttccctgttttctcag

SEQ ID NO: 10123 - DNA, 20 bp, Artificial Sequence
  Description of Artificial Sequence: Synthetic oligonucleotide
  Target: DMPK; (-) strand; PAM type: NRG; PAM sequence: CAG
actaaagttccctgttttct

SEQ ID NO: 10124 - DNA, 20 bp, Artificial Sequence
  Description of Artificial Sequence: Synthetic oligonucleotide
  Target: DMPK; (-) strand; PAM type: NRG; PAM sequence: AAG
aggacctcttatttatacta

SEQ ID NO: 10125 - DNA, 20 bp, Artificial Sequence
  Description of Artificial Sequence: Synthetic oligonucleotide
  Target: DMPK; (-) strand; PAM type: NRG; PAM sequence: AGG
caggttcctccctgtcccgc

SEQ ID NO: 10126 - DNA, 20 bp, Artificial Sequence
  Description of Artificial Sequence: Synthetic oligonucleotide
  Target: DMPK; (-) strand; PAM type: NRG; PAM sequence: CAG
tcaggttcctccctgtcccg

SEQ ID NO: 10127 - DNA, 20 bp, Artificial Sequence
  Description of Artificial Sequence: Synthetic oligonucleotide
  Target: DMPK; (-) strand; PAM type: NRG; PAM sequence: AGG
ttaaattatggaagcccctc

SEQ ID NO: 10128 - DNA, 20 bp, Artificial Sequence
  Description of Artificial Sequence: Synthetic oligonucleotide
  Target: DMPK; (-) strand; PAM type: NRG; PAM sequence: CAG
gttaaattatggaagcccct

SEQ ID NO: 10129 - DNA, 20 bp, Artificial Sequence
  Description of Artificial Sequence: Synthetic oligonucleotide
  Target: DMPK; (-) strand; PAM type: NRG; PAM sequence: AAG
tgaagagtgttaaattatgg

SEQ ID NO: 10130 - DNA, 20 bp, Artificial Sequence
  Description of Artificial Sequence: Synthetic oligonucleotide
  Target: DMPK; (-) strand; PAM type: NRG; PAM sequence: TGG
ttttgaagagtgttaaatta

SEQ ID NO: 10131 - DNA, 20 bp, Artificial Sequence
  Description of Artificial Sequence: Synthetic oligonucleotide
  Target: DMPK; (-) strand; PAM type: NRG; PAM sequence: GAG
ctattgtctgtgcttttgaa

SEQ ID NO: 10132 - DNA, 20 bp, Artificial Sequence
  Description of Artificial Sequence: Synthetic oligonucleotide
  Target: DMPK; (-) strand; PAM type: NRG; PAM sequence: AAG
tgctattgtctgtgcttttg

SEQ ID NO: 10133 - DNA, 20 bp, Artificial Sequence
  Description of Artificial Sequence: Synthetic oligonucleotide
  Target: DMPK; (-) strand; PAM type: NRG; PAM sequence: CAG
ccctcgcccggcccccaccc

SEQ ID NO: 10134 - DNA, 20 bp, Artificial Sequence
  Description of Artificial Sequence: Synthetic oligonucleotide
  Target: DMPK; (-) strand; PAM type: NRG; PAM sequence: CGG
ggggtggtccagccctcgcc

SEQ ID NO: 10135 - DNA, 20 bp, Artificial Sequence
  Description of Artificial Sequence: Synthetic oligonucleotide
  Target: DMPK; (-) strand; PAM type: NRG; PAM sequence: CAG
gggcagggccgggggtggtc

SEQ ID NO: 10136 - DNA, 20 bp, Artificial Sequence
  Description of Artificial Sequence: Synthetic oligonucleotide
  Target: DMPK; (-) strand; PAM type: NRG; PAM sequence: TGG
tgagtgggcagggccggggg

SEQ ID NO: 10137 - DNA, 20 bp, Artificial Sequence
  Description of Artificial Sequence: Synthetic oligonucleotide
  Target: DMPK; (-) strand; PAM type: NRG; PAM sequence: GGG
agttgagtgggcagggccgg

SEQ ID NO: 10138 - DNA, 20 bp, Artificial Sequence
  Description of Artificial Sequence: Synthetic oligonucleotide
  Target: DMPK; (-) strand; PAM type: NRG; PAM sequence: GGG
cagttgagtgggcagggccg

SEQ ID NO: 10139 - DNA, 20 bp, Artificial Sequence
  Description of Artificial Sequence: Synthetic oligonucleotide
  Target: DMPK; (-) strand; PAM type: NRG; PAM sequence: GGG
tcagttgagtgggcagggcc

SEQ ID NO: 10140 - DNA, 20 bp, Artificial Sequence
  Description of Artificial Sequence: Synthetic oligonucleotide
  Target: DMPK; (-) strand; PAM type: NRG; PAM sequence: CGG
ctcagttgagtgggcagggc

SEQ ID NO: 10141 - DNA, 20 bp, Artificial Sequence
  Description of Artificial Sequence: Synthetic oligonucleotide
  Target: DMPK; (-) strand; PAM type: NRG; PAM sequence: GGG
gcccctcagttgagtgggca

SEQ ID NO: 10142 - DNA, 20 bp, Artificial Sequence
  Description of Artificial Sequence: Synthetic oligonucleotide
  Target: DMPK; (-) strand; PAM type: NRG; PAM sequence: AGG
tgcccctcagttgagtgggc

SEQ ID NO: 10143 - DNA, 20 bp, Artificial Sequence
  Description of Artificial Sequence: Synthetic oligonucleotide
  Target: DMPK; (-) strand; PAM type: NRG; PAM sequence: CAG
gtgcccctcagttgagtggg

SEQ ID NO: 10144 - DNA, 20 bp, Artificial Sequence
  Description of Artificial Sequence: Synthetic oligonucleotide
  Target: DMPK; (-) strand; PAM type: NRG; PAM sequence: GGG
agtgtgcccctcagttgagt

SEQ ID NO: 10145 - DNA, 20 bp, Artificial Sequence
  Description of Artificial Sequence: Synthetic oligonucleotide
  Target: DMPK; (-) strand; PAM type: NRG; PAM sequence: TGG
cagtgtgcccctcagttgag

SEQ ID NO: 10146 - DNA, 20 bp, Artificial Sequence
  Description of Artificial Sequence: Synthetic oligonucleotide
  Target: DMPK; (-) strand; PAM type: NRG; PAM sequence: GAG
ctgcagtgtgcccctcagtt

SEQ ID NO: 10147 - DNA, 20 bp, Artificial Sequence
  Description of Artificial Sequence: Synthetic oligonucleotide
  Target: DMPK; (-) strand; PAM type: NRG; PAM sequence: CAG
caggtctgcagtgtgcccct

SEQ ID NO: 10148 - DNA, 20 bp, Artificial Sequence
  Description of Artificial Sequence: Synthetic oligonucleotide
  Target: DMPK; (-) strand; PAM type: NRG; PAM sequence: CAG
ccacaagagccccaggtctg

SEQ ID NO: 10149 - DNA, 20 bp, Artificial Sequence
  Description of Artificial Sequence: Synthetic oligonucleotide
  Target: DMPK; (-) strand; PAM type: NRG; PAM sequence: AGG
gcccctgccacaagagcccc

SEQ ID NO: 10150 - DNA, 20 bp, Artificial Sequence
  Description of Artificial Sequence: Synthetic oligonucleotide
  Target: DMPK; (-) strand; PAM type: NRG; PAM sequence: CAG
cgcccctgccacaagagccc

SEQ ID NO: 10151 - DNA, 20 bp, Artificial Sequence
  Description of Artificial Sequence: Synthetic oligonucleotide
  Target: DMPK; (-) strand; PAM type: NRG; PAM sequence: GAG
actccccgcccctgccacaa

SEQ ID NO: 10152 - DNA, 20 bp, Artificial Sequence
  Description of Artificial Sequence: Synthetic oligonucleotide
  Target: DMPK; (-) strand; PAM type: NRG; PAM sequence: AAG
agactccccgcccctgccac

SEQ ID NO: 10153 - DNA, 20 bp, Artificial Sequence
  Description of Artificial Sequence: Synthetic oligonucleotide
  Target: DMPK; (-) strand; PAM type: NRG; PAM sequence: GAG
tgactggtcactcctgggga

SEQ ID NO: 10154 - DNA, 20 bp, Artificial Sequence
  Description of Artificial Sequence: Synthetic oligonucleotide
  Target: DMPK; (-) strand; PAM type: NRG; PAM sequence: GAG
tgtgactggtcactcctggg

SEQ ID NO: 10155 - DNA, 20 bp, Artificial Sequence
  Description of Artificial Sequence: Synthetic oligonucleotide
  Target: DMPK; (-) strand; PAM type: NRG; PAM sequence: GGG
catgtgactggtcactcctg

SEQ ID NO: 10156 - DNA, 20 bp, Artificial Sequence
  Description of Artificial Sequence: Synthetic oligonucleotide
  Target: DMPK; (-) strand; PAM type: NRG; PAM sequence: GGG
gcatgtgactggtcactcct

SEQ ID NO: 10157 - DNA, 20 bp, Artificial Sequence
  Description of Artificial Sequence: Synthetic oligonucleotide
  Target: DMPK; (-) strand; PAM type: NRG; PAM sequence: TGG
agcatgtgactggtcactcc

SEQ ID NO: 10158 - DNA, 20 bp, Artificial Sequence
  Description of Artificial Sequence: Synthetic oligonucleotide
  Target: DMPK; (-) strand; PAM type: NRG; PAM sequence: TGG
ccctgtccccagcatgtgac

SEQ ID NO: 10159 - DNA, 20 bp, Artificial Sequence
  Description of Artificial Sequence: Synthetic oligonucleotide
  Target: DMPK; (-) strand; PAM type: NRG; PAM sequence: CAG
gttaccctcatccctgtccc

SEQ ID NO: 10160 - DNA, 20 bp, Artificial Sequence
  Description of Artificial Sequence: Synthetic oligonucleotide
  Target: DMPK; (-) strand; PAM type: NRG; PAM sequence: CAG
gacctcttcctctgaaacat

SEQ ID NO: 10161 - DNA, 20 bp, Artificial Sequence
  Description of Artificial Sequence: Synthetic oligonucleotide
  Target: DMPK; (-) strand; PAM type: NRG; PAM sequence: AAG
cttgtcccccacccactgcc

SEQ ID NO: 10162 - DNA, 20 bp, Artificial Sequence
  Description of Artificial Sequence: Synthetic oligonucleotide
  Target: DMPK; (-) strand; PAM type: NRG; PAM sequence: CAG
tgtaatagcccttgtggcct

SEQ ID NO: 10163 - DNA, 20 bp, Artificial Sequence
  Description of Artificial Sequence: Synthetic oligonucleotide
  Target: DMPK; (-) strand; PAM type: NRG; PAM sequence: TGG
gggcgatgtaatagcccttg

SEQ ID NO: 10164 - DNA, 20 bp, Artificial Sequence
  Description of Artificial Sequence: Synthetic oligonucleotide
  Target: DMPK; (-) strand; PAM type: NRG; PAM sequence: TAG
cccggacacgggcgatgtaa

SEQ ID NO: 10165 - DNA, 20 bp, Artificial Sequence
  Description of Artificial Sequence: Synthetic oligonucleotide
  Target: DMPK; (-) strand; PAM type: NRG; PAM sequence: GGG
ccccagactggcccggacac

SEQ ID NO: 10166 - DNA, 20 bp, Artificial Sequence
  Description of Artificial Sequence: Synthetic oligonucleotide
  Target: DMPK; (-) strand; PAM type: NRG; PAM sequence: CGG
cccccagactggcccggaca

SEQ ID NO: 10167 - DNA, 20 bp, Artificial Sequence
  Description of Artificial Sequence: Synthetic oligonucleotide
  Target: DMPK; (-) strand; PAM type: NRG; PAM sequence: CGG
gggggccccccagactggcc

SEQ ID NO: 10168 - DNA, 20 bp, Artificial Sequence
  Description of Artificial Sequence: Synthetic oligonucleotide
  Target: DMPK; (-) strand; PAM type: NRG; PAM sequence: TGG
aatttgggggccccccagac

SEQ ID NO: 10169 - DNA, 20 bp, Artificial Sequence
  Description of Artificial Sequence: Synthetic oligonucleotide
  Target: DMPK; (-) strand; PAM type: NRG; PAM sequence: CAG
cacaaaatttgggggccccc

SEQ ID NO: 10170 - DNA, 20 bp, Artificial Sequence
  Description of Artificial Sequence: Synthetic oligonucleotide
  Target: DMPK; (-) strand; PAM type: NRG; PAM sequence: GGG
cccacctgcacaaaatttgg

SEQ ID NO: 10171 - DNA, 20 bp, Artificial Sequence
  Description of Artificial Sequence: Synthetic oligonucleotide
  Target: DMPK; (-) strand; PAM type: NRG; PAM sequence: GGG
ccccacctgcacaaaatttg

SEQ ID NO: 10172 - DNA, 20 bp, Artificial Sequence
  Description of Artificial Sequence: Synthetic oligonucleotide
  Target: DMPK; (-) strand; PAM type: NRG; PAM sequence: GGG
cccccacctgcacaaaattt

SEQ ID NO: 10173 - DNA, 20 bp, Artificial Sequence
  Description of Artificial Sequence: Synthetic oligonucleotide
  Target: DMPK; (-) strand; PAM type: NRG; PAM sequence: TGG
ccccccacctgcacaaaatt

SEQ ID NO: 10174 - DNA, 20 bp, Artificial Sequence
  Description of Artificial Sequence: Synthetic oligonucleotide
  Target: DMPK; (-) strand; PAM type: NRG; PAM sequence: CAG
ccatgatggatggactgctc

SEQ ID NO: 10175 - DNA, 20 bp, Artificial Sequence
  Description of Artificial Sequence: Synthetic oligonucleotide
  Target: DMPK; (-) strand; PAM type: NRG; PAM sequence: TGG
acaagactaaccatgatgga

SEQ ID NO: 10176 - DNA, 20 bp, Artificial Sequence
  Description of Artificial Sequence: Synthetic oligonucleotide
  Target: DMPK; (-) strand; PAM type: NRG; PAM sequence: TGG
attaacaagactaaccatga

SEQ ID NO: 10177 - DNA, 20 bp, Artificial Sequence
  Description of Artificial Sequence: Synthetic oligonucleotide
  Target: DMPK; (-) strand; PAM type: NRG; PAM sequence: AAG
tcacagatcaacgtattaac

SEQ ID NO: 10178 - DNA, 20 bp, Artificial Sequence
  Description of Artificial Sequence: Synthetic oligonucleotide
  Target: DMPK; (-) strand; PAM type: NRG; PAM sequence: CAG
aaccctccctgctgacctca

SEQ ID NO: 10179 - DNA, 20 bp, Artificial Sequence
  Description of Artificial Sequence: Synthetic oligonucleotide
  Target: DMPK; (-) strand; PAM type: NRG; PAM sequence: TAG
accccatgcccccagcctcc

SEQ ID NO: 10180 - DNA, 20 bp, Artificial Sequence
  Description of Artificial Sequence: Synthetic oligonucleotide
  Target: DMPK; (-) strand; PAM type: NRG; PAM sequence: CAG
cccccccaaccccatgcccc

SEQ ID NO: 10181 - DNA, 20 bp, Artificial Sequence
  Description of Artificial Sequence: Synthetic oligonucleotide
  Target: DMPK; (-) strand; PAM type: NRG; PAM sequence: GGG
ggtgtgaagccatggatatc

SEQ ID NO: 10182 - DNA, 20 bp, Artificial Sequence
  Description of Artificial Sequence: Synthetic oligonucleotide
  Target: DMPK; (-) strand; PAM type: NRG; PAM sequence: CGG
tggtgtgaagccatggatat

SEQ ID NO: 10183 - DNA, 20 bp, Artificial Sequence
  Description of Artificial Sequence: Synthetic oligonucleotide
  Target: DMPK; (-) strand; PAM type: NRG; PAM sequence: TGG
ggcacagtggtgtgaagcca

SEQ ID NO: 10184 - DNA, 20 bp, Artificial Sequence
  Description of Artificial Sequence: Synthetic oligonucleotide
  Target: DMPK; (-) strand; PAM type: NRG; PAM sequence: AAG
ccgagtggcacagtggtgtg

SEQ ID NO: 10185 - DNA, 20 bp, Artificial Sequence
  Description of Artificial Sequence: Synthetic oligonucleotide
  Target: DMPK; (-) strand; PAM type: NRG; PAM sequence: TGG
caactccccgagtggcacag

SEQ ID NO: 10186 - DNA, 20 bp, Artificial Sequence
  Description of Artificial Sequence: Synthetic oligonucleotide
  Target: DMPK; (-) strand; PAM type: NRG; PAM sequence: CAG
aggcaactccccgagtggca

SEQ ID NO: 10187 - DNA, 20 bp, Artificial Sequence
  Description of Artificial Sequence: Synthetic oligonucleotide
  Target: DMPK; (-) strand; PAM type: NRG; PAM sequence: TGG
caaccaggcaactccccgag

SEQ ID NO: 10188 - DNA, 20 bp, Artificial Sequence
  Description of Artificial Sequence: Synthetic oligonucleotide
  Target: DMPK; (-) strand; PAM type: NRG; PAM sequence: GAG
tcccaaccaggcaactcccc

SEQ ID NO: 10189 - DNA, 20 bp, Artificial Sequence
  Description of Artificial Sequence: Synthetic oligonucleotide
  Target: DMPK; (-) strand; PAM type: NRG; PAM sequence: AGG
cagggcatctcctcccaacc

SEQ ID NO: 10190 - DNA, 20 bp, Artificial Sequence
  Description of Artificial Sequence: Synthetic oligonucleotide
  Target: DMPK; (-) strand; PAM type: NRG; PAM sequence: CAG
ccagggcatctcctcccaac

SEQ ID NO: 10191 - DNA, 20 bp, Artificial Sequence
  Description of Artificial Sequence: Synthetic oligonucleotide
  Target: DMPK; (-) strand; PAM type: NRG; PAM sequence: GGG
tctccctctcatcttcccca

SEQ ID NO: 10192 - DNA, 20 bp, Artificial Sequence
  Description of Artificial Sequence: Synthetic oligonucleotide
  Target: DMPK; (-) strand; PAM type: NRG; PAM sequence: AGG
ctctccctctcatcttcccc

SEQ ID NO: 10193 - DNA, 20 bp, Artificial Sequence
  Description of Artificial Sequence: Synthetic oligonucleotide
  Target: DMPK; (-) strand; PAM type: NRG; PAM sequence: CAG
tctctccctctcatcttccc

SEQ ID NO: 10194 - DNA, 20 bp, Artificial Sequence
  Description of Artificial Sequence: Synthetic oligonucleotide
  Target: DMPK; (-) strand; PAM type: NRG; PAM sequence: TGG
gacactggctgaagcccagg

SEQ ID NO: 10195 - DNA, 20 bp, Artificial Sequence
  Description of Artificial Sequence: Synthetic oligonucleotide
  Target: DMPK; (-) strand; PAM type: NRG; PAM sequence: AGG
cttgacactggctgaagccc

SEQ ID NO: 10196 - DNA, 20 bp, Artificial Sequence
  Description of Artificial Sequence: Synthetic oligonucleotide
  Target: DMPK; (-) strand; PAM type: NRG; PAM sequence: CAG
ccttgacactggctgaagcc

SEQ ID NO: 10197 - DNA, 20 bp, Artificial Sequence
  Description of Artificial Sequence: Synthetic oligonucleotide
  Target: DMPK; (-) strand; PAM type: NRG; PAM sequence: AAG
cctccccttgacactggctg

SEQ ID NO: 10198 - DNA, 20 bp, Artificial Sequence
  Description of Artificial Sequence: Synthetic oligonucleotide
  Target: DMPK; (-) strand; PAM type: NRG; PAM sequence: TGG
tggctccctccccttgacac

SEQ ID NO: 10199 - DNA, 20 bp, Artificial Sequence
  Description of Artificial Sequence: Synthetic oligonucleotide
  Target: DMPK; (-) strand; PAM type: NRG; PAM sequence: TGG
cagctttggggactctgggc

SEQ ID NO: 10200 - DNA, 20 bp, Artificial Sequence
  Description of Artificial Sequence: Synthetic oligonucleotide
  Target: DMPK; (-) strand; PAM type: NRG; PAM sequence: GGG
gcagcagctttggggactct

SEQ ID NO: 10201 - DNA, 20 bp, Artificial Sequence
  Description of Artificial Sequence: Synthetic oligonucleotide
  Target: DMPK; (-) strand; PAM type: NRG; PAM sequence: TGG
ggcagcagctttggggactc

SEQ ID NO: 10202 - DNA, 20 bp, Artificial Sequence
  Description of Artificial Sequence: Synthetic oligonucleotide
  Target: DMPK; (-) strand; PAM type: NRG; PAM sequence: GGG
ccagggtggcagcagctttg

SEQ ID NO: 10203 - DNA, 20 bp, Artificial Sequence
  Description of Artificial Sequence: Synthetic oligonucleotide
  Target: DMPK; (-) strand; PAM type: NRG; PAM sequence: GGG
gccagggtggcagcagcttt

SEQ ID NO: 10204 - DNA, 20 bp, Artificial Sequence
  Description of Artificial Sequence: Synthetic oligonucleotide
  Target: DMPK; (-) strand; PAM type: NRG; PAM sequence: TGG
ggccagggtggcagcagctt

SEQ ID NO: 10205 - DNA, 20 bp, Artificial Sequence
  Description of Artificial Sequence: Synthetic oligonucleotide
  Target: DMPK; (-) strand; PAM type: NRG; PAM sequence: CAG
gggcaaggccagggtggcag

SEQ ID NO: 10206 - DNA, 20 bp, Artificial Sequence
  Description of Artificial Sequence: Synthetic oligonucleotide
  Target: DMPK; (-) strand; PAM type: NRG; PAM sequence: CAG
caagggcaaggccagggtgg

SEQ ID NO: 10207 - DNA, 20 bp, Artificial Sequence
  Description of Artificial Sequence: Synthetic oligonucleotide
  Target: DMPK; (-) strand; PAM type: NRG; PAM sequence: TGG
acccaagggcaaggccaggg

SEQ ID NO: 10208 - DNA, 20 bp, Artificial Sequence
  Description of Artificial Sequence: Synthetic oligonucleotide
  Target: DMPK; (-) strand; PAM type: NRG; PAM sequence: GGG
cggacccaagggcaaggcca

SEQ ID NO: 10209 - DNA, 20 bp, Artificial Sequence
  Description of Artificial Sequence: Synthetic oligonucleotide
  Target: DMPK; (-) strand; PAM type: NRG; PAM sequence: AGG
gcggacccaagggcaaggcc

SEQ ID NO: 10210 - DNA, 20 bp, Artificial Sequence
  Description of Artificial Sequence: Synthetic oligonucleotide
  Target: DMPK; (-) strand; PAM type: NRG; PAM sequence: CAG
ggcggacccaagggcaaggc

SEQ ID NO: 10211 - DNA, 20 bp, Artificial Sequence
  Description of Artificial Sequence: Synthetic oligonucleotide
  Target: DMPK; (-) strand; PAM type: NRG; PAM sequence: AGG
ctagggcggacccaagggca

SEQ ID NO: 10212 - DNA, 20 bp, Artificial Sequence
  Description of Artificial Sequence: Synthetic oligonucleotide
  Target: DMPK; (-) strand; PAM type: NRG; PAM sequence: AAG
tctagggcggacccaagggc

SEQ ID NO: 10213 - DNA, 20 bp, Artificial Sequence
  Description of Artificial Sequence: Synthetic oligonucleotide
  Target: DMPK; (-) strand; PAM type: NRG; PAM sequence: GGG
ggggtctagggcggacccaa

SEQ ID NO: 10214 - DNA, 20 bp, Artificial Sequence
  Description of Artificial Sequence: Synthetic oligonucleotide
  Target: DMPK; (-) strand; PAM type: NRG; PAM sequence: AGG
gggggtctagggcggaccca

SEQ ID NO: 10215 - DNA, 20 bp, Artificial Sequence
  Description of Artificial Sequence: Synthetic oligonucleotide
  Target: DMPK; (-) strand; PAM type: NRG; PAM sequence: AAG
ggggggtctagggcggaccc

SEQ ID NO: 10216 - DNA, 20 bp, Artificial Sequence
  Description of Artificial Sequence: Synthetic oligonucleotide
  Target: DMPK; (-) strand; PAM type: NRG; PAM sequence: CGG
ggcctctggggggtctaggg

SEQ ID NO: 10217 - DNA, 20 bp, Artificial Sequence
  Description of Artificial Sequence: Synthetic oligonucleotide
  Target: DMPK; (-) strand; PAM type: NRG; PAM sequence: GGG
agtggcctctggggggtcta

SEQ ID NO: 10218 - DNA, 20 bp, Artificial Sequence
  Description of Artificial Sequence: Synthetic oligonucleotide
  Target: DMPK; (-) strand; PAM type: NRG; PAM sequence: AGG
cagtggcctctggggggtct

SEQ ID NO: 10219 - DNA, 20 bp, Artificial Sequence
  Description of Artificial Sequence: Synthetic oligonucleotide
  Target: DMPK; (-) strand; PAM type: NRG; PAM sequence: TAG
gcagtggcctctggggggtc

SEQ ID NO: 10220 - DNA, 20 bp, Artificial Sequence
  Description of Artificial Sequence: Synthetic oligonucleotide
  Target: DMPK; (-) strand; PAM type: NRG; PAM sequence: GGG
ctagagcagtggcctctggg

SEQ ID NO: 10221 - DNA, 20 bp, Artificial Sequence
  Description of Artificial Sequence: Synthetic oligonucleotide
  Target: DMPK; (-) strand; PAM type: NRG; PAM sequence: GGG
cctagagcagtggcctctgg

SEQ ID NO: 10222 - DNA, 20 bp, Artificial Sequence
  Description of Artificial Sequence: Synthetic oligonucleotide
  Target: DMPK; (-) strand; PAM type: NRG; PAM sequence: GGG
gcctagagcagtggcctctg

SEQ ID NO: 10223 - DNA, 20 bp, Artificial Sequence
  Description of Artificial Sequence: Synthetic oligonucleotide
  Target: DMPK; (-) strand; PAM type: NRG; PAM sequence: GGG
agcctagagcagtggcctct

SEQ ID NO: 10224 - DNA, 20 bp, Artificial Sequence
  Description of Artificial Sequence: Synthetic oligonucleotide
  Target: DMPK; (-) strand; PAM type: NRG; PAM sequence: TGG
cagcctagagcagtggcctc

SEQ ID NO: 10225 - DNA, 20 bp, Artificial Sequence
  Description of Artificial Sequence: Synthetic oligonucleotide
  Target: DMPK; (-) strand; PAM type: NRG; PAM sequence: TGG
aagttcccagcctagagcag

SEQ ID NO: 10226 - DNA, 20 bp, Artificial Sequence
  Description of Artificial Sequence: Synthetic oligonucleotide
  Target: DMPK; (-) strand; PAM type: NRG; PAM sequence: CAG
tgcaagttcccagcctagag

SEQ ID NO: 10227 - DNA, 20 bp, Artificial Sequence
  Description of Artificial Sequence: Synthetic oligonucleotide
  Target: DMPK; (-) strand; PAM type: NRG; PAM sequence: GAG
agatgcaagttcccagccta

SEQ ID NO: 10228 - DNA, 20 bp, Artificial Sequence
  Description of Artificial Sequence: Synthetic oligonucleotide
  Target: DMPK; (-) strand; PAM type: NRG; PAM sequence: TAG
taagatgcaagttcccagcc

SEQ ID NO: 10229 - DNA, 20 bp, Artificial Sequence
  Description of Artificial Sequence: Synthetic oligonucleotide
  Target: DMPK; (-) strand; PAM type: NRG; PAM sequence: CAG
ctagctaagatgcaagttcc

SEQ ID NO: 10230 - DNA, 20 bp, Artificial Sequence
  Description of Artificial Sequence: Synthetic oligonucleotide
  Target: DMPK; (-) strand; PAM type: NRG; PAM sequence: AAG
caggaagctagctaagatgc

SEQ ID NO: 10231 - DNA, 20 bp, Artificial Sequence
  Description of Artificial Sequence: Synthetic oligonucleotide
  Target: DMPK; (-) strand; PAM type: NRG; PAM sequence: AAG
gccaggacaggaagctagct

SEQ ID NO: 10232 - DNA, 20 bp, Artificial Sequence
  Description of Artificial Sequence: Synthetic oligonucleotide
  Target: DMPK; (-) strand; PAM type: NRG; PAM sequence: TAG
tgactgccaggacaggaagc

SEQ ID NO: 10233 - DNA, 20 bp, Artificial Sequence
  Description of Artificial Sequence: Synthetic oligonucleotide
  Target: DMPK; (-) strand; PAM type: NRG; PAM sequence: AAG
gtgctgactgccaggacagg

SEQ ID NO: 10234 - DNA, 20 bp, Artificial Sequence
  Description of Artificial Sequence: Synthetic oligonucleotide
  Target: DMPK; (-) strand; PAM type: NRG; PAM sequence: AGG
aaagtgctgactgccaggac

SEQ ID NO: 10235 - DNA, 20 bp, Artificial Sequence
  Description of Artificial Sequence: Synthetic oligonucleotide
  Target: DMPK; (-) strand; PAM type: NRG; PAM sequence: CAG
gaaagtgctgactgccagga

SEQ ID NO: 10236 - DNA, 20 bp, Artificial Sequence
  Description of Artificial Sequence: Synthetic oligonucleotide
  Target: DMPK; (-) strand; PAM type: NRG; PAM sequence: AGG
gcgtgaaagtgctgactgcc

SEQ ID NO: 10237 - DNA, 20 bp, Artificial Sequence
  Description of Artificial Sequence: Synthetic oligonucleotide
  Target: DMPK; (-) strand; PAM type: NRG; PAM sequence: CAG
tgcgtgaaagtgctgactgc

SEQ ID NO: 10238 - DNA, 20 bp, Artificial Sequence
  Description of Artificial Sequence: Synthetic oligonucleotide
  Target: DMPK; (-) strand; PAM type: NRG; PAM sequence: AAG
ggactttgattattgcgtga

SEQ ID NO: 10239 - DNA, 20 bp, Artificial Sequence
  Description of Artificial Sequence: Synthetic oligonucleotide
  Target: DMPK; (-) strand; PAM type: NRG; PAM sequence: AGG
gtctcactcaggatccgcca

SEQ ID NO: 10240 - DNA, 20 bp, Artificial Sequence
  Description of Artificial Sequence: Synthetic oligonucleotide
  Target: DMPK; (-) strand; PAM type: NRG; PAM sequence: AAG
ggtctcactcaggatccgcc

SEQ ID NO: 10241 - DNA, 20 bp, Artificial Sequence
  Description of Artificial Sequence: Synthetic oligonucleotide
  Target: DMPK; (-) strand; PAM type: NRG; PAM sequence: AGG
cttaccccatggtctcactc

SEQ ID NO: 10242 - DNA, 20 bp, Artificial Sequence
  Description of Artificial Sequence: Synthetic oligonucleotide
  Target: DMPK; (-) strand; PAM type: NRG; PAM sequence: CAG
ccttaccccatggtctcact

SEQ ID NO: 10243 - DNA, 20 bp, Artificial Sequence
  Description of Artificial Sequence: Synthetic oligonucleotide
  Target: DMPK; (-) strand; PAM type: NRG; PAM sequence: TGG
ccacccttacccttacccca

SEQ ID NO: 10244 - DNA, 20 bp, Artificial Sequence
  Description of Artificial Sequence: Synthetic oligonucleotide
  Target: DMPK; (-) strand; PAM type: NRG; PAM sequence: CAG
cccaagttagaagggagctc

SEQ ID NO: 10245 - DNA, 20 bp, Artificial Sequence
  Description of Artificial Sequence: Synthetic oligonucleotide
  Target: DMPK; (-) strand; PAM type: NRG; PAM sequence: GAG
gtccctcccaagttagaagg

SEQ ID NO: 10246 - DNA, 20 bp, Artificial Sequence
  Description of Artificial Sequence: Synthetic oligonucleotide
  Target: DMPK; (-) strand; PAM type: NRG; PAM sequence: GGG
gggtccctcccaagttagaa

SEQ ID NO: 10247 - DNA, 20 bp, Artificial Sequence
  Description of Artificial Sequence: Synthetic oligonucleotide
  Target: DMPK; (-) strand; PAM type: NRG; PAM sequence: AGG
agggtccctcccaagttaga

SEQ ID NO: 10248 - DNA, 20 bp, Artificial Sequence
  Description of Artificial Sequence: Synthetic oligonucleotide
  Target: DMPK; (-) strand; PAM type: NRG; PAM sequence: AAG
cagggtccctcccaagttag

SEQ ID NO: 10249 - DNA, 20 bp, Artificial Sequence
  Description of Artificial Sequence: Synthetic oligonucleotide
  Target: DMPK; (-) strand; PAM type: NRG; PAM sequence: TAG
cctcagggtccctcccaagt

SEQ ID NO: 10250 - DNA, 20 bp, Artificial Sequence
  Description of Artificial Sequence: Synthetic oligonucleotide
  Target: DMPK; (-) strand; PAM type: NRG; PAM sequence: AAG
agcacctcagggtccctccc

SEQ ID NO: 10251 - DNA, 20 bp, Artificial Sequence
  Description of Artificial Sequence: Synthetic oligonucleotide
  Target: DMPK; (-) strand; PAM type: NRG; PAM sequence: GGG
gttctttccccagcacctca

SEQ ID NO: 10252 - DNA, 20 bp, Artificial Sequence
  Description of Artificial Sequence: Synthetic oligonucleotide
  Target: DMPK; (-) strand; PAM type: NRG; PAM sequence: AGG
agttctttccccagcacctc

SEQ ID NO: 10253 - DNA, 20 bp, Artificial Sequence
  Description of Artificial Sequence: Synthetic oligonucleotide
  Target: DMPK; (-) strand; PAM type: NRG; PAM sequence: CAG
gagttctttccccagcacct

SEQ ID NO: 10254 - DNA, 20 bp, Artificial Sequence
  Description of Artificial Sequence: Synthetic oligonucleotide
  Target: DMPK; (-) strand; PAM type: NRG; PAM sequence: CAG
ctgtccctgagttctttccc

SEQ ID NO: 10255 - DNA, 20 bp, Artificial Sequence
  Description of Artificial Sequence: Synthetic oligonucleotide
  Target: DMPK; (-) strand; PAM type: NRG; PAM sequence: GAG
gtagaggtaggactgtccct

SEQ ID NO: 10256 - DNA, 20 bp, Artificial Sequence
  Description of Artificial Sequence: Synthetic oligonucleotide
  Target: DMPK; (-) strand; PAM type: NRG; PAM sequence: AGG
agcaagtcagtggtagaggt

SEQ ID NO: 10257 - DNA, 20 bp, Artificial Sequence
  Description of Artificial Sequence: Synthetic oligonucleotide
  Target: DMPK; (-) strand; PAM type: NRG; PAM sequence: TAG
cagcaagtcagtggtagagg

SEQ ID NO: 10258 - DNA, 20 bp, Artificial Sequence
  Description of Artificial Sequence: Synthetic oligonucleotide
  Target: DMPK; (-) strand; PAM type: NRG; PAM sequence: AGG
acccagcaagtcagtggtag

SEQ ID NO: 10259 - DNA, 20 bp, Artificial Sequence
  Description of Artificial Sequence: Synthetic oligonucleotide
  Target: DMPK; (-) strand; PAM type: NRG; PAM sequence: GAG
cacccagcaagtcagtggta

SEQ ID NO: 10260 - DNA, 20 bp, Artificial Sequence
  Description of Artificial Sequence: Synthetic oligonucleotide
  Target: DMPK; (-) strand; PAM type: NRG; PAM sequence: TAG
gtcacccagcaagtcagtgg

SEQ ID NO: 10261 - DNA, 20 bp, Artificial Sequence
  Description of Artificial Sequence: Synthetic oligonucleotide
  Target: DMPK; (-) strand; PAM type: NRG; PAM sequence: TGG
caggtcacccagcaagtcag

SEQ ID NO: 10262 - DNA, 20 bp, Artificial Sequence
  Description of Artificial Sequence: Synthetic oligonucleotide
  Target: DMPK; (-) strand; PAM type: NRG; PAM sequence: CAG
gcccaggtcacccagcaagt

SEQ ID NO: 10263 - DNA, 20 bp, Artificial Sequence
  Description of Artificial Sequence: Synthetic oligonucleotide
  Target: DMPK; (-) strand; PAM type: NRG; PAM sequence: AAG
gttggcccaggtcacccagc

SEQ ID NO: 10264 - DNA, 20 bp, Artificial Sequence
  Description of Artificial Sequence: Synthetic oligonucleotide
  Target: DMPK; (-) strand; PAM type: NRG; PAM sequence: CAG
ggaagttggcccaggtcacc

SEQ ID NO: 10265 - DNA, 20 bp, Artificial Sequence
  Description of Artificial Sequence: Synthetic oligonucleotide
  Target: DMPK; (-) strand; PAM type: NRG; PAM sequence: AGG
caggggaaggaagttggccc

SEQ ID NO: 10266 - DNA, 20 bp, Artificial Sequence
  Description of Artificial Sequence: Synthetic oligonucleotide
  Target: DMPK; (-) strand; PAM type: NRG; PAM sequence: CAG
acaggggaaggaagttggcc

SEQ ID NO: 10267 - DNA, 20 bp, Artificial Sequence
  Description of Artificial Sequence: Synthetic oligonucleotide
  Target: DMPK; (-) strand; PAM type: NRG; PAM sequence: TGG
cccagacaggggaaggaagt

SEQ ID NO: 10268 - DNA, 20 bp, Artificial Sequence
  Description of Artificial Sequence: Synthetic oligonucleotide
  Target: DMPK; (-) strand; PAM type: NRG; PAM sequence: AAG
gaggcccagacaggggaagg

SEQ ID NO: 10269 - DNA, 20 bp, Artificial Sequence
  Description of Artificial Sequence: Synthetic oligonucleotide
  Target: DMPK; (-) strand; PAM type: NRG; PAM sequence: AGG
accgaggcccagacagggga

SEQ ID NO: 10270 - DNA, 20 bp, Artificial Sequence
  Description of Artificial Sequence: Synthetic oligonucleotide
  Target: DMPK; (-) strand; PAM type: NRG; PAM sequence: AAG
gaccgaggcccagacagggg

SEQ ID NO: 10271 - DNA, 20 bp, Artificial Sequence
  Description of Artificial Sequence: Synthetic oligonucleotide
  Target: DMPK; (-) strand; PAM type: NRG; PAM sequence: GGG
ggagaccgaggcccagacag

SEQ ID NO: 10272 - DNA, 20 bp, Artificial Sequence
  Description of Artificial Sequence: Synthetic oligonucleotide
  Target: DMPK; (-) strand; PAM type: NRG; PAM sequence: GGG
aggagaccgaggcccagaca

SEQ ID NO: 10273 - DNA, 20 bp, Artificial Sequence
  Description of Artificial Sequence: Synthetic oligonucleotide
  Target: DMPK; (-) strand; PAM type: NRG; PAM sequence: AGG
gaggagaccgaggcccagac

SEQ ID NO: 10274 - DNA, 20 bp, Artificial Sequence
  Description of Artificial Sequence: Synthetic oligonucleotide
  Target: DMPK; (-) strand; PAM type: NRG; PAM sequence: CAG
cgaggagaccgaggcccaga

SEQ ID NO: 10275 - DNA, 20 bp, Artificial Sequence
  Description of Artificial Sequence: Synthetic oligonucleotide
  Target: DMPK; (-) strand; PAM type: NRG; PAM sequence: CAG
cagacgaggagaccgaggcc

SEQ ID NO: 10276 - DNA, 20 bp, Artificial Sequence
  Description of Artificial Sequence: Synthetic oligonucleotide
  Target: DMPK; (-) strand; PAM type: NRG; PAM sequence: AGG
gttcacagacgaggagaccg

SEQ ID NO: 10277 - DNA, 20 bp, Artificial Sequence
  Description of Artificial Sequence: Synthetic oligonucleotide
  Target: DMPK; (-) strand; PAM type: NRG; PAM sequence: GAG
agttcacagacgaggagacc

SEQ ID NO: 10278 - DNA, 20 bp, Artificial Sequence
  Description of Artificial Sequence: Synthetic oligonucleotide
  Target: DMPK; (-) strand; PAM type: NRG; PAM sequence: GAG
ctccgtagttcacagacgag

SEQ ID NO: 10279 - DNA, 20 bp, Artificial Sequence
  Description of Artificial Sequence: Synthetic oligonucleotide
  Target: DMPK; (-) strand; PAM type: NRG; PAM sequence: AGG
gtctccgtagttcacagacg

SEQ ID NO: 10280 - DNA, 20 bp, Artificial Sequence
  Description of Artificial Sequence: Synthetic oligonucleotide
  Target: DMPK; (-) strand; PAM type: NRG; PAM sequence: GAG
tgtctccgtagttcacagac

SEQ ID NO: 10281 - DNA, 20 bp, Artificial Sequence
  Description of Artificial Sequence: Synthetic oligonucleotide
  Target: DMPK; (-) strand; PAM type: NRG; PAM sequence: CAG
ccctctgtctccgtagttca

SEQ ID NO: 10282 - DNA, 20 bp, Artificial Sequence
  Description of Artificial Sequence: Synthetic oligonucleotide
  Target: DMPK; (-) strand; PAM type: NRG; PAM sequence: TAG
aagagacccctctgtctccg

SEQ ID NO: 10283 - DNA, 20 bp, Artificial Sequence
  Description of Artificial Sequence: Synthetic oligonucleotide
  Target: DMPK; (-) strand; PAM type: NRG; PAM sequence: GAG
agtctggttgagtcctaaaa

SEQ ID NO: 10284 - DNA, 20 bp, Artificial Sequence
  Description of Artificial Sequence: Synthetic oligonucleotide
  Target: DMPK; (-) strand; PAM type: NRG; PAM sequence: AAG
ggagtctggttgagtcctaa

SEQ ID NO: 10285 - DNA, 20 bp, Artificial Sequence
  Description of Artificial Sequence: Synthetic oligonucleotide
  Target: DMPK; (-) strand; PAM type: NRG; PAM sequence: GAG
gggatttggggagtctggtt

SEQ ID NO: 10286 - DNA, 20 bp, Artificial Sequence
  Description of Artificial Sequence: Synthetic oligonucleotide
  Target: DMPK; (-) strand; PAM type: NRG; PAM sequence: TGG
gtggtgggatttggggagtc

SEQ ID NO: 10287 - DNA, 20 bp, Artificial Sequence
  Description of Artificial Sequence: Synthetic oligonucleotide
  Target: DMPK; (-) strand; PAM type: NRG; PAM sequence: GAG
caagagtggtgggatttggg

SEQ ID NO: 10288 - DNA, 20 bp, Artificial Sequence
  Description of Artificial Sequence: Synthetic oligonucleotide
  Target: DMPK; (-) strand; PAM type: NRG; PAM sequence: GGG
ggcaagagtggtgggatttg

SEQ ID NO: 10289 - DNA, 20 bp, Artificial Sequence
  Description of Artificial Sequence: Synthetic oligonucleotide
  Target: DMPK; (-) strand; PAM type: NRG; PAM sequence: GGG
aggcaagagtggtgggattt

SEQ ID NO: 10290 - DNA, 20 bp, Artificial Sequence
  Description of Artificial Sequence: Synthetic oligonucleotide
  Target: DMPK; (-) strand; PAM type: NRG; PAM sequence: TGG
gaggcaagagtggtgggatt

SEQ ID NO: 10291 - DNA, 20 bp, Artificial Sequence
  Description of Artificial Sequence: Synthetic oligonucleotide
  Target: DMPK; (-) strand; PAM type: NRG; PAM sequence: GGG
gactcagaggcaagagtggt

SEQ ID NO: 10292 - DNA, 20 bp, Artificial Sequence
  Description of Artificial Sequence: Synthetic oligonucleotide
  Target: DMPK; (-) strand; PAM type: NRG; PAM sequence: TGG
tgactcagaggcaagagtgg

SEQ ID NO: 10293 - DNA, 20 bp, Artificial Sequence
  Description of Artificial Sequence: Synthetic oligonucleotide
  Target: DMPK; (-) strand; PAM type: NRG; PAM sequence: TGG
gagtgactcagaggcaagag

SEQ ID NO: 10294 - DNA, 20 bp, Artificial Sequence
  Description of Artificial Sequence: Synthetic oligonucleotide
  Target: DMPK; (-) strand; PAM type: NRG; PAM sequence: GAG
tctgagtgactcagaggcaa

SEQ ID NO: 10295 - DNA, 20 bp, Artificial Sequence
  Description of Artificial Sequence: Synthetic oligonucleotide
  Target: DMPK; (-) strand; PAM type: NRG; PAM sequence: AAG
agtctgagtgactcagaggc

SEQ ID NO: 10296 - DNA, 20 bp, Artificial Sequence
  Description of Artificial Sequence: Synthetic oligonucleotide
  Target: DMPK; (-) strand; PAM type: NRG; PAM sequence: AGG
gcacagtctgagtgactcag

SEQ ID NO: 10297 - DNA, 20 bp, Artificial Sequence
  Description of Artificial Sequence: Synthetic oligonucleotide
  Target: DMPK; (-) strand; PAM type: NRG; PAM sequence: GAG
agcacagtctgagtgactca

SEQ ID NO: 10298 - DNA, 20 bp, Artificial Sequence
  Description of Artificial Sequence: Synthetic oligonucleotide
  Target: DMPK; (-) strand; PAM type: NRG; PAM sequence: CAG
agagcacagtctgagtgact

SEQ ID NO: 10299 - DNA, 20 bp, Artificial Sequence
  Description of Artificial Sequence: Synthetic oligonucleotide
  Target: DMPK; (-) strand; PAM type: NRG; PAM sequence: GAG
agaacttgagagcacagtct

SEQ ID NO: 10300 - DNA, 20 bp, Artificial Sequence
  Description of Artificial Sequence: Synthetic oligonucleotide
  Target: DMPK; (-) strand; PAM type: NRG; PAM sequence: CAG
gtccctagaacttgagagca

SEQ ID NO: 10301 - DNA, 20 bp, Artificial Sequence
  Description of Artificial Sequence: Synthetic oligonucleotide
  Target: DMPK; (-) strand; PAM type: NRG; PAM sequence: GAG
cctgagtccctagaacttga

SEQ ID NO: 10302 - DNA, 20 bp, Artificial Sequence
  Description of Artificial Sequence: Synthetic oligonucleotide
  Target: DMPK; (-) strand; PAM type: NRG; PAM sequence: GAG
gtcctgagtccctagaactt

SEQ ID NO: 10303 - DNA, 20 bp, Artificial Sequence
  Description of Artificial Sequence: Synthetic oligonucleotide
  Target: DMPK; (-) strand; PAM type: NRG; PAM sequence: TAG
atcgtagagtcctgagtccc

SEQ ID NO: 10304 - DNA, 20 bp, Artificial Sequence
  Description of Artificial Sequence: Synthetic oligonucleotide
  Target: DMPK; (-) strand; PAM type: NRG; PAM sequence: GAG
ttttggaatcgtagagtcct

SEQ ID NO: 10305 - DNA, 20 bp, Artificial Sequence
  Description of Artificial Sequence: Synthetic oligonucleotide
  Target: DMPK; (-) strand; PAM type: NRG; PAM sequence: GAG
tcctcagttttggaatcgta

SEQ ID NO: 10306 - DNA, 20 bp, Artificial Sequence
  Description of Artificial Sequence: Synthetic oligonucleotide
  Target: DMPK; (-) strand; PAM type: NRG; PAM sequence: TAG
gatcctcagttttggaatcg

SEQ ID NO: 10307 - DNA, 20 bp, Artificial Sequence
  Description of Artificial Sequence: Synthetic oligonucleotide
  Target: DMPK; (-) strand; PAM type: NRG; PAM sequence: TGG
gttcctcagatcctcagttt

SEQ ID NO: 10308 - DNA, 20 bp, Artificial Sequence
  Description of Artificial Sequence: Synthetic oligonucleotide
  Target: DMPK; (-) strand; PAM type: NRG; PAM sequence: CAG
ggcttggttcctcagatcct

SEQ ID NO: 10309 - DNA, 20 bp, Artificial Sequence
  Description of Artificial Sequence: Synthetic oligonucleotide
  Target: DMPK; (-) strand; PAM type: NRG; PAM sequence: CAG
gaggccgtggcttggttcct

SEQ ID NO: 10310 - DNA, 20 bp, Artificial Sequence
  Description of Artificial Sequence: Synthetic oligonucleotide
  Target: DMPK; (-) strand; PAM type: NRG; PAM sequence: TGG
gggtcctggaggccgtggct

SEQ ID NO: 10311 - DNA, 20 bp, Artificial Sequence
  Description of Artificial Sequence: Synthetic oligonucleotide
  Target: DMPK; (-) strand; PAM type: NRG; PAM sequence: TGG
gcccagggtcctggaggccg

SEQ ID NO: 10312 - DNA, 20 bp, Artificial Sequence
  Description of Artificial Sequence: Synthetic oligonucleotide
  Target: DMPK; (-) strand; PAM type: NRG; PAM sequence: AGG
tcagttgcccagggtcctgg

SEQ ID NO: 10313 - DNA, 20 bp, Artificial Sequence
  Description of Artificial Sequence: Synthetic oligonucleotide
  Target: DMPK; (-) strand; PAM type: NRG; PAM sequence: GAG
ctcagttgcccagggtcctg

SEQ ID NO: 10314 - DNA, 20 bp, Artificial Sequence
  Description of Artificial Sequence: Synthetic oligonucleotide
  Target: DMPK; (-) strand; PAM type: NRG; PAM sequence: TGG
gactcagttgcccagggtcc

SEQ ID NO: 10315 - DNA, 20 bp, Artificial Sequence
  Description of Artificial Sequence: Synthetic oligonucleotide
  Target: DMPK; (-) strand; PAM type: NRG; PAM sequence: GGG
ggcttggactcagttgccca

SEQ ID NO: 10316 - DNA, 20 bp, Artificial Sequence
  Description of Artificial Sequence: Synthetic oligonucleotide
  Target: DMPK; (-) strand; PAM type: NRG; PAM sequence: AGG
gggcttggactcagttgccc

SEQ ID NO: 10317 - DNA, 20 bp, Artificial Sequence
  Description of Artificial Sequence: Synthetic oligonucleotide
  Target: DMPK; (-) strand; PAM type: NRG; PAM sequence: CAG
agggcttggactcagttgcc

SEQ ID NO: 10318 - DNA, 20 bp, Artificial Sequence
  Description of Artificial Sequence: Synthetic oligonucleotide
  Target: DMPK; (-) strand; PAM type: NRG; PAM sequence: CAG
agcttcttagggcttggact

SEQ ID NO: 10319 - DNA, 20 bp, Artificial Sequence
  Description of Artificial Sequence: Synthetic oligonucleotide
  Target: DMPK; (-) strand; PAM type: NRG; PAM sequence: TGG
tgtctcagcttcttagggct

SEQ ID NO: 10320 - DNA, 20 bp, Artificial Sequence
  Description of Artificial Sequence: Synthetic oligonucleotide
  Target: DMPK; (-) strand; PAM type: NRG; PAM sequence: GGG
ttgggtgtctcagcttctta

SEQ ID NO: 10321 - DNA, 20 bp, Artificial Sequence
  Description of Artificial Sequence: Synthetic oligonucleotide
  Target: DMPK; (-) strand; PAM type: NRG; PAM sequence: AGG
cttgggtgtctcagcttctt

SEQ ID NO: 10322 - DNA, 20 bp, Artificial Sequence
  Description of Artificial Sequence: Synthetic oligonucleotide
  Target: DMPK; (-) strand; PAM type: NRG; PAM sequence: TAG
tcttgggtgtctcagcttct

SEQ ID NO: 10323 - DNA, 20 bp, Artificial Sequence
  Description of Artificial Sequence: Synthetic oligonucleotide
  Target: DMPK; (-) strand; PAM type: NRG; PAM sequence: CAG
ggagctcgtcttgggtgtct

SEQ ID NO: 10324 - DNA, 20 bp, Artificial Sequence
  Description of Artificial Sequence: Synthetic oligonucleotide
  Target: DMPK; (-) strand; PAM type: NRG; PAM sequence: GGG
gtaagttcggagctcgtctt

SEQ ID NO: 10325 - DNA, 20 bp, Artificial Sequence
  Description of Artificial Sequence: Synthetic oligonucleotide
  Target: DMPK; (-) strand; PAM type: NRG; PAM sequence: TGG
tgtaagttcggagctcgtct

SEQ ID NO: 10326 - DNA, 20 bp, Artificial Sequence
  Description of Artificial Sequence: Synthetic oligonucleotide
  Target: DMPK; (-) strand; PAM type: NRG; PAM sequence: GAG
cctggcatcttgtaagttcg

SEQ ID NO: 10327 - DNA, 20 bp, Artificial Sequence
  Description of Artificial Sequence: Synthetic oligonucleotide
  Target: DMPK; (-) strand; PAM type: NRG; PAM sequence: CGG
ggcctggcatcttgtaagtt

SEQ ID NO: 10328 - DNA, 20 bp, Artificial Sequence
  Description of Artificial Sequence: Synthetic oligonucleotide
  Target: DMPK; (-) strand; PAM type: NRG; PAM sequence: AAG
aatcaggcctggcatcttgt

SEQ ID NO: 10329 - DNA, 20 bp, Artificial Sequence
  Description of Artificial Sequence: Synthetic oligonucleotide
  Target: DMPK; (-) strand; PAM type: NRG; PAM sequence: TGG
catagtaggcgaatcaggcc

SEQ ID NO: 10330 - DNA, 20 bp, Artificial Sequence
  Description of Artificial Sequence: Synthetic oligonucleotide
  Target: DMPK; (-) strand; PAM type: NRG; PAM sequence: AGG
aaggtcatagtaggcgaatc

SEQ ID NO: 10331 - DNA, 20 bp, Artificial Sequence
  Description of Artificial Sequence: Synthetic oligonucleotide
  Target: DMPK; (-) strand; PAM type: NRG; PAM sequence: CAG
gaaggtcatagtaggcgaat

SEQ ID NO: 10332 - DNA, 20 bp, Artificial Sequence
  Description of Artificial Sequence: Synthetic oligonucleotide
  Target: DMPK; (-) strand; PAM type: NRG; PAM sequence: AGG
ggcgttgggaaggtcatagt

SEQ ID NO: 10333 - DNA, 20 bp, Artificial Sequence
  Description of Artificial Sequence: Synthetic oligonucleotide
  Target: DMPK; (-) strand; PAM type: NRG; PAM sequence: TAG
tggcgttgggaaggtcatag

SEQ ID NO: 10334 - DNA, 20 bp, Artificial Sequence
  Description of Artificial Sequence: Synthetic oligonucleotide
  Target: DMPK; (-) strand; PAM type: NRG; PAM sequence: TAG
ctgtggcgttgggaaggtca

SEQ ID NO: 10335 - DNA, 20 bp, Artificial Sequence
  Description of Artificial Sequence: Synthetic oligonucleotide
  Target: DMPK; (-) strand; PAM type: NRG; PAM sequence: AGG
ggtgggctgtggcgttggga

SEQ ID NO: 10336 - DNA, 20 bp, Artificial Sequence
  Description of Artificial Sequence: Synthetic oligonucleotide
  Target: DMPK; (-) strand; PAM type: NRG; PAM sequence: AAG
gggtgggctgtggcgttggg

SEQ ID NO: 10337 - DNA, 20 bp, Artificial Sequence
  Description of Artificial Sequence: Synthetic oligonucleotide
  Target: DMPK; (-) strand; PAM type: NRG; PAM sequence: GGG
cctgggtgggctgtggcgtt

SEQ ID NO: 10338 - DNA, 20 bp, Artificial Sequence
  Description of Artificial Sequence: Synthetic oligonucleotide
  Target: DMPK; (-) strand; PAM type: NRG; PAM sequence: TGG
tcctgggtgggctgtggcgt

SEQ ID NO: 10339 - DNA, 20 bp, Artificial Sequence
  Description of Artificial Sequence: Synthetic oligonucleotide
  Target: DMPK; (-) strand; PAM type: NRG; PAM sequence: TGG
cttgcctcctgggtgggctg

SEQ ID NO: 10340 - DNA, 20 bp, Artificial Sequence
  Description of Artificial Sequence: Synthetic oligonucleotide
  Target: DMPK; (-) strand; PAM type: NRG; PAM sequence: GGG
gatgtgcttgcctcctgggt

SEQ ID NO: 10341 - DNA, 20 bp, Artificial Sequence
  Description of Artificial Sequence: Synthetic oligonucleotide
  Target: DMPK; (-) strand; PAM type: NRG; PAM sequence: TGG
ggatgtgcttgcctcctggg

SEQ ID NO: 10342 - DNA, 20 bp, Artificial Sequence
  Description of Artificial Sequence: Synthetic oligonucleotide
  Target: DMPK; (-) strand; PAM type: NRG; PAM sequence: GGG
ggtggatgtgcttgcctcct

SEQ ID NO: 10343 - DNA, 20 bp, Artificial Sequence
  Description of Artificial Sequence: Synthetic oligonucleotide
  Target: DMPK; (-) strand; PAM type: NRG; PAM sequence: TGG
gggtggatgtgcttgcctcc

SEQ ID NO: 10344 - DNA, 20 bp, Artificial Sequence
  Description of Artificial Sequence: Synthetic oligonucleotide
  Target: DMPK; (-) strand; PAM type: NRG; PAM sequence: TGG
cctgtaggatgggcagtggg

SEQ ID NO: 10345 - DNA, 20 bp, Artificial Sequence
  Description of Artificial Sequence: Synthetic oligonucleotide
  Target: DMPK; (-) strand; PAM type: NRG; PAM sequence: GGG
gagcctgtaggatgggcagt

SEQ ID NO: 10346 - DNA, 20 bp, Artificial Sequence
  Description of Artificial Sequence: Synthetic oligonucleotide
  Target: DMPK; (-) strand; PAM type: NRG; PAM sequence: TGG
agagcctgtaggatgggcag

SEQ ID NO: 10347 - DNA, 20 bp, Artificial Sequence
  Description of Artificial Sequence: Synthetic oligonucleotide
  Target: DMPK; (-) strand; PAM type: NRG; PAM sequence: CAG
aacagagcctgtaggatggg

SEQ ID NO: 10348 - DNA, 20 bp, Artificial Sequence
  Description of Artificial Sequence: Synthetic oligonucleotide
  Target: DMPK; (-) strand; PAM type: NRG; PAM sequence: GGG
tagaacagagcctgtaggat

SEQ ID NO: 10349 - DNA, 20 bp, Artificial Sequence
  Description of Artificial Sequence: Synthetic oligonucleotide
  Target: DMPK; (-) strand; PAM type: NRG; PAM sequence: TGG
ttagaacagagcctgtagga

SEQ ID NO: 10350 - DNA, 20 bp, Artificial Sequence
  Description of Artificial Sequence: Synthetic oligonucleotide
  Target: DMPK; (-) strand; PAM type: NRG; PAM sequence: AGG
cctcttagaacagagcctgt

SEQ ID NO: 10351 - DNA, 20 bp, Artificial Sequence
  Description of Artificial Sequence: Synthetic oligonucleotide
  Target: DMPK; (-) strand; PAM type: NRG; PAM sequence: TAG
acctcttagaacagagcctg

SEQ ID NO: 10352 - DNA, 20 bp, Artificial Sequence
  Description of Artificial Sequence: Synthetic oligonucleotide
  Target: DMPK; (-) strand; PAM type: NRG; PAM sequence: GAG
actcatcacctcttagaaca

SEQ ID NO: 10353 - DNA, 20 bp, Artificial Sequence
  Description of Artificial Sequence: Synthetic oligonucleotide
  Target: DMPK; (-) strand; PAM type: NRG; PAM sequence: CAG
caactcatcacctcttagaa

SEQ ID NO: 10354 - DNA, 20 bp, Artificial Sequence
  Description of Artificial Sequence: Synthetic oligonucleotide
  Target: DMPK; (-) strand; PAM type: NRG; PAM sequence: TAG
acctccaactcatcacctct

SEQ ID NO: 10355 - DNA, 20 bp, Artificial Sequence
  Description of Artificial Sequence: Synthetic oligonucleotide
  Target: DMPK; (-) strand; PAM type: NRG; PAM sequence: AAG
ctccctctgtgaccctggac

SEQ ID NO: 10356 - DNA, 20 bp, Artificial Sequence
  Description of Artificial Sequence: Synthetic oligonucleotide
  Target: DMPK; (-) strand; PAM type: NRG; PAM sequence: TGG
tcccactccctctgtgaccc

SEQ ID NO: 10357 - DNA, 20 bp, Artificial Sequence
  Description of Artificial Sequence: Synthetic oligonucleotide
  Target: DMPK; (-) strand; PAM type: NRG; PAM sequence: CAG
ggaatcccaggcctgggttc

SEQ ID NO: 10358 - DNA, 20 bp, Artificial Sequence
  Description of Artificial Sequence: Synthetic oligonucleotide
  Target: DMPK; (-) strand; PAM type: NRG; PAM sequence: GGG
aggctgggaatcccaggcct

SEQ ID NO: 10359 - DNA, 20 bp, Artificial Sequence
  Description of Artificial Sequence: Synthetic oligonucleotide
  Target: DMPK; (-) strand; PAM type: NRG; PAM sequence: TGG
caggctgggaatcccaggcc

SEQ ID NO: 10360 - DNA, 20 bp, Artificial Sequence
  Description of Artificial Sequence: Synthetic oligonucleotide
  Target: DMPK; (-) strand; PAM type: NRG; PAM sequence: AGG
aggcacaggctgggaatccc

SEQ ID NO: 10361 - DNA, 20 bp, Artificial Sequence
  Description of Artificial Sequence: Synthetic oligonucleotide
  Target: DMPK; (-) strand; PAM type: NRG; PAM sequence: CAG
aaggcacaggctgggaatcc

SEQ ID NO: 10362 - DNA, 20 bp, Artificial Sequence
  Description of Artificial Sequence: Synthetic oligonucleotide
  Target: DMPK; (-) strand; PAM type: NRG; PAM sequence: GGG
tcctgctgaaggcacaggct

SEQ ID NO: 10363 - DNA, 20 bp, Artificial Sequence
  Description of Artificial Sequence: Synthetic oligonucleotide
  Target: DMPK; (-) strand; PAM type: NRG; PAM sequence: TGG
ctcctgctgaaggcacaggc

SEQ ID NO: 10364 - DNA, 20 bp, Artificial Sequence
  Description of Artificial Sequence: Synthetic oligonucleotide
  Target: DMPK; (-) strand; PAM type: NRG; PAM sequence: AGG
gagcctcctgctgaaggcac

SEQ ID NO: 10365 - DNA, 20 bp, Artificial Sequence
  Description of Artificial Sequence: Synthetic oligonucleotide
  Target: DMPK; (-) strand; PAM type: NRG; PAM sequence: CAG
tgagcctcctgctgaaggca

SEQ ID NO: 10366 - DNA, 20 bp, Artificial Sequence
  Description of Artificial Sequence: Synthetic oligonucleotide
  Target: DMPK; (-) strand; PAM type: NRG; PAM sequence: AGG
ggatctgagcctcctgctga

SEQ ID NO: 10367 - DNA, 20 bp, Artificial Sequence
  Description of Artificial Sequence: Synthetic oligonucleotide
  Target: DMPK; (-) strand; PAM type: NRG; PAM sequence: AAG
aggatctgagcctcctgctg

SEQ ID NO: 10368 - DNA, 20 bp, Artificial Sequence
  Description of Artificial Sequence: Synthetic oligonucleotide
  Target: DMPK; (-) strand; PAM type: NRG; PAM sequence: GAG
gggtctgggactcaggatct

SEQ ID NO: 10369 - DNA, 20 bp, Artificial Sequence
  Description of Artificial Sequence: Synthetic oligonucleotide
  Target: DMPK; (-) strand; PAM type: NRG; PAM sequence: AGG
ccagcctgggtctgggactc

SEQ ID NO: 10370 - DNA, 20 bp, Artificial Sequence
  Description of Artificial Sequence: Synthetic oligonucleotide
  Target: DMPK; (-) strand; PAM type: NRG; PAM sequence: CAG
gccagcctgggtctgggact

SEQ ID NO: 10371 - DNA, 20 bp, Artificial Sequence
  Description of Artificial Sequence: Synthetic oligonucleotide
  Target: DMPK; (-) strand; PAM type: NRG; PAM sequence: GGG
atggctgccagcctgggtct

SEQ ID NO: 10372 - DNA, 20 bp, Artificial Sequence
  Description of Artificial Sequence: Synthetic oligonucleotide
  Target: DMPK; (-) strand; PAM type: NRG; PAM sequence: TGG
catggctgccagcctgggtc

SEQ ID NO: 10373 - DNA, 20 bp, Artificial Sequence
  Description of Artificial Sequence: Synthetic oligonucleotide
  Target: DMPK; (-) strand; PAM type: NRG; PAM sequence: GGG
gtgggcatggctgccagcct

SEQ ID NO: 10374 - DNA, 20 bp, Artificial Sequence
  Description of Artificial Sequence: Synthetic oligonucleotide
  Target: DMPK; (-) strand; PAM type: NRG; PAM sequence: TGG
tgtgggcatggctgccagcc

SEQ ID NO: 10375 - DNA, 20 bp, Artificial Sequence
  Description of Artificial Sequence: Synthetic oligonucleotide
  Target: DMPK; (-) strand; PAM type: NRG; PAM sequence: CAG
aagcctgtgggcatggctgc

SEQ ID NO: 10376 - DNA, 20 bp, Artificial Sequence
  Description of Artificial Sequence: Synthetic oligonucleotide
  Target: DMPK; (-) strand; PAM type: NRG; PAM sequence: TGG
cgagctcaagcctgtgggca

SEQ ID NO: 10377 - DNA, 20 bp, Artificial Sequence
  Description of Artificial Sequence: Synthetic oligonucleotide
  Target: DMPK; (-) strand; PAM type: NRG; PAM sequence: GGG
aggggcgagctcaagcctgt

SEQ ID NO: 10378 - DNA, 20 bp, Artificial Sequence
  Description of Artificial Sequence: Synthetic oligonucleotide
  Target: DMPK; (-) strand; PAM type: NRG; PAM sequence: TGG
taggggcgagctcaagcctg

SEQ ID NO: 10379 - DNA, 20 bp, Artificial Sequence
  Description of Artificial Sequence: Synthetic oligonucleotide
  Target: DMPK; (-) strand; PAM type: NRG; PAM sequence: AAG
ccaaaactaggggcgagctc

SEQ ID NO: 10380 - DNA, 20 bp, Artificial Sequence
  Description of Artificial Sequence: Synthetic oligonucleotide
  Target: DMPK; (-) strand; PAM type: NRG; PAM sequence: GAG
ttcaggccaaaactaggggc

SEQ ID NO: 10381 - DNA, 20 bp, Artificial Sequence
  Description of Artificial Sequence: Synthetic oligonucleotide
  Target: DMPK; (-) strand; PAM type: NRG; PAM sequence: GGG
gtacttcaggccaaaactag

SEQ ID NO: 10382 - DNA, 20 bp, Artificial Sequence
  Description of Artificial Sequence: Synthetic oligonucleotide
  Target: DMPK; (-) strand; PAM type: NRG; PAM sequence: GGG
agtacttcaggccaaaacta

SEQ ID NO: 10383 - DNA, 20 bp, Artificial Sequence
  Description of Artificial Sequence: Synthetic oligonucleotide
  Target: DMPK; (-) strand; PAM type: NRG; PAM sequence: AGG
gagtacttcaggccaaaact

SEQ ID NO: 10384 - DNA, 20 bp, Artificial Sequence
  Description of Artificial Sequence: Synthetic oligonucleotide
  Target: DMPK; (-) strand; PAM type: NRG; PAM sequence: TAG
tgagtacttcaggccaaaac

SEQ ID NO: 10385 - DNA, 20 bp, Artificial Sequence
  Description of Artificial Sequence: Synthetic oligonucleotide
  Target: DMPK; (-) strand; PAM type: NRG; PAM sequence: AGG
gaaacttttttgagtacttc

SEQ ID NO: 10386 - DNA, 20 bp, Artificial Sequence
  Description of Artificial Sequence: Synthetic oligonucleotide
  Target: DMPK; (-) strand; PAM type: NRG; PAM sequence: CAG
tgaaacttttttgagtactt

SEQ ID NO: 10387 - DNA, 20 bp, Artificial Sequence
  Description of Artificial Sequence: Synthetic oligonucleotide
  Target: DMPK; (-) strand; PAM type: NRG; PAM sequence: GAG
ttaaatcgtgaaactttttt

SEQ ID NO: 10388 - DNA, 20 bp, Artificial Sequence
  Description of Artificial Sequence: Synthetic oligonucleotide
  Target: DMPK; (-) strand; PAM type: NRG; PAM sequence: CAG
ttactgcctgtcactcgaac

SEQ ID NO: 10389 - DNA, 20 bp, Artificial Sequence
  Description of Artificial Sequence: Synthetic oligonucleotide
  Target: DMPK; (-) strand; PAM type: NRG; PAM sequence: AGG
cagatgggccccacatggcc

SEQ ID NO: 10390 - DNA, 20 bp, Artificial Sequence
  Description of Artificial Sequence: Synthetic oligonucleotide
  Target: DMPK; (-) strand; PAM type: NRG; PAM sequence: CAG
gcagatgggccccacatggc

SEQ ID NO: 10391 - DNA, 20 bp, Artificial Sequence
  Description of Artificial Sequence: Synthetic oligonucleotide
  Target: DMPK; (-) strand; PAM type: NRG; PAM sequence: TGG
ggcagcagatgggccccaca

SEQ ID NO: 10392 - DNA, 20 bp, Artificial Sequence
  Description of Artificial Sequence: Synthetic oligonucleotide
  Target: DMPK; (-) strand; PAM type: NRG; PAM sequence: GGG
ccgtctgaagggcagcagat

SEQ ID NO: 10393 - DNA, 20 bp, Artificial Sequence
  Description of Artificial Sequence: Synthetic oligonucleotide
  Target: DMPK; (-) strand; PAM type: NRG; PAM sequence: TGG
gccgtctgaagggcagcaga

SEQ ID NO: 10394 - DNA, 20 bp, Artificial Sequence
  Description of Artificial Sequence: Synthetic oligonucleotide
  Target: DMPK; (-) strand; PAM type: NRG; PAM sequence: CAG
gctggccgtctgaagggcag

SEQ ID NO: 10395 - DNA, 20 bp, Artificial Sequence
  Description of Artificial Sequence: Synthetic oligonucleotide
  Target: DMPK; (-) strand; PAM type: NRG; PAM sequence: CAG
aaggctggccgtctgaaggg

SEQ ID NO: 10396 - DNA, 20 bp, Artificial Sequence
  Description of Artificial Sequence: Synthetic oligonucleotide
  Target: DMPK; (-) strand; PAM type: NRG; PAM sequence: GGG
tccaaggctggccgtctgaa

SEQ ID NO: 10397 - DNA, 20 bp, Artificial Sequence
  Description of Artificial Sequence: Synthetic oligonucleotide
  Target: DMPK; (-) strand; PAM type: NRG; PAM sequence: AGG
atccaaggctggccgtctga

SEQ ID NO: 10398 - DNA, 20 bp, Artificial Sequence
  Description of Artificial Sequence: Synthetic oligonucleotide
  Target: DMPK; (-) strand; PAM type: NRG; PAM sequence: AAG
catccaaggctggccgtctg

SEQ ID NO: 10399 - DNA, 20 bp, Artificial Sequence
  Description of Artificial Sequence: Synthetic oligonucleotide
  Target: DMPK; (-) strand; PAM type: NRG; PAM sequence: TGG
ggaattggggcatccaaggc

SEQ ID NO: 10400 - DNA, 20 bp, Artificial Sequence
  Description of Artificial Sequence: Synthetic oligonucleotide
  Target: DMPK; (-) strand; PAM type: NRG; PAM sequence: AGG
gctaggaattggggcatcca

SEQ ID NO: 10401 - DNA, 20 bp, Artificial Sequence
  Description of Artificial Sequence: Synthetic oligonucleotide
  Target: DMPK; (-) strand; PAM type: NRG; PAM sequence: AAG
agctaggaattggggcatcc

SEQ ID NO: 10402 - DNA, 20 bp, Artificial Sequence
  Description of Artificial Sequence: Synthetic oligonucleotide
  Target: DMPK; (-) strand; PAM type: NRG; PAM sequence: GGG
tgagagccagctaggaattg

SEQ ID NO: 10403 - DNA, 20 bp, Artificial Sequence
  Description of Artificial Sequence: Synthetic oligonucleotide
  Target: DMPK; (-) strand; PAM type: NRG; PAM sequence: GGG
gtgagagccagctaggaatt

SEQ ID NO: 10404 - DNA, 20 bp, Artificial Sequence
  Description of Artificial Sequence: Synthetic oligonucleotide
  Target: DMPK; (-) strand; PAM type: NRG; PAM sequence: TGG
tgtgagagccagctaggaat

SEQ ID NO: 10405 - DNA, 20 bp, Artificial Sequence
  Description of Artificial Sequence: Synthetic oligonucleotide
  Target: DMPK; (-) strand; PAM type: NRG; PAM sequence: AGG
ggtgggtgtgagagccagct

SEQ ID NO: 10406 - DNA, 20 bp, Artificial Sequence
  Description of Artificial Sequence: Synthetic oligonucleotide
  Target: DMPK; (-) strand; PAM type: NRG; PAM sequence: TAG
gggtgggtgtgagagccagc

SEQ ID NO: 10407 - DNA, 20 bp, Artificial Sequence
  Description of Artificial Sequence: Synthetic oligonucleotide
  Target: DMPK; (-) strand; PAM type: NRG; PAM sequence: CAG
agaggggtgggtgtgagagc

SEQ ID NO: 10408 - DNA, 20 bp, Artificial Sequence
  Description of Artificial Sequence: Synthetic oligonucleotide
  Target: DMPK; (-) strand; PAM type: NRG; PAM sequence: GAG
agaaagaggggtgggtgtga

SEQ ID NO: 10409 - DNA, 20 bp, Artificial Sequence
  Description of Artificial Sequence: Synthetic oligonucleotide
  Target: DMPK; (-) strand; PAM type: NRG; PAM sequence: GAG
gcagaaagaggggtgggtgt

SEQ ID NO: 10410 - DNA, 20 bp, Artificial Sequence
  Description of Artificial Sequence: Synthetic oligonucleotide
  Target: DMPK; (-) strand; PAM type: NRG; PAM sequence: GGG
caggcagcagaaagaggggt

SEQ ID NO: 10411 - DNA, 20 bp, Artificial Sequence
  Description of Artificial Sequence: Synthetic oligonucleotide
  Target: DMPK; (-) strand; PAM type: NRG; PAM sequence: TGG
gcaggcagcagaaagagggg

SEQ ID NO: 10412 - DNA, 20 bp, Artificial Sequence
  Description of Artificial Sequence: Synthetic oligonucleotide
  Target: DMPK; (-) strand; PAM type: NRG; PAM sequence: GGG
gcagcaggcagcagaaagag

SEQ ID NO: 10413 - DNA, 20 bp, Artificial Sequence
  Description of Artificial Sequence: Synthetic oligonucleotide
  Target: DMPK; (-) strand; PAM type: NRG; PAM sequence: GGG
ggcagcaggcagcagaaaga

SEQ ID NO: 10414 - DNA, 20 bp, Artificial Sequence
  Description of Artificial Sequence: Synthetic oligonucleotide
  Target: DMPK; (-) strand; PAM type: NRG; PAM sequence: AGG
aggcagcaggcagcagaaag

SEQ ID NO: 10415 - DNA, 20 bp, Artificial Sequence
  Description of Artificial Sequence: Synthetic oligonucleotide
  Target: DMPK; (-) strand; PAM type: NRG; PAM sequence: GAG
taggcagcaggcagcagaaa

SEQ ID NO: 10416 - DNA, 20 bp, Artificial Sequence
  Description of Artificial Sequence: Synthetic oligonucleotide
  Target: DMPK; (-) strand; PAM type: NRG; PAM sequence: AAG
cctaggcagcaggcagcaga

SEQ ID NO: 10417 - DNA, 20 bp, Artificial Sequence
  Description of Artificial Sequence: Synthetic oligonucleotide
  Target: DMPK; (-) strand; PAM type: NRG; PAM sequence: CAG
tagccctaggcagcaggcag

SEQ ID NO: 10418 - DNA, 20 bp, Artificial Sequence
  Description of Artificial Sequence: Synthetic oligonucleotide
  Target: DMPK; (-) strand; PAM type: NRG; PAM sequence: CAG
gtctagccctaggcagcagg

SEQ ID NO: 10419 - DNA, 20 bp, Artificial Sequence
  Description of Artificial Sequence: Synthetic oligonucleotide
  Target: DMPK; (-) strand; PAM type: NRG; PAM sequence: AGG
ggggtctagccctaggcagc

SEQ ID NO: 10420 - DNA, 20 bp, Artificial Sequence
  Description of Artificial Sequence: Synthetic oligonucleotide
  Target: DMPK; (-) strand; PAM type: NRG; PAM sequence: CAG
gggggtctagccctaggcag

SEQ ID NO: 10421 - DNA, 20 bp, Artificial Sequence
  Description of Artificial Sequence: Synthetic oligonucleotide
  Target: DMPK; (-) strand; PAM type: NRG; PAM sequence: CAG
tgagggggtctagccctagg

SEQ ID NO: 10422 - DNA, 20 bp, Artificial Sequence
  Description of Artificial Sequence: Synthetic oligonucleotide
  Target: DMPK; (-) strand; PAM type: NRG; PAM sequence: AGG
gagtgagggggtctagccct

SEQ ID NO: 10423 - DNA, 20 bp, Artificial Sequence
  Description of Artificial Sequence: Synthetic oligonucleotide
  Target: DMPK; (-) strand; PAM type: NRG; PAM sequence: TAG
agagtgagggggtctagccc

SEQ ID NO: 10424 - DNA, 20 bp, Artificial Sequence
  Description of Artificial Sequence: Synthetic oligonucleotide
  Target: DMPK; (-) strand; PAM type: NRG; PAM sequence: TAG
atccttagagtgagggggtc

SEQ ID NO: 10425 - DNA, 20 bp, Artificial Sequence
  Description of Artificial Sequence: Synthetic oligonucleotide
  Target: DMPK; (-) strand; PAM type: NRG; PAM sequence: GGG
ctcagatccttagagtgagg

SEQ ID NO: 10426 - DNA, 20 bp, Artificial Sequence
  Description of Artificial Sequence: Synthetic oligonucleotide
  Target: DMPK; (-) strand; PAM type: NRG; PAM sequence: GGG
tctcagatccttagagtgag

SEQ ID NO: 10427 - DNA, 20 bp, Artificial Sequence
  Description of Artificial Sequence: Synthetic oligonucleotide
  Target: DMPK; (-) strand; PAM type: NRG; PAM sequence: GGG
ctctcagatccttagagtga

SEQ ID NO: 10428 - DNA, 20 bp, Artificial Sequence
  Description of Artificial Sequence: Synthetic oligonucleotide
  Target: DMPK; (-) strand; PAM type: NRG; PAM sequence: AGG
cctctcagatccttagagtg

SEQ ID NO: 10429 - DNA, 20 bp, Artificial Sequence
  Description of Artificial Sequence: Synthetic oligonucleotide
  Target: DMPK; (-) strand; PAM type: NRG; PAM sequence: GAG
acctctcagatccttagagt

SEQ ID NO: 10430 - DNA, 20 bp, Artificial Sequence
  Description of Artificial Sequence: Synthetic oligonucleotide
  Target: DMPK; (-) strand; PAM type: NRG; PAM sequence: GAG
caagacctctcagatcctta

SEQ ID NO: 10431 - DNA, 20 bp, Artificial Sequence
  Description of Artificial Sequence: Synthetic oligonucleotide
  Target: DMPK; (-) strand; PAM type: NRG; PAM sequence: TAG
tacaagacctctcagatcct

SEQ ID NO: 10432 - DNA, 20 bp, Artificial Sequence
  Description of Artificial Sequence: Synthetic oligonucleotide
  Target: DMPK; (-) strand; PAM type: NRG; PAM sequence: CAG
tgtctcagtacaagacctct

SEQ ID NO: 10433 - DNA, 20 bp, Artificial Sequence
  Description of Artificial Sequence: Synthetic oligonucleotide
  Target: DMPK; (-) strand; PAM type: NRG; PAM sequence: AAG
aaatcttagtgtctcagtac

SEQ ID NO: 10434 - DNA, 20 bp, Artificial Sequence
  Description of Artificial Sequence: Synthetic oligonucleotide
  Target: DMPK; (-) strand; PAM type: NRG; PAM sequence: CAG
ccagggaaatcttagtgtct

SEQ ID NO: 10435 - DNA, 20 bp, Artificial Sequence
  Description of Artificial Sequence: Synthetic oligonucleotide
  Target: DMPK; (-) strand; PAM type: NRG; PAM sequence: TAG
aggggaagccagggaaatct

SEQ ID NO: 10436 - DNA, 20 bp, Artificial Sequence
  Description of Artificial Sequence: Synthetic oligonucleotide
  Target: DMPK; (-) strand; PAM type: NRG; PAM sequence: GGG
cgtggggtgaggggaagcca

SEQ ID NO: 10437 - DNA, 20 bp, Artificial Sequence
  Description of Artificial Sequence: Synthetic oligonucleotide
  Target: DMPK; (-) strand; PAM type: NRG; PAM sequence: AGG
ccgtggggtgaggggaagcc

SEQ ID NO: 10438 - DNA, 20 bp, Artificial Sequence
  Description of Artificial Sequence: Synthetic oligonucleotide
  Target: DMPK; (-) strand; PAM type: NRG; PAM sequence: CAG
tccgtggggtgaggggaagc

SEQ ID NO: 10439 - DNA, 20 bp, Artificial Sequence
  Description of Artificial Sequence: Synthetic oligonucleotide
  Target: DMPK; (-) strand; PAM type: NRG; PAM sequence: AAG
tggctccgtggggtgagggg

SEQ ID NO: 10440 - DNA, 20 bp, Artificial Sequence
  Description of Artificial Sequence: Synthetic oligonucleotide
  Target: DMPK; (-) strand; PAM type: NRG; PAM sequence: GGG
ctctggctccgtggggtgag

SEQ ID NO: 10441 - DNA, 20 bp, Artificial Sequence
  Description of Artificial Sequence: Synthetic oligonucleotide
  Target: DMPK; (-) strand; PAM type: NRG; PAM sequence: GGG
cctctggctccgtggggtga

SEQ ID NO: 10442 - DNA, 20 bp, Artificial Sequence
  Description of Artificial Sequence: Synthetic oligonucleotide
  Target: DMPK; (-) strand; PAM type: NRG; PAM sequence: AGG
gcctctggctccgtggggtg

SEQ ID NO: 10443 - DNA, 20 bp, Artificial Sequence
  Description of Artificial Sequence: Synthetic oligonucleotide
  Target: DMPK; (-) strand; PAM type: NRG; PAM sequence: GAG
agcctctggctccgtggggt

SEQ ID NO: 10444 - DNA, 20 bp, Artificial Sequence
  Description of Artificial Sequence: Synthetic oligonucleotide
  Target: DMPK; (-) strand; PAM type: NRG; PAM sequence: GGG
tcacagcctctggctccgtg

SEQ ID NO: 10445 - DNA, 20 bp, Artificial Sequence
  Description of Artificial Sequence: Synthetic oligonucleotide
  Target: DMPK; (-) strand; PAM type: NRG; PAM sequence: GGG
gtcacagcctctggctccgt

SEQ ID NO: 10446 - DNA, 20 bp, Artificial Sequence
  Description of Artificial Sequence: Synthetic oligonucleotide
  Target: DMPK; (-) strand; PAM type: NRG; PAM sequence: TGG
tgtcacagcctctggctccg

SEQ ID NO: 10447 - DNA, 20 bp, Artificial Sequence
  Description of Artificial Sequence: Synthetic oligonucleotide
  Target: DMPK; (-) strand; PAM type: NRG; PAM sequence: TGG
tttgttgctgtcacagcctc

SEQ ID NO: 10448 - DNA, 20 bp, Artificial Sequence
  Description of Artificial Sequence: Synthetic oligonucleotide
  Target: DMPK; (-) strand; PAM type: NRG; PAM sequence: CAG
agagggctttgttgctgtca

SEQ ID NO: 10449 - DNA, 20 bp, Artificial Sequence
  Description of Artificial Sequence: Synthetic oligonucleotide
  Target: DMPK; (-) strand; PAM type: NRG; PAM sequence: GGG
ggcaggcattggcagagaga

SEQ ID NO: 10450 - DNA, 20 bp, Artificial Sequence
  Description of Artificial Sequence: Synthetic oligonucleotide
  Target: DMPK; (-) strand; PAM type: NRG; PAM sequence: AGG
aggcaggcattggcagagag

SEQ ID NO: 10451 - DNA, 20 bp, Artificial Sequence
  Description of Artificial Sequence: Synthetic oligonucleotide
  Target: DMPK; (-) strand; PAM type: NRG; PAM sequence: GAG
gaggcaggcattggcagaga

SEQ ID NO: 10452 - DNA, 20 bp, Artificial Sequence
  Description of Artificial Sequence: Synthetic oligonucleotide
  Target: DMPK; (-) strand; PAM type: NRG; PAM sequence: GAG
aagaggcaggcattggcaga

SEQ ID NO: 10453 - DNA, 20 bp, Artificial Sequence
  Description of Artificial Sequence: Synthetic oligonucleotide
  Target: DMPK; (-) strand; PAM type: NRG; PAM sequence: GAG
ggaagaggcaggcattggca

SEQ ID NO: 10454 - DNA, 20 bp, Artificial Sequence
  Description of Artificial Sequence: Synthetic oligonucleotide
  Target: DMPK; (-) strand; PAM type: NRG; PAM sequence: CAG
tgggaagaggcaggcattgg

SEQ ID NO: 10455 - DNA, 20 bp, Artificial Sequence
  Description of Artificial Sequence: Synthetic oligonucleotide
  Target: DMPK; (-) strand; PAM type: NRG; PAM sequence: TGG
tcgtgggaagaggcaggcat

SEQ ID NO: 10456 - DNA, 20 bp, Artificial Sequence
  Description of Artificial Sequence: Synthetic oligonucleotide
  Target: DMPK; (-) strand; PAM type: NRG; PAM sequence: AGG
gacctttcgtgggaagaggc

SEQ ID NO: 10457 - DNA, 20 bp, Artificial Sequence
  Description of Artificial Sequence: Synthetic oligonucleotide
  Target: DMPK; (-) strand; PAM type: NRG; PAM sequence: CAG
ggacctttcgtgggaagagg

SEQ ID NO: 10458 - DNA, 20 bp, Artificial Sequence
  Description of Artificial Sequence: Synthetic oligonucleotide
  Target: DMPK; (-) strand; PAM type: NRG; PAM sequence: AGG
gcaggacctttcgtgggaag

SEQ ID NO: 10459 - DNA, 20 bp, Artificial Sequence
  Description of Artificial Sequence: Synthetic oligonucleotide
  Target: DMPK; (-) strand; PAM type: NRG; PAM sequence: GAG
ggcaggacctttcgtgggaa

SEQ ID NO: 10460 - DNA, 20 bp, Artificial Sequence
  Description of Artificial Sequence: Synthetic oligonucleotide
  Target: DMPK; (-) strand; PAM type: NRG; PAM sequence: AAG
ctggcaggacctttcgtggg

SEQ ID NO: 10461 - DNA, 20 bp, Artificial Sequence
  Description of Artificial Sequence: Synthetic oligonucleotide
  Target: DMPK; (-) strand; PAM type: NRG; PAM sequence: GGG
gacctggcaggacctttcgt

SEQ ID NO: 10462 - DNA, 20 bp, Artificial Sequence
  Description of Artificial Sequence: Synthetic oligonucleotide
  Target: DMPK; (-) strand; PAM type: NRG; PAM sequence: TGG
ggacctggcaggacctttcg

SEQ ID NO: 10463 - DNA, 20 bp, Artificial Sequence
  Description of Artificial Sequence: Synthetic oligonucleotide
  Target: DMPK; (-) strand; PAM type: NRG; PAM sequence: AGG
cagcctgccggggacctggc

SEQ ID NO: 10464 - DNA, 20 bp, Artificial Sequence
  Description of Artificial Sequence: Synthetic oligonucleotide
  Target: DMPK; (-) strand; PAM type: NRG; PAM sequence: CAG
ccagcctgccggggacctgg

SEQ ID NO: 10465 - DNA, 20 bp, Artificial Sequence
  Description of Artificial Sequence: Synthetic oligonucleotide
  Target: DMPK; (-) strand; PAM type: NRG; PAM sequence: TGG
acaccagcctgccggggacc

SEQ ID NO: 10466 - DNA, 20 bp, Artificial Sequence
  Description of Artificial Sequence: Synthetic oligonucleotide
  Target: DMPK; (-) strand; PAM type: NRG; PAM sequence: GGG
ggccccacaccagcctgccg

SEQ ID NO: 10467 - DNA, 20 bp, Artificial Sequence
  Description of Artificial Sequence: Synthetic oligonucleotide
  Target: DMPK; (-) strand; PAM type: NRG; PAM sequence: GGG
tggccccacaccagcctgcc

SEQ ID NO: 10468 - DNA, 20 bp, Artificial Sequence
  Description of Artificial Sequence: Synthetic oligonucleotide
  Target: DMPK; (-) strand; PAM type: NRG; PAM sequence: CGG
gtggccccacaccagcctgc

SEQ ID NO: 10469 - DNA, 20 bp, Artificial Sequence
  Description of Artificial Sequence: Synthetic oligonucleotide
  Target: DMPK; (-) strand; PAM type: NRG; PAM sequence: CAG
ggcggtgagtggccccacac

SEQ ID NO: 10470 - DNA, 20 bp, Artificial Sequence
  Description of Artificial Sequence: Synthetic oligonucleotide
  Target: DMPK; (-) strand; PAM type: NRG; PAM sequence: TGG
cggccgggcaaggcggtgag

SEQ ID NO: 10471 - DNA, 20 bp, Artificial Sequence
  Description of Artificial Sequence: Synthetic oligonucleotide
  Target: DMPK; (-) strand; PAM type: NRG; PAM sequence: GAG
gcccggccgggcaaggcggt

SEQ ID NO: 10472 - DNA, 20 bp, Artificial Sequence
  Description of Artificial Sequence: Synthetic oligonucleotide
  Target: DMPK; (-) strand; PAM type: NRG; PAM sequence: CGG
ctgggcccggccgggcaagg

SEQ ID NO: 10473 - DNA, 20 bp, Artificial Sequence
  Description of Artificial Sequence: Synthetic oligonucleotide
  Target: DMPK; (-) strand; PAM type: NRG; PAM sequence: AGG
cacctgggcccggccgggca

SEQ ID NO: 10474 - DNA, 20 bp, Artificial Sequence
  Description of Artificial Sequence: Synthetic oligonucleotide
  Target: DMPK; (-) strand; PAM type: NRG; PAM sequence: AAG
gcacctgggcccggccgggc

SEQ ID NO: 10475 - DNA, 20 bp, Artificial Sequence
  Description of Artificial Sequence: Synthetic oligonucleotide
  Target: DMPK; (-) strand; PAM type: NRG; PAM sequence: GGG
atctgcacctgggcccggcc

SEQ ID NO: 10476 - DNA, 20 bp, Artificial Sequence
  Description of Artificial Sequence: Synthetic oligonucleotide
  Target: DMPK; (-) strand; PAM type: NRG; PAM sequence: CGG
catctgcacctgggcccggc

SEQ ID NO: 10477 - DNA, 20 bp, Artificial Sequence
  Description of Artificial Sequence: Synthetic oligonucleotide
  Target: DMPK; (-) strand; PAM type: NRG; PAM sequence: CGG
gcctcatctgcacctgggcc

SEQ ID NO: 10478 - DNA, 20 bp, Artificial Sequence
  Description of Artificial Sequence: Synthetic oligonucleotide
  Target: DMPK; (-) strand; PAM type: NRG; PAM sequence: GGG
ggagggcctcatctgcacct

SEQ ID NO: 10479 - DNA, 20 bp, Artificial Sequence
  Description of Artificial Sequence: Synthetic oligonucleotide
  Target: DMPK; (-) strand; PAM type: NRG; PAM sequence: TGG
aggagggcctcatctgcacc

SEQ ID NO: 10480 - DNA, 20 bp, Artificial Sequence
  Description of Artificial Sequence: Synthetic oligonucleotide
  Target: DMPK; (-) strand; PAM type: NRG; PAM sequence: GGG
atcatcactgcctgccagga

SEQ ID NO: 10481 - DNA, 20 bp, Artificial Sequence
  Description of Artificial Sequence: Synthetic oligonucleotide
  Target: DMPK; (-) strand; PAM type: NRG; PAM sequence: AGG
catcatcactgcctgccagg

SEQ ID NO: 10482 - DNA, 20 bp, Artificial Sequence
  Description of Artificial Sequence: Synthetic oligonucleotide
  Target: DMPK; (-) strand; PAM type: NRG; PAM sequence: GAG
gcatcatcactgcctgccag

SEQ ID NO: 10483 - DNA, 20 bp, Artificial Sequence
  Description of Artificial Sequence: Synthetic oligonucleotide
  Target: DMPK; (-) strand; PAM type: NRG; PAM sequence: AGG
ctgcatcatcactgcctgcc

SEQ ID NO: 10484 - DNA, 20 bp, Artificial Sequence
  Description of Artificial Sequence: Synthetic oligonucleotide
  Target: DMPK; (-) strand; PAM type: NRG; PAM sequence: CAG
actgcatcatcactgcctgc

SEQ ID NO: 10485 - DNA, 20 bp, Artificial Sequence
  Description of Artificial Sequence: Synthetic oligonucleotide
  Target: DMPK; (-) strand; PAM type: NRG; PAM sequence: AGG
cacagtcctcctgttcctgg

SEQ ID NO: 10486 - DNA, 20 bp, Artificial Sequence
  Description of Artificial Sequence: Synthetic oligonucleotide
  Target: DMPK; (-) strand; PAM type: NRG; PAM sequence: GAG
tcacagtcctcctgttcctg

SEQ ID NO: 10487 - DNA, 20 bp, Artificial Sequence
  Description of Artificial Sequence: Synthetic oligonucleotide
  Target: DMPK; (-) strand; PAM type: NRG; PAM sequence: TGG
gctcacagtcctcctgttcc

SEQ ID NO: 10488 - DNA, 20 bp, Artificial Sequence
  Description of Artificial Sequence: Synthetic oligonucleotide
  Target: DMPK; (-) strand; PAM type: NRG; PAM sequence: CAG
gatcgcccaggagcggctca

SEQ ID NO: 10489 - DNA, 20 bp, Artificial Sequence
  Description of Artificial Sequence: Synthetic oligonucleotide
  Target: DMPK; (-) strand; PAM type: NRG; PAM sequence: CGG
gcaagaagatcgcccaggag

SEQ ID NO: 10490 - DNA, 20 bp, Artificial Sequence
  Description of Artificial Sequence: Synthetic oligonucleotide
  Target: DMPK; (-) strand; PAM type: NRG; PAM sequence: GAG
tgtgcaagaagatcgcccag

SEQ ID NO: 10491 - DNA, 20 bp, Artificial Sequence
  Description of Artificial Sequence: Synthetic oligonucleotide
  Target: DMPK; (-) strand; PAM type: NRG; PAM sequence: AGG
tgtgtgcaagaagatcgccc

SEQ ID NO: 10492 - DNA, 20 bp, Artificial Sequence
  Description of Artificial Sequence: Synthetic oligonucleotide
  Target: DMPK; (-) strand; PAM type: NRG; PAM sequence: CAG
ttgtgtgcaagaagatcgcc

SEQ ID NO: 10493 - DNA, 20 bp, Artificial Sequence
  Description of Artificial Sequence: Synthetic oligonucleotide
  Target: DMPK; (-) strand; PAM type: NRG; PAM sequence: AAG
tggagccccttgtgtgcaag

SEQ ID NO: 10494 - DNA, 20 bp, Artificial Sequence
  Description of Artificial Sequence: Synthetic oligonucleotide
  Target: DMPK; (-) strand; PAM type: NRG; PAM sequence: AAG
tgctggagccccttgtgtgc

SEQ ID NO: 10495 - DNA, 20 bp, Artificial Sequence
  Description of Artificial Sequence: Synthetic oligonucleotide
  Target: DMPK; (-) strand; PAM type: NRG; PAM sequence: GAG
tccacgaggtgcccctgctg

SEQ ID NO: 10496 - DNA, 20 bp, Artificial Sequence
  Description of Artificial Sequence: Synthetic oligonucleotide
  Target: DMPK; (-) strand; PAM type: NRG; PAM sequence: TGG
catccacgaggtgcccctgc

SEQ ID NO: 10497 - DNA, 20 bp, Artificial Sequence
  Description of Artificial Sequence: Synthetic oligonucleotide
  Target: DMPK; (-) strand; PAM type: NRG; PAM sequence: AGG
gctgtgcccgcgcatccacg

SEQ ID NO: 10498 - DNA, 20 bp, Artificial Sequence
  Description of Artificial Sequence: Synthetic oligonucleotide
  Target: DMPK; (-) strand; PAM type: NRG; PAM sequence: GAG
cgctgtgcccgcgcatccac

SEQ ID NO: 10499 - DNA, 20 bp, Artificial Sequence
  Description of Artificial Sequence: Synthetic oligonucleotide
  Target: DMPK; (-) strand; PAM type: NRG; PAM sequence: GGG
ctggaccccgccaaggtgct

SEQ ID NO: 10500 - DNA, 20 bp, Artificial Sequence
  Description of Artificial Sequence: Synthetic oligonucleotide
  Target: DMPK; (-) strand; PAM type: NRG; PAM sequence: TGG
cctggaccccgccaaggtgc

SEQ ID NO: 10501 - DNA, 20 bp, Artificial Sequence
  Description of Artificial Sequence: Synthetic oligonucleotide
  Target: DMPK; (-) strand; PAM type: NRG; PAM sequence: AGG
cagccgcctggaccccgcca

SEQ ID NO: 10502 - DNA, 20 bp, Artificial Sequence
  Description of Artificial Sequence: Synthetic oligonucleotide
  Target: DMPK; (-) strand; PAM type: NRG; PAM sequence: AAG
gcagccgcctggaccccgcc

SEQ ID NO: 10503 - DNA, 20 bp, Artificial Sequence
  Description of Artificial Sequence: Synthetic oligonucleotide
  Target: DMPK; (-) strand; PAM type: NRG; PAM sequence: TGG
ccctgttccccgcagccgcc

SEQ ID NO: 10504 - DNA, 20 bp, Artificial Sequence
  Description of Artificial Sequence: Synthetic oligonucleotide
  Target: DMPK; (-) strand; PAM type: NRG; PAM sequence: CAG
cccagcggccctgttccccg

SEQ ID NO: 10505 - DNA, 20 bp, Artificial Sequence
  Description of Artificial Sequence: Synthetic oligonucleotide
  Target: DMPK; (-) strand; PAM type: NRG; PAM sequence: CGG
agtggtggggagaagcccag

SEQ ID NO: 10506 - DNA, 20 bp, Artificial Sequence
  Description of Artificial Sequence: Synthetic oligonucleotide
  Target: DMPK; (-) strand; PAM type: NRG; PAM sequence: CAG
ggcagtggtggggagaagcc

SEQ ID NO: 10507 - DNA, 20 bp, Artificial Sequence
  Description of Artificial Sequence: Synthetic oligonucleotide
  Target: DMPK; (-) strand; PAM type: NRG; PAM sequence: AAG
gcagtggcagtggtggggag

SEQ ID NO: 10508 - DNA, 20 bp, Artificial Sequence
  Description of Artificial Sequence: Synthetic oligonucleotide
  Target: DMPK; (-) strand; PAM type: NRG; PAM sequence: GAG
gcggcagtggcagtggtggg

SEQ ID NO: 10509 - DNA, 20 bp, Artificial Sequence
  Description of Artificial Sequence: Synthetic oligonucleotide
  Target: DMPK; (-) strand; PAM type: NRG; PAM sequence: GGG
tggcggcagtggcagtggtg

SEQ ID NO: 10510 - DNA, 20 bp, Artificial Sequence
  Description of Artificial Sequence: Synthetic oligonucleotide
  Target: DMPK; (-) strand; PAM type: NRG; PAM sequence: GGG
gtggcggcagtggcagtggt

SEQ ID NO: 10511 - DNA, 20 bp, Artificial Sequence
  Description of Artificial Sequence: Synthetic oligonucleotide
  Target: DMPK; (-) strand; PAM type: NRG; PAM sequence: TGG
agtggcggcagtggcagtgg

SEQ ID NO: 10512 - DNA, 20 bp, Artificial Sequence
  Description of Artificial Sequence: Synthetic oligonucleotide
  Target: DMPK; (-) strand; PAM type: NRG; PAM sequence: TGG
ggcagtggcggcagtggcag

SEQ ID NO: 10513 - DNA, 20 bp, Artificial Sequence
  Description of Artificial Sequence: Synthetic oligonucleotide
  Target: DMPK; (-) strand; PAM type: NRG; PAM sequence: CAG
ggtggcagtggcggcagtgg

SEQ ID NO: 10514 - DNA, 20 bp, Artificial Sequence
  Description of Artificial Sequence: Synthetic oligonucleotide
  Target: DMPK; (-) strand; PAM type: NRG; PAM sequence: TGG
cggggtggcagtggcggcag

SEQ ID NO: 10515 - DNA, 20 bp, Artificial Sequence
  Description of Artificial Sequence: Synthetic oligonucleotide
  Target: DMPK; (-) strand; PAM type: NRG; PAM sequence: CAG
agccggggtggcagtggcgg

SEQ ID NO: 10516 - DNA, 20 bp, Artificial Sequence
  Description of Artificial Sequence: Synthetic oligonucleotide
  Target: DMPK; (-) strand; PAM type: NRG; PAM sequence: CGG
atcagccggggtggcagtgg

SEQ ID NO: 10517 - DNA, 20 bp, Artificial Sequence
  Description of Artificial Sequence: Synthetic oligonucleotide
  Target: DMPK; (-) strand; PAM type: NRG; PAM sequence: TGG
aacatcagccggggtggcag

SEQ ID NO: 10518 - DNA, 20 bp, Artificial Sequence
  Description of Artificial Sequence: Synthetic oligonucleotide
  Target: DMPK; (-) strand; PAM type: NRG; PAM sequence: CAG
ggcaacatcagccggggtgg

SEQ ID NO: 10519 - DNA, 20 bp, Artificial Sequence
  Description of Artificial Sequence: Synthetic oligonucleotide
  Target: DMPK; (-) strand; PAM type: NRG; PAM sequence: TGG
ctgggcaacatcagccgggg

SEQ ID NO: 10520 - DNA, 20 bp, Artificial Sequence
  Description of Artificial Sequence: Synthetic oligonucleotide
  Target: DMPK; (-) strand; PAM type: NRG; PAM sequence: GGG
agcctgggcaacatcagccg

SEQ ID NO: 10521 - DNA, 20 bp, Artificial Sequence
  Description of Artificial Sequence: Synthetic oligonucleotide
  Target: DMPK; (-) strand; PAM type: NRG; PAM sequence: GGG
cagcctgggcaacatcagcc

SEQ ID NO: 10522 - DNA, 20 bp, Artificial Sequence
  Description of Artificial Sequence: Synthetic oligonucleotide
  Target: DMPK; (-) strand; PAM type: NRG; PAM sequence: CGG
acagcctgggcaacatcagc

SEQ ID NO: 10523 - DNA, 20 bp, Artificial Sequence
  Description of Artificial Sequence: Synthetic oligonucleotide
  Target: DMPK; (-) strand; PAM type: NRG; PAM sequence: CAG
taccacagcctgggcaacat

SEQ ID NO: 10524 - DNA, 20 bp, Artificial Sequence
  Description of Artificial Sequence: Synthetic oligonucleotide
  Target: DMPK; (-) strand; PAM type: NRG; PAM sequence: GGG
cacaagcgctaccacagcct

SEQ ID NO: 10525 - DNA, 20 bp, Artificial Sequence
  Description of Artificial Sequence: Synthetic oligonucleotide
  Target: DMPK; (-) strand; PAM type: NRG; PAM sequence: TGG
gcacaagcgctaccacagcc

SEQ ID NO: 10526 - DNA, 20 bp, Artificial Sequence
  Description of Artificial Sequence: Synthetic oligonucleotide
  Target: DMPK; (-) strand; PAM type: NRG; PAM sequence: CAG
aaggagcacaagcgctacca

SEQ ID NO: 10527 - DNA, 20 bp, Artificial Sequence
  Description of Artificial Sequence: Synthetic oligonucleotide
  Target: DMPK; (-) strand; PAM type: NRG; PAM sequence: AAG
ggggggcagagaaggagcac

SEQ ID NO: 10528 - DNA, 20 bp, Artificial Sequence
  Description of Artificial Sequence: Synthetic oligonucleotide
  Target: DMPK; (-) strand; PAM type: NRG; PAM sequence: GAG
gggaccggggggcagagaag

SEQ ID NO: 10529 - DNA, 20 bp, Artificial Sequence
  Description of Artificial Sequence: Synthetic oligonucleotide
  Target: DMPK; (-) strand; PAM type: NRG; PAM sequence: AGG
gcgggaccggggggcagaga

SEQ ID NO: 10530 - DNA, 20 bp, Artificial Sequence
  Description of Artificial Sequence: Synthetic oligonucleotide
  Target: DMPK; (-) strand; PAM type: NRG; PAM sequence: AAG
ggcgggaccggggggcagag

SEQ ID NO: 10531 - DNA, 20 bp, Artificial Sequence
  Description of Artificial Sequence: Synthetic oligonucleotide
  Target: DMPK; (-) strand; PAM type: NRG; PAM sequence: GAG
agcggcgggaccggggggca

SEQ ID NO: 10532 - DNA, 20 bp, Artificial Sequence
  Description of Artificial Sequence: Synthetic oligonucleotide
  Target: DMPK; (-) strand; PAM type: NRG; PAM sequence: CAG
ggagcggcgggaccgggggg

SEQ ID NO: 10533 - DNA, 20 bp, Artificial Sequence
  Description of Artificial Sequence: Synthetic oligonucleotide
  Target: DMPK; (-) strand; PAM type: NRG; PAM sequence: GGG
gcaggagcggcgggaccggg

SEQ ID NO: 10534 - DNA, 20 bp, Artificial Sequence
  Description of Artificial Sequence: Synthetic oligonucleotide
  Target: DMPK; (-) strand; PAM type: NRG; PAM sequence: GGG
tgcaggagcggcgggaccgg

SEQ ID NO: 10535 - DNA, 20 bp, Artificial Sequence
  Description of Artificial Sequence: Synthetic oligonucleotide
  Target: DMPK; (-) strand; PAM type: NRG; PAM sequence: GGG
ctgcaggagcggcgggaccg

SEQ ID NO: 10536 - DNA, 20 bp, Artificial Sequence
  Description of Artificial Sequence: Synthetic oligonucleotide
  Target: DMPK; (-) strand; PAM type: NRG; PAM sequence: GGG
actgcaggagcggcgggacc

SEQ ID NO: 10537 - DNA, 20 bp, Artificial Sequence
  Description of Artificial Sequence: Synthetic oligonucleotide
  Target: DMPK; (-) strand; PAM type: NRG; PAM sequence: CGG
cactgcaggagcggcgggac

SEQ ID NO: 10538 - DNA, 20 bp, Artificial Sequence
  Description of Artificial Sequence: Synthetic oligonucleotide
  Target: DMPK; (-) strand; PAM type: NRG; PAM sequence: GGG
gctcacactgcaggagcggc

SEQ ID NO: 10539 - DNA, 20 bp, Artificial Sequence
  Description of Artificial Sequence: Synthetic oligonucleotide
  Target: DMPK; (-) strand; PAM type: NRG; PAM sequence: CGG
cgctcacactgcaggagcgg

SEQ ID NO: 10540 - DNA, 20 bp, Artificial Sequence
  Description of Artificial Sequence: Synthetic oligonucleotide
  Target: DMPK; (-) strand; PAM type: NRG; PAM sequence: CGG
ccacgctcacactgcaggag

SEQ ID NO: 10541 - DNA, 20 bp, Artificial Sequence
  Description of Artificial Sequence: Synthetic oligonucleotide
  Target: DMPK; (-) strand; PAM type: NRG; PAM sequence: GAG
tcgccacgctcacactgcag

SEQ ID NO: 10542 - DNA, 20 bp, Artificial Sequence
  Description of Artificial Sequence: Synthetic oligonucleotide
  Target: DMPK; (-) strand; PAM type: NRG; PAM sequence: AGG
cttcgccacgctcacactgc

SEQ ID NO: 10543 - DNA, 20 bp, Artificial Sequence
  Description of Artificial Sequence: Synthetic oligonucleotide
  Target: DMPK; (-) strand; PAM type: NRG; PAM sequence: CAG
gcttcgccacgctcacactg

SEQ ID NO: 10544 - DNA, 20 bp, Artificial Sequence
  Description of Artificial Sequence: Synthetic oligonucleotide
  Target: DMPK; (-) strand; PAM type: NRG; PAM sequence: TGG
cctggcacaccattcagcat

SEQ ID NO: 10545 - DNA, 20 bp, Artificial Sequence
  Description of Artificial Sequence: Synthetic oligonucleotide
  Target: DMPK; (-) strand; PAM type: NRG; PAM sequence: CAG
gcagagcctggcacaccatt

SEQ ID NO: 10546 - DNA, 20 bp, Artificial Sequence
  Description of Artificial Sequence: Synthetic oligonucleotide
  Target: DMPK; (-) strand; PAM type: NRG; PAM sequence: TGG
ccgggtgtggcggcagagcc

SEQ ID NO: 10547 - DNA, 20 bp, Artificial Sequence
  Description of Artificial Sequence: Synthetic oligonucleotide
  Target: DMPK; (-) strand; PAM type: NRG; PAM sequence: GAG
gcggcccgggtgtggcggca

SEQ ID NO: 10548 - DNA, 20 bp, Artificial Sequence
  Description of Artificial Sequence: Synthetic oligonucleotide
  Target: DMPK; (-) strand; PAM type: NRG; PAM sequence: CAG
gggcggcccgggtgtggcgg

SEQ ID NO: 10549 - DNA, 20 bp, Artificial Sequence
  Description of Artificial Sequence: Synthetic oligonucleotide
  Target: DMPK; (-) strand; PAM type: NRG; PAM sequence: CGG
ggcgggcggcccgggtgtgg

SEQ ID NO: 10550 - DNA, 20 bp, Artificial Sequence
  Description of Artificial Sequence: Synthetic oligonucleotide
  Target: DMPK; (-) strand; PAM type: NRG; PAM sequence: TGG
caaggcgggcggcccgggtg

SEQ ID NO: 10551 - DNA, 20 bp, Artificial Sequence
  Description of Artificial Sequence: Synthetic oligonucleotide
  Target: DMPK; (-) strand; PAM type: NRG; PAM sequence: GGG
gggggcaaggcgggcggccc

SEQ ID NO: 10552 - DNA, 20 bp, Artificial Sequence
  Description of Artificial Sequence: Synthetic oligonucleotide
  Target: DMPK; (-) strand; PAM type: NRG; PAM sequence: CGG
cgggggcaaggcgggcggcc

SEQ ID NO: 10553 - DNA, 20 bp, Artificial Sequence
  Description of Artificial Sequence: Synthetic oligonucleotide
  Target: DMPK; (-) strand; PAM type: NRG; PAM sequence: CGG
gctggcgggggcaaggcggg

SEQ ID NO: 10554 - DNA, 20 bp, Artificial Sequence
  Description of Artificial Sequence: Synthetic oligonucleotide
  Target: DMPK; (-) strand; PAM type: NRG; PAM sequence: GGG
ccagctggcgggggcaaggc

SEQ ID NO: 10555 - DNA, 20 bp, Artificial Sequence
  Description of Artificial Sequence: Synthetic oligonucleotide
  Target: DMPK; (-) strand; PAM type: NRG; PAM sequence: CGG
cccagctggcgggggcaagg

SEQ ID NO: 10556 - DNA, 20 bp, Artificial Sequence
  Description of Artificial Sequence: Synthetic oligonucleotide
  Target: DMPK; (-) strand; PAM type: NRG; PAM sequence: AGG
gcacccagctggcgggggca

SEQ ID NO: 10557 - DNA, 20 bp, Artificial Sequence
  Description of Artificial Sequence: Synthetic oligonucleotide
  Target: DMPK; (-) strand; PAM type: NRG; PAM sequence: AAG
cgcacccagctggcgggggc

SEQ ID NO: 10558 - DNA, 20 bp, Artificial Sequence
  Description of Artificial Sequence: Synthetic oligonucleotide
  Target: DMPK; (-) strand; PAM type: NRG; PAM sequence: GGG
ctcccgcacccagctggcgg

SEQ ID NO: 10559 - DNA, 20 bp, Artificial Sequence
  Description of Artificial Sequence: Synthetic oligonucleotide
  Target: DMPK; (-) strand; PAM type: NRG; PAM sequence: GGG
tctcccgcacccagctggcg

SEQ ID NO: 10560 - DNA, 20 bp, Artificial Sequence
  Description of Artificial Sequence: Synthetic oligonucleotide
  Target: DMPK; (-) strand; PAM type: NRG; PAM sequence: GGG
gtctcccgcacccagctggc

SEQ ID NO: 10561 - DNA, 20 bp, Artificial Sequence
  Description of Artificial Sequence: Synthetic oligonucleotide
  Target: DMPK; (-) strand; PAM type: NRG; PAM sequence: CGG
agtctcccgcacccagctgg

SEQ ID NO: 10562 - DNA, 20 bp, Artificial Sequence
  Description of Artificial Sequence: Synthetic oligonucleotide
  Target: DMPK; (-) strand; PAM type: NRG; PAM sequence: TGG
aacagtctcccgcacccagc

SEQ ID NO: 10563 - DNA, 20 bp, Artificial Sequence
  Description of Artificial Sequence: Synthetic oligonucleotide
  Target: DMPK; (-) strand; PAM type: NRG; PAM sequence: CAG
ctccaacagtctcccgcacc

SEQ ID NO: 10564 - DNA, 20 bp, Artificial Sequence
  Description of Artificial Sequence: Synthetic oligonucleotide
  Target: DMPK; (-) strand; PAM type: NRG; PAM sequence: CAG
cgctcgctgtcccgctccaa

SEQ ID NO: 10565 - DNA, 20 bp, Artificial Sequence
  Description of Artificial Sequence: Synthetic oligonucleotide
  Target: DMPK; (-) strand; PAM type: NRG; PAM sequence: AGG
aggggtggcgagcctggccc

SEQ ID NO: 10566 - DNA, 20 bp, Artificial Sequence
  Description of Artificial Sequence: Synthetic oligonucleotide
  Target: DMPK; (-) strand; PAM type: NRG; PAM sequence: CAG
gaggggtggcgagcctggcc

SEQ ID NO: 10567 - DNA, 20 bp, Artificial Sequence
  Description of Artificial Sequence: Synthetic oligonucleotide
  Target: DMPK; (-) strand; PAM type: NRG; PAM sequence: TGG
agctcgaggggtggcgagcc

SEQ ID NO: 10568 - DNA, 20 bp, Artificial Sequence
  Description of Artificial Sequence: Synthetic oligonucleotide
  Target: DMPK; (-) strand; PAM type: NRG; PAM sequence: GAG
ccagcagctcgaggggtggc

SEQ ID NO: 10569 - DNA, 20 bp, Artificial Sequence
  Description of Artificial Sequence: Synthetic oligonucleotide
  Target: DMPK; (-) strand; PAM type: NRG; PAM sequence: TGG
gccgccagcagctcgagggg

SEQ ID NO: 10570 - DNA, 20 bp, Artificial Sequence
  Description of Artificial Sequence: Synthetic oligonucleotide
  Target: DMPK; (-) strand; PAM type: NRG; PAM sequence: GGG
ccggccgccagcagctcgag

SEQ ID NO: 10571 - DNA, 20 bp, Artificial Sequence
  Description of Artificial Sequence: Synthetic oligonucleotide
  Target: DMPK; (-) strand; PAM type: NRG; PAM sequence: GGG
accggccgccagcagctcga

SEQ ID NO: 10572 - DNA, 20 bp, Artificial Sequence
  Description of Artificial Sequence: Synthetic oligonucleotide
  Target: DMPK; (-) strand; PAM type: NRG; PAM sequence: AGG
caccggccgccagcagctcg

SEQ ID NO: 10573 - DNA, 20 bp, Artificial Sequence
  Description of Artificial Sequence: Synthetic oligonucleotide
  Target: DMPK; (-) strand; PAM type: NRG; PAM sequence: GAG
ccaccggccgccagcagctc

SEQ ID NO: 10574 - DNA, 20 bp, Artificial Sequence
  Description of Artificial Sequence: Synthetic oligonucleotide
  Target: DMPK; (-) strand; PAM type: NRG; PAM sequence: CAG
accacgccaccggccgccag

SEQ ID NO: 10575 - DNA, 20 bp, Artificial Sequence
  Description of Artificial Sequence: Synthetic oligonucleotide
  Target: DMPK; (-) strand; PAM type: NRG; PAM sequence: CAG
ggcaccacgccaccggccgc

SEQ ID NO: 10576 - DNA, 20 bp, Artificial Sequence
  Description of Artificial Sequence: Synthetic oligonucleotide
  Target: DMPK; (-) strand; PAM type: NRG; PAM sequence: CGG
cacacctggcaccacgccac

SEQ ID NO: 10577 - DNA, 20 bp, Artificial Sequence
  Description of Artificial Sequence: Synthetic oligonucleotide
  Target: DMPK; (-) strand; PAM type: NRG; PAM sequence: TGG
cgcaccctccctggcacacc

SEQ ID NO: 10578 - DNA, 20 bp, Artificial Sequence
  Description of Artificial Sequence: Synthetic oligonucleotide
  Target: DMPK; (-) strand; PAM type: NRG; PAM sequence: TGG
gcccgcacccgcaccctccc

SEQ ID NO: 10579 - DNA, 20 bp, Artificial Sequence
  Description of Artificial Sequence: Synthetic oligonucleotide
  Target: DMPK; (-) strand; PAM type: NRG; PAM sequence: TGG
gctctacccgcacccccccc

SEQ ID NO: 10580 - DNA, 20 bp, Artificial Sequence
  Description of Artificial Sequence: Synthetic oligonucleotide
  Target: DMPK; (-) strand; PAM type: NRG; PAM sequence: AAG
ctgcctgtgggacctcactg

SEQ ID NO: 10581 - DNA, 20 bp, Artificial Sequence
  Description of Artificial Sequence: Synthetic oligonucleotide
  Target: DMPK; (-) strand; PAM type: NRG; PAM sequence: GGG
ggacacgcagttctgcctgt

SEQ ID NO: 10582 - DNA, 20 bp, Artificial Sequence
  Description of Artificial Sequence: Synthetic oligonucleotide
  Target: DMPK; (-) strand; PAM type: NRG; PAM sequence: TGG
aggacacgcagttctgcctg

SEQ ID NO: 10583 - DNA, 20 bp, Artificial Sequence
  Description of Artificial Sequence: Synthetic oligonucleotide
  Target: DMPK; (-) strand; PAM type: NRG; PAM sequence: CAG
gctcggcgggccaggacacg

SEQ ID NO: 10584 - DNA, 20 bp, Artificial Sequence
  Description of Artificial Sequence: Synthetic oligonucleotide
  Target: DMPK; (-) strand; PAM type: NRG; PAM sequence: AGG
ccgctttggctcggcgggcc

SEQ ID NO: 10585 - DNA, 20 bp, Artificial Sequence
  Description of Artificial Sequence: Synthetic oligonucleotide
  Target: DMPK; (-) strand; PAM type: NRG; PAM sequence: CAG
accgctttggctcggcgggc

SEQ ID NO: 10586 - DNA, 20 bp, Artificial Sequence
  Description of Artificial Sequence: Synthetic oligonucleotide
  Target: DMPK; (-) strand; PAM type: NRG; PAM sequence: GGG
acttaccgctttggctcggc

SEQ ID NO: 10587 - DNA, 20 bp, Artificial Sequence
  Description of Artificial Sequence: Synthetic oligonucleotide
  Target: DMPK; (-) strand; PAM type: NRG; PAM sequence: CGG
tacttaccgctttggctcgg

SEQ ID NO: 10588 - DNA, 20 bp, Artificial Sequence
  Description of Artificial Sequence: Synthetic oligonucleotide
  Target: DMPK; (-) strand; PAM type: NRG; PAM sequence: CGG
cattacttaccgctttggct

SEQ ID NO: 10589 - DNA, 20 bp, Artificial Sequence
  Description of Artificial Sequence: Synthetic oligonucleotide
  Target: DMPK; (-) strand; PAM type: NRG; PAM sequence: TGG
ggctccattacttaccgctt

SEQ ID NO: 10590 - DNA, 20 bp, Artificial Sequence
  Description of Artificial Sequence: Synthetic oligonucleotide
  Target: DMPK; (-) strand; PAM type: NRG; PAM sequence: TGG
ctctctccactgcccaaggc

SEQ ID NO: 10591 - DNA, 20 bp, Artificial Sequence
  Description of Artificial Sequence: Synthetic oligonucleotide
  Target: DMPK; (-) strand; PAM type: NRG; PAM sequence: AGG
cccgctctctccactgccca

SEQ ID NO: 10592 - DNA, 20 bp, Artificial Sequence
  Description of Artificial Sequence: Synthetic oligonucleotide
  Target: DMPK; (-) strand; PAM type: NRG; PAM sequence: AAG
ccccgctctctccactgccc

SEQ ID NO: 10593 - DNA, 20 bp, Artificial Sequence
  Description of Artificial Sequence: Synthetic oligonucleotide
  Target: DMPK; (-) strand; PAM type: NRG; PAM sequence: GGG
gcgggcacaggctcggccgg

SEQ ID NO: 10594 - DNA, 20 bp, Artificial Sequence
  Description of Artificial Sequence: Synthetic oligonucleotide
  Target: DMPK; (-) strand; PAM type: NRG; PAM sequence: GGG
tgcgggcacaggctcggccg

SEQ ID NO: 10595 - DNA, 20 bp, Artificial Sequence
  Description of Artificial Sequence: Synthetic oligonucleotide
  Target: DMPK; (-) strand; PAM type: NRG; PAM sequence: GGG
ctgcgggcacaggctcggcc

SEQ ID NO: 10596 - DNA, 20 bp, Artificial Sequence
  Description of Artificial Sequence: Synthetic oligonucleotide
  Target: DMPK; (-) strand; PAM type: NRG; PAM sequence: CGG
gctgcgggcacaggctcggc

SEQ ID NO: 10597 - DNA, 20 bp, Artificial Sequence
  Description of Artificial Sequence: Synthetic oligonucleotide
  Target: DMPK; (-) strand; PAM type: NRG; PAM sequence: CGG
cgaggctgcgggcacaggct

SEQ ID NO: 10598 - DNA, 20 bp, Artificial Sequence
  Description of Artificial Sequence: Synthetic oligonucleotide
  Target: DMPK; (-) strand; PAM type: NRG; PAM sequence: AGG
gagcccgaggctgcgggcac

SEQ ID NO: 10599 - DNA, 20 bp, Artificial Sequence
  Description of Artificial Sequence: Synthetic oligonucleotide
  Target: DMPK; (-) strand; PAM type: NRG; PAM sequence: CAG
ggagcccgaggctgcgggca

SEQ ID NO: 10600 - DNA, 20 bp, Artificial Sequence
  Description of Artificial Sequence: Synthetic oligonucleotide
  Target: DMPK; (-) strand; PAM type: NRG; PAM sequence: GGG
gaggaggagcccgaggctgc

SEQ ID NO: 10601 - DNA, 20 bp, Artificial Sequence
  Description of Artificial Sequence: Synthetic oligonucleotide
  Target: DMPK; (-) strand; PAM type: NRG; PAM sequence: CGG
ggaggaggagcccgaggctg

SEQ ID NO: 10602 - DNA, 20 bp, Artificial Sequence
  Description of Artificial Sequence: Synthetic oligonucleotide
  Target: DMPK; (-) strand; PAM type: NRG; PAM sequence: AGG
agaggaggaggaggagcccg

SEQ ID NO: 10603 - DNA, 20 bp, Artificial Sequence
  Description of Artificial Sequence: Synthetic oligonucleotide
  Target: DMPK; (-) strand; PAM type: NRG; PAM sequence: GAG
aagaggaggaggaggagccc

SEQ ID NO: 10604 - DNA, 20 bp, Artificial Sequence
  Description of Artificial Sequence: Synthetic oligonucleotide
  Target: DMPK; (-) strand; PAM type: NRG; PAM sequence: GAG
gcggcgaagaggaggaggag

SEQ ID NO: 10605 - DNA, 20 bp, Artificial Sequence
  Description of Artificial Sequence: Synthetic oligonucleotide
  Target: DMPK; (-) strand; PAM type: NRG; PAM sequence: AGG
gagcggcgaagaggaggagg

SEQ ID NO: 10606 - DNA, 20 bp, Artificial Sequence
  Description of Artificial Sequence: Synthetic oligonucleotide
  Target: DMPK; (-) strand; PAM type: NRG; PAM sequence: GAG
ggagcggcgaagaggaggag

SEQ ID NO: 10607 - DNA, 20 bp, Artificial Sequence
  Description of Artificial Sequence: Synthetic oligonucleotide
  Target: DMPK; (-) strand; PAM type: NRG; PAM sequence: AGG
gcggagcggcgaagaggagg

SEQ ID NO: 10608 - DNA, 20 bp, Artificial Sequence
  Description of Artificial Sequence: Synthetic oligonucleotide
  Target: DMPK; (-) strand; PAM type: NRG; PAM sequence: GAG
agcggagcggcgaagaggag

SEQ ID NO: 10609 - DNA, 20 bp, Artificial Sequence
  Description of Artificial Sequence: Synthetic oligonucleotide
  Target: DMPK; (-) strand; PAM type: NRG; PAM sequence: AGG
ggagcggagcggcgaagagg

SEQ ID NO: 10610 - DNA, 20 bp, Artificial Sequence
  Description of Artificial Sequence: Synthetic oligonucleotide
  Target: DMPK; (-) strand; PAM type: NRG; PAM sequence: GAG
gggagcggagcggcgaagag

SEQ ID NO: 10611 - DNA, 20 bp, Artificial Sequence
  Description of Artificial Sequence: Synthetic oligonucleotide
  Target: DMPK; (-) strand; PAM type: NRG; PAM sequence: AGG
tggggagcggagcggcgaag

SEQ ID NO: 10612 - DNA, 20 bp, Artificial Sequence
  Description of Artificial Sequence: Synthetic oligonucleotide
  Target: DMPK; (-) strand; PAM type: NRG; PAM sequence: GAG
atggggagcggagcggcgaa

SEQ ID NO: 10613 - DNA, 20 bp, Artificial Sequence
  Description of Artificial Sequence: Synthetic oligonucleotide
  Target: DMPK; (-) strand; PAM type: NRG; PAM sequence: AAG
tgatggggagcggagcggcg

SEQ ID NO: 10614 - DNA, 20 bp, Artificial Sequence
  Description of Artificial Sequence: Synthetic oligonucleotide
  Target: DMPK; (-) strand; PAM type: NRG; PAM sequence: CGG
ggtgctgatggggagcggag

SEQ ID NO: 10615 - DNA, 20 bp, Artificial Sequence
  Description of Artificial Sequence: Synthetic oligonucleotide
  Target: DMPK; (-) strand; PAM type: NRG; PAM sequence: GAG
gccggtgctgatggggagcg

SEQ ID NO: 10616 - DNA, 20 bp, Artificial Sequence
  Description of Artificial Sequence: Synthetic oligonucleotide
  Target: DMPK; (-) strand; PAM type: NRG; PAM sequence: CGG
cagccggtgctgatggggag

SEQ ID NO: 10617 - DNA, 20 bp, Artificial Sequence
  Description of Artificial Sequence: Synthetic oligonucleotide
  Target: DMPK; (-) strand; PAM type: NRG; PAM sequence: GAG
cagcagccggtgctgatggg

SEQ ID NO: 10618 - DNA, 20 bp, Artificial Sequence
  Description of Artificial Sequence: Synthetic oligonucleotide
  Target: DMPK; (-) strand; PAM type: NRG; PAM sequence: GGG
gacagcagccggtgctgatg

SEQ ID NO: 10619 - DNA, 20 bp, Artificial Sequence
  Description of Artificial Sequence: Synthetic oligonucleotide
  Target: DMPK; (-) strand; PAM type: NRG; PAM sequence: GGG
cgacagcagccggtgctgat

SEQ ID NO: 10620 - DNA, 20 bp, Artificial Sequence
  Description of Artificial Sequence: Synthetic oligonucleotide
  Target: DMPK; (-) strand; PAM type: NRG; PAM sequence: TGG
gcgacagcagccggtgctga

SEQ ID NO: 10621 - DNA, 20 bp, Artificial Sequence
  Description of Artificial Sequence: Synthetic oligonucleotide
  Target: DMPK; (-) strand; PAM type: NRG; PAM sequence: CGG
gaggaggcggcgacagcagc

SEQ ID NO: 10622 - DNA, 20 bp, Artificial Sequence
  Description of Artificial Sequence: Synthetic oligonucleotide
  Target: DMPK; (-) strand; PAM type: NRG; PAM sequence: CAG
ggcagaggaggcggcgacag

SEQ ID NO: 10623 - DNA, 20 bp, Artificial Sequence
  Description of Artificial Sequence: Synthetic oligonucleotide
  Target: DMPK; (-) strand; PAM type: NRG; PAM sequence: CAG
aagggcagaggaggcggcga

SEQ ID NO: 10624 - DNA, 20 bp, Artificial Sequence
  Description of Artificial Sequence: Synthetic oligonucleotide
  Target: DMPK; (-) strand; PAM type: NRG; PAM sequence: CGG
caccacaagggcagaggagg

SEQ ID NO: 10625 - DNA, 20 bp, Artificial Sequence
  Description of Artificial Sequence: Synthetic oligonucleotide
  Target: DMPK; (-) strand; PAM type: NRG; PAM sequence: AGG
ctacaccacaagggcagagg

SEQ ID NO: 10626 - DNA, 20 bp, Artificial Sequence
  Description of Artificial Sequence: Synthetic oligonucleotide
  Target: DMPK; (-) strand; PAM type: NRG; PAM sequence: GAG
cctacaccacaagggcagag

SEQ ID NO: 10627 - DNA, 20 bp, Artificial Sequence
  Description of Artificial Sequence: Synthetic oligonucleotide
  Target: DMPK; (-) strand; PAM type: NRG; PAM sequence: AGG
cccctacaccacaagggcag

SEQ ID NO: 10628 - DNA, 20 bp, Artificial Sequence
  Description of Artificial Sequence: Synthetic oligonucleotide
  Target: DMPK; (-) strand; PAM type: NRG; PAM sequence: GAG
acccctacaccacaagggca

SEQ ID NO: 10629 - DNA, 20 bp, Artificial Sequence
  Description of Artificial Sequence: Synthetic oligonucleotide
  Target: DMPK; (-) strand; PAM type: NRG; PAM sequence: CAG
tgacccctacaccacaaggg

SEQ ID NO: 10630 - DNA, 20 bp, Artificial Sequence
  Description of Artificial Sequence: Synthetic oligonucleotide
  Target: DMPK; (-) strand; PAM type: NRG; PAM sequence: GGG
ctttgacccctacaccacaa

SEQ ID NO: 10631 - DNA, 20 bp, Artificial Sequence
  Description of Artificial Sequence: Synthetic oligonucleotide
  Target: DMPK; (-) strand; PAM type: NRG; PAM sequence: AGG
cctttgacccctacaccaca

SEQ ID NO: 10632 - DNA, 20 bp, Artificial Sequence
  Description of Artificial Sequence: Synthetic oligonucleotide
  Target: DMPK; (-) strand; PAM type: NRG; PAM sequence: AAG
gcctttgacccctacaccac

SEQ ID NO: 10633 - DNA, 20 bp, Artificial Sequence
  Description of Artificial Sequence: Synthetic oligonucleotide
  Target: DMPK; (-) strand; PAM type: NRG; PAM sequence: TGG
caagtcctgggtcaacgctg

SEQ ID NO: 10634 - DNA, 20 bp, Artificial Sequence
  Description of Artificial Sequence: Synthetic oligonucleotide
  Target: DMPK; (-) strand; PAM type: NRG; PAM sequence: GGG
aggccatggccacaagtcct

SEQ ID NO: 10635 - DNA, 20 bp, Artificial Sequence
  Description of Artificial Sequence: Synthetic oligonucleotide
  Target: DMPK; (-) strand; PAM type: NRG; PAM sequence: TGG
gaggccatggccacaagtcc

SEQ ID NO: 10636 - DNA, 20 bp, Artificial Sequence
  Description of Artificial Sequence: Synthetic oligonucleotide
  Target: DMPK; (-) strand; PAM type: NRG; PAM sequence: AAG
tggctcgaggccatggccac

SEQ ID NO: 10637 - DNA, 20 bp, Artificial Sequence
  Description of Artificial Sequence: Synthetic oligonucleotide
  Target: DMPK; (-) strand; PAM type: NRG; PAM sequence: TGG
cgcgtggtggctcgaggcca

SEQ ID NO: 10638 - DNA, 20 bp, Artificial Sequence
  Description of Artificial Sequence: Synthetic oligonucleotide
  Target: DMPK; (-) strand; PAM type: NRG; PAM sequence: AGG
gagggccgcgtggtggctcg

SEQ ID NO: 10639 - DNA, 20 bp, Artificial Sequence
  Description of Artificial Sequence: Synthetic oligonucleotide
  Target: DMPK; (-) strand; PAM type: NRG; PAM sequence: GAG
cgagggccgcgtggtggctc

SEQ ID NO: 10640 - DNA, 20 bp, Artificial Sequence
  Description of Artificial Sequence: Synthetic oligonucleotide
  Target: DMPK; (-) strand; PAM type: NRG; PAM sequence: TGG
cttcaccgagggccgcgtgg

SEQ ID NO: 10641 - DNA, 20 bp, Artificial Sequence
  Description of Artificial Sequence: Synthetic oligonucleotide
  Target: DMPK; (-) strand; PAM type: NRG; PAM sequence: TGG
gtccttcaccgagggccgcg

SEQ ID NO: 10642 - DNA, 20 bp, Artificial Sequence
  Description of Artificial Sequence: Synthetic oligonucleotide
  Target: DMPK; (-) strand; PAM type: NRG; PAM sequence: GGG
accgtgtggtccttcaccga

SEQ ID NO: 10643 - DNA, 20 bp, Artificial Sequence
  Description of Artificial Sequence: Synthetic oligonucleotide
  Target: DMPK; (-) strand; PAM type: NRG; PAM sequence: AGG
caccgtgtggtccttcaccg

SEQ ID NO: 10644 - DNA, 20 bp, Artificial Sequence
  Description of Artificial Sequence: Synthetic oligonucleotide
  Target: DMPK; (-) strand; PAM type: NRG; PAM sequence: GAG
tcaccgtgtggtccttcacc

SEQ ID NO: 10645 - DNA, 20 bp, Artificial Sequence
  Description of Artificial Sequence: Synthetic oligonucleotide
  Target: DMPK; (-) strand; PAM type: NRG; PAM sequence: TGG
aagatgacctggtcaccgtg

SEQ ID NO: 10646 - DNA, 20 bp, Artificial Sequence
  Description of Artificial Sequence: Synthetic oligonucleotide
  Target: DMPK; (-) strand; PAM type: NRG; PAM sequence: TGG
gacgggtggcgaagatgacc

SEQ ID NO: 10647 - DNA, 20 bp, Artificial Sequence
  Description of Artificial Sequence: Synthetic oligonucleotide
  Target: DMPK; (-) strand; PAM type: NRG; PAM sequence: AAG
ctacgtggtgacgggtggcg

SEQ ID NO: 10648 - DNA, 20 bp, Artificial Sequence
  Description of Artificial Sequence: Synthetic oligonucleotide
  Target: DMPK; (-) strand; PAM type: NRG; PAM sequence: TGG
ggccgctacgtggtgacggg

SEQ ID NO: 10649 - DNA, 20 bp, Artificial Sequence
  Description of Artificial Sequence: Synthetic oligonucleotide
  Target: DMPK; (-) strand; PAM type: NRG; PAM sequence: GGG
gacggccgctacgtggtgac

SEQ ID NO: 10650 - DNA, 20 bp, Artificial Sequence
  Description of Artificial Sequence: Synthetic oligonucleotide
  Target: DMPK; (-) strand; PAM type: NRG; PAM sequence: CGG
tgacggccgctacgtggtga

SEQ ID NO: 10651 - DNA, 20 bp, Artificial Sequence
  Description of Artificial Sequence: Synthetic oligonucleotide
  Target: DMPK; (-) strand; PAM type: NRG; PAM sequence: TGG
gagccctgacggccgctacg

SEQ ID NO: 10652 - DNA, 20 bp, Artificial Sequence
  Description of Artificial Sequence: Synthetic oligonucleotide
  Target: DMPK; (-) strand; PAM type: NRG; PAM sequence: CGG
tgtgtgtgctggagccctga

SEQ ID NO: 10653 - DNA, 20 bp, Artificial Sequence
  Description of Artificial Sequence: Synthetic oligonucleotide
  Target: DMPK; (-) strand; PAM type: NRG; PAM sequence: GAG
ggcctgctgtgtgtgtgctg

SEQ ID NO: 10654 - DNA, 20 bp, Artificial Sequence
  Description of Artificial Sequence: Synthetic oligonucleotide
  Target: DMPK; (-) strand; PAM type: NRG; PAM sequence: TGG
ggggcctgctgtgtgtgtgc

SEQ ID NO: 10655 - DNA, 20 bp, Artificial Sequence
  Description of Artificial Sequence: Synthetic oligonucleotide
  Target: DMPK; (-) strand; PAM type: NRG; PAM sequence: GGG
ctcatgaagagctactttgg

SEQ ID NO: 10656 - DNA, 20 bp, Artificial Sequence
  Description of Artificial Sequence: Synthetic oligonucleotide
  Target: DMPK; (-) strand; PAM type: NRG; PAM sequence: GGG
gctcatgaagagctactttg

SEQ ID NO: 10657 - DNA, 20 bp, Artificial Sequence
  Description of Artificial Sequence: Synthetic oligonucleotide
  Target: DMPK; (-) strand; PAM type: NRG; PAM sequence: GGG
ggctcatgaagagctacttt

SEQ ID NO: 10658 - DNA, 20 bp, Artificial Sequence
  Description of Artificial Sequence: Synthetic oligonucleotide
  Target: DMPK; (-) strand; PAM type: NRG; PAM sequence: TGG
gggctcatgaagagctactt

SEQ ID NO: 10659 - DNA, 20 bp, Artificial Sequence
  Description of Artificial Sequence: Synthetic oligonucleotide
  Target: DMPK; (-) strand; PAM type: NRG; PAM sequence: GAG
ctcctgcgtgggctcatgaa

SEQ ID NO: 10660 - DNA, 20 bp, Artificial Sequence
  Description of Artificial Sequence: Synthetic oligonucleotide
  Target: DMPK; (-) strand; PAM type: NRG; PAM sequence: AAG
tgctcctgcgtgggctcatg

SEQ ID NO: 10661 - DNA, 20 bp, Artificial Sequence
  Description of Artificial Sequence: Synthetic oligonucleotide
  Target: DMPK; (-) strand; PAM type: NRG; PAM sequence: GGG
tcgactccatgctcctgcgt

SEQ ID NO: 10662 - DNA, 20 bp, Artificial Sequence
  Description of Artificial Sequence: Synthetic oligonucleotide
  Target: DMPK; (-) strand; PAM type: NRG; PAM sequence: TGG
ttcgactccatgctcctgcg

SEQ ID NO: 10663 - DNA, 20 bp, Artificial Sequence
  Description of Artificial Sequence: Synthetic oligonucleotide
  Target: DMPK; (-) strand; PAM type: NRG; PAM sequence: TGG
ctggcctgtgtgagccagga

SEQ ID NO: 10664 - DNA, 20 bp, Artificial Sequence
  Description of Artificial Sequence: Synthetic oligonucleotide
  Target: DMPK; (-) strand; PAM type: NRG; PAM sequence: AGG
gcacctggcctgtgtgagcc

SEQ ID NO: 10665 - DNA, 20 bp, Artificial Sequence
  Description of Artificial Sequence: Synthetic oligonucleotide
  Target: DMPK; (-) strand; PAM type: NRG; PAM sequence: CAG
ggcacctggcctgtgtgagc

SEQ ID NO: 10666 - DNA, 20 bp, Artificial Sequence
  Description of Artificial Sequence: Synthetic oligonucleotide
  Target: DMPK; (-) strand; PAM type: NRG; PAM sequence: GAG
ggccggcacctggcctgtgt

SEQ ID NO: 10667 - DNA, 20 bp, Artificial Sequence
  Description of Artificial Sequence: Synthetic oligonucleotide
  Target: DMPK; (-) strand; PAM type: NRG; PAM sequence: TGG
ctcgcccgatggccggcacc

SEQ ID NO: 10668 - DNA, 20 bp, Artificial Sequence
  Description of Artificial Sequence: Synthetic oligonucleotide
  Target: DMPK; (-) strand; PAM type: NRG; PAM sequence: CGG
tcgccttctcgcccgatggc

SEQ ID NO: 10669 - DNA, 20 bp, Artificial Sequence
  Description of Artificial Sequence: Synthetic oligonucleotide
  Target: DMPK; (-) strand; PAM type: NRG; PAM sequence: TGG
gagttcgccttctcgcccga

SEQ ID NO: 10670 - DNA, 20 bp, Artificial Sequence
  Description of Artificial Sequence: Synthetic oligonucleotide
  Target: DMPK; (-) strand; PAM type: NRG; PAM sequence: GAG
tgggtgaggggcccctcaac

SEQ ID NO: 10671 - DNA, 20 bp, Artificial Sequence
  Description of Artificial Sequence: Synthetic oligonucleotide
  Target: DMPK; (-) strand; PAM type: NRG; PAM sequence: GGG
ccaagtgggcggtgggtgag

SEQ ID NO: 10672 - DNA, 20 bp, Artificial Sequence
  Description of Artificial Sequence: Synthetic oligonucleotide
  Target: DMPK; (-) strand; PAM type: NRG; PAM sequence: GGG
gccaagtgggcggtgggtga

SEQ ID NO: 10673 - DNA, 20 bp, Artificial Sequence
  Description of Artificial Sequence: Synthetic oligonucleotide
  Target: DMPK; (-) strand; PAM type: NRG; PAM sequence: AGG
ggccaagtgggcggtgggtg

SEQ ID NO: 10674 - DNA, 20 bp, Artificial Sequence
  Description of Artificial Sequence: Synthetic oligonucleotide
  Target: DMPK; (-) strand; PAM type: NRG; PAM sequence: GAG
tggccaagtgggcggtgggt

SEQ ID NO: 10675 - DNA, 20 bp, Artificial Sequence
  Description of Artificial Sequence: Synthetic oligonucleotide
  Target: DMPK; (-) strand; PAM type: NRG; PAM sequence: GGG
ccgctggccaagtgggcggt

SEQ ID NO: 10676 - DNA, 20 bp, Artificial Sequence
  Description of Artificial Sequence: Synthetic oligonucleotide
  Target: DMPK; (-) strand; PAM type: NRG; PAM sequence: TGG
cccgctggccaagtgggcgg

SEQ ID NO: 10677 - DNA, 20 bp, Artificial Sequence
  Description of Artificial Sequence: Synthetic oligonucleotide
  Target: DMPK; (-) strand; PAM type: NRG; PAM sequence: CGG
caacccgctggccaagtggg

SEQ ID NO: 10678 - DNA, 20 bp, Artificial Sequence
  Description of Artificial Sequence: Synthetic oligonucleotide
  Target: DMPK; (-) strand; PAM type: NRG; PAM sequence: GGG
ccgcaacccgctggccaagt

SEQ ID NO: 10679 - DNA, 20 bp, Artificial Sequence
  Description of Artificial Sequence: Synthetic oligonucleotide
  Target: DMPK; (-) strand; PAM type: NRG; PAM sequence: TGG
cccgcaacccgctggccaag

SEQ ID NO: 10680 - DNA, 20 bp, Artificial Sequence
  Description of Artificial Sequence: Synthetic oligonucleotide
  Target: DMPK; (-) strand; PAM type: NRG; PAM sequence: AAG
caccccgcaacccgctggcc

SEQ ID NO: 10681 - DNA, 20 bp, Artificial Sequence
  Description of Artificial Sequence: Synthetic oligonucleotide
  Target: DMPK; (-) strand; PAM type: NRG; PAM sequence: TGG
caaggcaccccgcaacccgc

SEQ ID NO: 10682 - DNA, 20 bp, Artificial Sequence
  Description of Artificial Sequence: Synthetic oligonucleotide
  Target: DMPK; (-) strand; PAM type: NRG; PAM sequence: AGG
tgtctatgctgccaagagca

SEQ ID NO: 10683 - DNA, 20 bp, Artificial Sequence
  Description of Artificial Sequence: Synthetic oligonucleotide
  Target: DMPK; (-) strand; PAM type: NRG; PAM sequence: AAG
ctgtctatgctgccaagagc

SEQ ID NO: 10684 - DNA, 20 bp, Artificial Sequence
  Description of Artificial Sequence: Synthetic oligonucleotide
  Target: DMPK; (-) strand; PAM type: NRG; PAM sequence: GAG
ttctctgtctatgctgccaa

SEQ ID NO: 10685 - DNA, 20 bp, Artificial Sequence
  Description of Artificial Sequence: Synthetic oligonucleotide
  Target: DMPK; (-) strand; PAM type: NRG; PAM sequence: AAG
gcttctctgtctatgctgcc

SEQ ID NO: 10686 - DNA, 20 bp, Artificial Sequence
  Description of Artificial Sequence: Synthetic oligonucleotide
  Target: DMPK; (-) strand; PAM type: NRG; PAM sequence: GGG
agcctgctgaagcagggcga

SEQ ID NO: 10687 - DNA, 20 bp, Artificial Sequence
  Description of Artificial Sequence: Synthetic oligonucleotide
  Target: DMPK; (-) strand; PAM type: NRG; PAM sequence: AGG
cagcctgctgaagcagggcg

SEQ ID NO: 10688 - DNA, 20 bp, Artificial Sequence
  Description of Artificial Sequence: Synthetic oligonucleotide
  Target: DMPK; (-) strand; PAM type: NRG; PAM sequence: GAG
acagcctgctgaagcagggc

SEQ ID NO: 10689 - DNA, 20 bp, Artificial Sequence
  Description of Artificial Sequence: Synthetic oligonucleotide
  Target: DMPK; (-) strand; PAM type: NRG; PAM sequence: GGG
cagtacagcctgctgaagca

SEQ ID NO: 10690 - DNA, 20 bp, Artificial Sequence
  Description of Artificial Sequence: Synthetic oligonucleotide
  Target: DMPK; (-) strand; PAM type: NRG; PAM sequence: AGG
ccagtacagcctgctgaagc

SEQ ID NO: 10691 - DNA, 20 bp, Artificial Sequence
  Description of Artificial Sequence: Synthetic oligonucleotide
  Target: DMPK; (-) strand; PAM type: NRG; PAM sequence: CAG
cccagtacagcctgctgaag

SEQ ID NO: 10692 - DNA, 20 bp, Artificial Sequence
  Description of Artificial Sequence: Synthetic oligonucleotide
  Target: DMPK; (-) strand; PAM type: NRG; PAM sequence: AAG
cgccccagtacagcctgctg

SEQ ID NO: 10693 - DNA, 20 bp, Artificial Sequence
  Description of Artificial Sequence: Synthetic oligonucleotide
  Target: DMPK; (-) strand; PAM type: NRG; PAM sequence: CAG
gcctcggccccgccccagta

SEQ ID NO: 10694 - DNA, 20 bp, Artificial Sequence
  Description of Artificial Sequence: Synthetic oligonucleotide
  Target: DMPK; (-) strand; PAM type: NRG; PAM sequence: CAG
cctgcgcctcggccccgccc

SEQ ID NO: 10695 - DNA, 20 bp, Artificial Sequence
  Description of Artificial Sequence: Synthetic oligonucleotide
  Target: DMPK; (-) strand; PAM type: NRG; PAM sequence: CGG
cgtcagccacccctgcgcct

SEQ ID NO: 10696 - DNA, 20 bp, Artificial Sequence
  Description of Artificial Sequence: Synthetic oligonucleotide
  Target: DMPK; (-) strand; PAM type: NRG; PAM sequence: CAG
cacctgtacctgtacaacgt

SEQ ID NO: 10697 - DNA, 20 bp, Artificial Sequence
  Description of Artificial Sequence: Synthetic oligonucleotide
  Target: DMPK; (-) strand; PAM type: NRG; PAM sequence: TGG
ttcctggcatcacacgccag

SEQ ID NO: 10698 - DNA, 20 bp, Artificial Sequence
  Description of Artificial Sequence: Synthetic oligonucleotide
  Target: DMPK; (-) strand; PAM type: NRG; PAM sequence: CAG
ctgttcctggcatcacacgc

SEQ ID NO: 10699 - DNA, 20 bp, Artificial Sequence
  Description of Artificial Sequence: Synthetic oligonucleotide
  Target: DMPK; (-) strand; PAM type: NRG; PAM sequence: TGG
tgagtcggagagcctgttcc

SEQ ID NO: 10700 - DNA, 20 bp, Artificial Sequence
  Description of Artificial Sequence: Synthetic oligonucleotide
  Target: DMPK; (-) strand; PAM type: NRG; PAM sequence: GAG
aagtggctgcctgagtcgga

SEQ ID NO: 10701 - DNA, 20 bp, Artificial Sequence
  Description of Artificial Sequence: Synthetic oligonucleotide
  Target: DMPK; (-) strand; PAM type: NRG; PAM sequence: GAG
tgaagtggctgcctgagtcg

SEQ ID NO: 10702 - DNA, 20 bp, Artificial Sequence
  Description of Artificial Sequence: Synthetic oligonucleotide
  Target: DMPK; (-) strand; PAM type: NRG; PAM sequence: CGG
tctgaagtggctgcctgagt

SEQ ID NO: 10703 - DNA, 20 bp, Artificial Sequence
  Description of Artificial Sequence: Synthetic oligonucleotide
  Target: DMPK; (-) strand; PAM type: NRG; PAM sequence: GAG
catatctgaagtggctgcct

SEQ ID NO: 10704 - DNA, 20 bp, Artificial Sequence
  Description of Artificial Sequence: Synthetic oligonucleotide
  Target: DMPK; (-) strand; PAM type: NRG; PAM sequence: TGG
ccaaggtgacatatctgaag

SEQ ID NO: 10705 - DNA, 20 bp, Artificial Sequence
  Description of Artificial Sequence: Synthetic oligonucleotide
  Target: DMPK; (-) strand; PAM type: NRG; PAM sequence: AAG
agaccaaggtgacatatctg

SEQ ID NO: 10706 - DNA, 20 bp, Artificial Sequence
  Description of Artificial Sequence: Synthetic oligonucleotide
  Target: DMPK; (-) strand; PAM type: NRG; PAM sequence: AGG
gcggttgatcgacaagacca

SEQ ID NO: 10707 - DNA, 20 bp, Artificial Sequence
  Description of Artificial Sequence: Synthetic oligonucleotide
  Target: DMPK; (-) strand; PAM type: NRG; PAM sequence: AAG
agcggttgatcgacaagacc

SEQ ID NO: 10708 - DNA, 20 bp, Artificial Sequence
  Description of Artificial Sequence: Synthetic oligonucleotide
  Target: DMPK; (-) strand; PAM type: NRG; PAM sequence: AAG
cctggcagcggttgatcgac

SEQ ID NO: 10709 - DNA, 20 bp, Artificial Sequence
  Description of Artificial Sequence: Synthetic oligonucleotide
  Target: DMPK; (-) strand; PAM type: NRG; PAM sequence: CGG
cacactgtctcccctggcag

SEQ ID NO: 10710 - DNA, 20 bp, Artificial Sequence
  Description of Artificial Sequence: Synthetic oligonucleotide
  Target: DMPK; (-) strand; PAM type: NRG; PAM sequence: CAG
ccccacactgtctcccctgg

SEQ ID NO: 10711 - DNA, 20 bp, Artificial Sequence
  Description of Artificial Sequence: Synthetic oligonucleotide
  Target: DMPK; (-) strand; PAM type: NRG; PAM sequence: TGG
caaccccacactgtctcccc

SEQ ID NO: 10712 - DNA, 20 bp, Artificial Sequence
  Description of Artificial Sequence: Synthetic oligonucleotide
  Target: DMPK; (-) strand; PAM type: NRG; PAM sequence: GGG
gtcggggagaagttctgcct

SEQ ID NO: 10713 - DNA, 20 bp, Artificial Sequence
  Description of Artificial Sequence: Synthetic oligonucleotide
  Target: DMPK; (-) strand; PAM type: NRG; PAM sequence: TGG
ggtcggggagaagttctgcc

SEQ ID NO: 10714 - DNA, 20 bp, Artificial Sequence
  Description of Artificial Sequence: Synthetic oligonucleotide
  Target: DMPK; (-) strand; PAM type: NRG; PAM sequence: AAG
ggggactttgggtcggggag

SEQ ID NO: 10715 - DNA, 20 bp, Artificial Sequence
  Description of Artificial Sequence: Synthetic oligonucleotide
  Target: DMPK; (-) strand; PAM type: NRG; PAM sequence: GAG
cttggggactttgggtcggg

SEQ ID NO: 10716 - DNA, 20 bp, Artificial Sequence
  Description of Artificial Sequence: Synthetic oligonucleotide
  Target: DMPK; (-) strand; PAM type: NRG; PAM sequence: GGG
ttcttggggactttgggtcg

SEQ ID NO: 10717 - DNA, 20 bp, Artificial Sequence
  Description of Artificial Sequence: Synthetic oligonucleotide
  Target: DMPK; (-) strand; PAM type: NRG; PAM sequence: GGG
cttcttggggactttgggtc

SEQ ID NO: 10718 - DNA, 20 bp, Artificial Sequence
  Description of Artificial Sequence: Synthetic oligonucleotide
  Target: DMPK; (-) strand; PAM type: NRG; PAM sequence: CGG
ccttcttggggactttgggt

SEQ ID NO: 10719 - DNA, 20 bp, Artificial Sequence
  Description of Artificial Sequence: Synthetic oligonucleotide
  Target: DMPK; (-) strand; PAM type: NRG; PAM sequence: GGG
acggccttcttggggacttt

SEQ ID NO: 10720 - DNA, 20 bp, Artificial Sequence
  Description of Artificial Sequence: Synthetic oligonucleotide
  Target: DMPK; (-) strand; PAM type: NRG; PAM sequence: TGG
aacggccttcttggggactt

SEQ ID NO: 10721 - DNA, 20 bp, Artificial Sequence
  Description of Artificial Sequence: Synthetic oligonucleotide
  Target: DMPK; (-) strand; PAM type: NRG; PAM sequence: GGG
catgtccaacggccttcttg

SEQ ID NO: 10722 - DNA, 20 bp, Artificial Sequence
  Description of Artificial Sequence: Synthetic oligonucleotide
  Target: DMPK; (-) strand; PAM type: NRG; PAM sequence: GGG
ccatgtccaacggccttctt

SEQ ID NO: 10723 - DNA, 20 bp, Artificial Sequence
  Description of Artificial Sequence: Synthetic oligonucleotide
  Target: DMPK; (-) strand; PAM type: NRG; PAM sequence: TGG
gccatgtccaacggccttct

SEQ ID NO: 10724 - DNA, 20 bp, Artificial Sequence
  Description of Artificial Sequence: Synthetic oligonucleotide
  Target: DMPK; (-) strand; PAM type: NRG; PAM sequence: CGG
gtgagcggggccatgtccaa

SEQ ID NO: 10725 - DNA, 20 bp, Artificial Sequence
  Description of Artificial Sequence: Synthetic oligonucleotide
  Target: DMPK; (-) strand; PAM type: NRG; PAM sequence: GGG
tggcacctgctgtgtgagcg

SEQ ID NO: 10726 - DNA, 20 bp, Artificial Sequence
  Description of Artificial Sequence: Synthetic oligonucleotide
  Target: DMPK; (-) strand; PAM type: NRG; PAM sequence: GGG
gtggcacctgctgtgtgagc

SEQ ID NO: 10727 - DNA, 20 bp, Artificial Sequence
  Description of Artificial Sequence: Synthetic oligonucleotide
  Target: DMPK; (-) strand; PAM type: NRG; PAM sequence: CGG
tgtggcacctgctgtgtgag

SEQ ID NO: 10728 - DNA, 20 bp, Artificial Sequence
  Description of Artificial Sequence: Synthetic oligonucleotide
  Target: DMPK; (-) strand; PAM type: NRG; PAM sequence: GAG
tggtgtggcacctgctgtgt

SEQ ID NO: 10729 - DNA, 20 bp, Artificial Sequence
  Description of Artificial Sequence: Synthetic oligonucleotide
  Target: DMPK; (-) strand; PAM type: NRG; PAM sequence: TGG
aggaggacctgggcctggtg

SEQ ID NO: 10730 - DNA, 20 bp, Artificial Sequence
  Description of Artificial Sequence: Synthetic oligonucleotide
  Target: DMPK; (-) strand; PAM type: NRG; PAM sequence: TGG
ctccgaggaggacctgggcc

SEQ ID NO: 10731 - DNA, 20 bp, Artificial Sequence
  Description of Artificial Sequence: Synthetic oligonucleotide
  Target: DMPK; (-) strand; PAM type: NRG; PAM sequence: GGG
cttctctccgaggaggacct

SEQ ID NO: 10732 - DNA, 20 bp, Artificial Sequence
  Description of Artificial Sequence: Synthetic oligonucleotide
  Target: DMPK; (-) strand; PAM type: NRG; PAM sequence: TGG
gcttctctccgaggaggacc

SEQ ID NO: 10733 - DNA, 20 bp, Artificial Sequence
  Description of Artificial Sequence: Synthetic oligonucleotide
  Target: DMPK; (-) strand; PAM type: NRG; PAM sequence: AGG
ttgggagcttctctccgagg

SEQ ID NO: 10734 - DNA, 20 bp, Artificial Sequence
  Description of Artificial Sequence: Synthetic oligonucleotide
  Target: DMPK; (-) strand; PAM type: NRG; PAM sequence: GAG
tttgggagcttctctccgag

SEQ ID NO: 10735 - DNA, 20 bp, Artificial Sequence
  Description of Artificial Sequence: Synthetic oligonucleotide
  Target: DMPK; (-) strand; PAM type: NRG; PAM sequence: AGG
agtttgggagcttctctccg

SEQ ID NO: 10736 - DNA, 20 bp, Artificial Sequence
  Description of Artificial Sequence: Synthetic oligonucleotide
  Target: DMPK; (-) strand; PAM type: NRG; PAM sequence: GAG
cagtttgggagcttctctcc

SEQ ID NO: 10737 - DNA, 20 bp, Artificial Sequence
  Description of Artificial Sequence: Synthetic oligonucleotide
  Target: DMPK; (-) strand; PAM type: NRG; PAM sequence: GAG
atctgtcttccccagtttgg

SEQ ID NO: 10738 - DNA, 20 bp, Artificial Sequence
  Description of Artificial Sequence: Synthetic oligonucleotide
  Target: DMPK; (-) strand; PAM type: NRG; PAM sequence: GGG
ccatctgtcttccccagttt

SEQ ID NO: 10739 - DNA, 20 bp, Artificial Sequence
  Description of Artificial Sequence: Synthetic oligonucleotide
  Target: DMPK; (-) strand; PAM type: NRG; PAM sequence: TGG
tccatctgtcttccccagtt

SEQ ID NO: 10740 - DNA, 20 bp, Artificial Sequence
  Description of Artificial Sequence: Synthetic oligonucleotide
  Target: DMPK; (-) strand; PAM type: NRG; PAM sequence: CAG
tggtgtccatctgtcttccc

SEQ ID NO: 10741 - DNA, 20 bp, Artificial Sequence
  Description of Artificial Sequence: Synthetic oligonucleotide
  Target: DMPK; (-) strand; PAM type: NRG; PAM sequence: TGG
ttccccatgtttccatgacc

SEQ ID NO: 10742 - DNA, 20 bp, Artificial Sequence
  Description of Artificial Sequence: Synthetic oligonucleotide
  Target: DMPK; (-) strand; PAM type: NRG; PAM sequence: CAG
accctgtggccaccttgcag

SEQ ID NO: 10743 - DNA, 20 bp, Artificial Sequence
  Description of Artificial Sequence: Synthetic oligonucleotide
  Target: DMPK; (-) strand; PAM type: NRG; PAM sequence: CAG
agcaccctgtggccaccttg

SEQ ID NO: 10744 - DNA, 20 bp, Artificial Sequence
  Description of Artificial Sequence: Synthetic oligonucleotide
  Target: DMPK; (-) strand; PAM type: NRG; PAM sequence: TGG
aggctccttggagcaccctg

SEQ ID NO: 10745 - DNA, 20 bp, Artificial Sequence
  Description of Artificial Sequence: Synthetic oligonucleotide
  Target: DMPK; (-) strand; PAM type: NRG; PAM sequence: GAG
tgggacatcgaggctccttg

SEQ ID NO: 10746 - DNA, 20 bp, Artificial Sequence
  Description of Artificial Sequence: Synthetic oligonucleotide
  Target: DMPK; (-) strand; PAM type: NRG; PAM sequence: TGG
gatgggacatcgaggctcct

SEQ ID NO: 10747 - DNA, 20 bp, Artificial Sequence
  Description of Artificial Sequence: Synthetic oligonucleotide
  Target: DMPK; (-) strand; PAM type: NRG; PAM sequence: AGG
tcgccaaagatgggacatcg

SEQ ID NO: 10748 - DNA, 20 bp, Artificial Sequence
  Description of Artificial Sequence: Synthetic oligonucleotide
  Target: DMPK; (-) strand; PAM type: NRG; PAM sequence: GAG
ctcgccaaagatgggacatc

SEQ ID NO: 10749 - DNA, 20 bp, Artificial Sequence
  Description of Artificial Sequence: Synthetic oligonucleotide
  Target: DMPK; (-) strand; PAM type: NRG; PAM sequence: GGG
actgtcccctcgccaaagat

SEQ ID NO: 10750 - DNA, 20 bp, Artificial Sequence
  Description of Artificial Sequence: Synthetic oligonucleotide
  Target: DMPK; (-) strand; PAM type: NRG; PAM sequence: TGG
gactgtcccctcgccaaaga

SEQ ID NO: 10751 - DNA, 20 bp, Artificial Sequence
  Description of Artificial Sequence: Synthetic oligonucleotide
  Target: DMPK; (-) strand; PAM type: NRG; PAM sequence: AAG
gcaggactgtcccctcgcca

SEQ ID NO: 10752 - DNA, 20 bp, Artificial Sequence
  Description of Artificial Sequence: Synthetic oligonucleotide
  Target: DMPK; (-) strand; PAM type: NRG; PAM sequence: AGG
aggacaattctgtggcaagc

SEQ ID NO: 10753 - DNA, 20 bp, Artificial Sequence
  Description of Artificial Sequence: Synthetic oligonucleotide
  Target: DMPK; (-) strand; PAM type: NRG; PAM sequence: CAG
caggacaattctgtggcaag

SEQ ID NO: 10754 - DNA, 20 bp, Artificial Sequence
  Description of Artificial Sequence: Synthetic oligonucleotide
  Target: DMPK; (-) strand; PAM type: NRG; PAM sequence: AAG
atacaggacaattctgtggc

SEQ ID NO: 10755 - DNA, 20 bp, Artificial Sequence
  Description of Artificial Sequence: Synthetic oligonucleotide
  Target: DMPK; (-) strand; PAM type: NRG; PAM sequence: TGG
cgagatacaggacaattctg

SEQ ID NO: 10756 - DNA, 20 bp, Artificial Sequence
  Description of Artificial Sequence: Synthetic oligonucleotide
  Target: DMPK; (-) strand; PAM type: NRG; PAM sequence: AGG
ggttgaggaccccgagatac

SEQ ID NO: 10757 - DNA, 20 bp, Artificial Sequence
  Description of Artificial Sequence: Synthetic oligonucleotide
  Target: DMPK; (-) strand; PAM type: NRG; PAM sequence: CAG
aggttgaggaccccgagata

SEQ ID NO: 10758 - DNA, 20 bp, Artificial Sequence
  Description of Artificial Sequence: Synthetic oligonucleotide
  Target: DMPK; (-) strand; PAM type: NRG; PAM sequence: GAG
gcccggaggttgaggacccc

SEQ ID NO: 10759 - DNA, 20 bp, Artificial Sequence
  Description of Artificial Sequence: Synthetic oligonucleotide
  Target: DMPK; (-) strand; PAM type: NRG; PAM sequence: AGG
gttccatggcccggaggttg

SEQ ID NO: 10760 - DNA, 20 bp, Artificial Sequence
  Description of Artificial Sequence: Synthetic oligonucleotide
  Target: DMPK; (-) strand; PAM type: NRG; PAM sequence: GAG
tgttccatggcccggaggtt

SEQ ID NO: 10761 - DNA, 20 bp, Artificial Sequence
  Description of Artificial Sequence: Synthetic oligonucleotide
  Target: DMPK; (-) strand; PAM type: NRG; PAM sequence: AGG
actactgttccatggcccgg

SEQ ID NO: 10762 - DNA, 20 bp, Artificial Sequence
  Description of Artificial Sequence: Synthetic oligonucleotide
  Target: DMPK; (-) strand; PAM type: NRG; PAM sequence: GAG
cactactgttccatggcccg

SEQ ID NO: 10763 - DNA, 20 bp, Artificial Sequence
  Description of Artificial Sequence: Synthetic oligonucleotide
  Target: DMPK; (-) strand; PAM type: NRG; PAM sequence: CGG
accactactgttccatggcc

SEQ ID NO: 10764 - DNA, 20 bp, Artificial Sequence
  Description of Artificial Sequence: Synthetic oligonucleotide
  Target: DMPK; (-) strand; PAM type: NRG; PAM sequence: TGG
cacggaccactactgttcca

SEQ ID NO: 10765 - DNA, 20 bp, Artificial Sequence
  Description of Artificial Sequence: Synthetic oligonucleotide
  Target: DMPK; (-) strand; PAM type: NRG; PAM sequence: CGG
gcctggttcctaacaggcca

SEQ ID NO: 10766 - DNA, 20 bp, Artificial Sequence
  Description of Artificial Sequence: Synthetic oligonucleotide
  Target: DMPK; (-) strand; PAM type: NRG; PAM sequence: AGG
tgcatggcctggttcctaac

SEQ ID NO: 10767 - DNA, 20 bp, Artificial Sequence
  Description of Artificial Sequence: Synthetic oligonucleotide
  Target: DMPK; (-) strand; PAM type: NRG; PAM sequence: CAG
ctgcatggcctggttcctaa

SEQ ID NO: 10768 - DNA, 20 bp, Artificial Sequence
  Description of Artificial Sequence: Synthetic oligonucleotide
  Target: DMPK; (-) strand; PAM type: NRG; PAM sequence: TGG
tcacctcctgctgcatggcc

SEQ ID NO: 10769 - DNA, 20 bp, Artificial Sequence
  Description of Artificial Sequence: Synthetic oligonucleotide
  Target: DMPK; (-) strand; PAM type: NRG; PAM sequence: TGG
accactcacctcctgctgca

SEQ ID NO: 10770 - DNA, 20 bp, Artificial Sequence
  Description of Artificial Sequence: Synthetic oligonucleotide
  Target: DMPK; (-) strand; PAM type: NRG; PAM sequence: AGG
tccggtaggaggctgggctc

SEQ ID NO: 10771 - DNA, 20 bp, Artificial Sequence
  Description of Artificial Sequence: Synthetic oligonucleotide
  Target: DMPK; (-) strand; PAM type: NRG; PAM sequence: CAG
ctccggtaggaggctgggct

SEQ ID NO: 10772 - DNA, 20 bp, Artificial Sequence
  Description of Artificial Sequence: Synthetic oligonucleotide
  Target: DMPK; (-) strand; PAM type: NRG; PAM sequence: GGG
cgctgctccggtaggaggct

SEQ ID NO: 10773 - DNA, 20 bp, Artificial Sequence
  Description of Artificial Sequence: Synthetic oligonucleotide
  Target: DMPK; (-) strand; PAM type: NRG; PAM sequence: TGG
gcgctgctccggtaggaggc

SEQ ID NO: 10774 - DNA, 20 bp, Artificial Sequence
  Description of Artificial Sequence: Synthetic oligonucleotide
  Target: DMPK; (-) strand; PAM type: NRG; PAM sequence: AGG
tggtgcgctgctccggtagg

SEQ ID NO: 10775 - DNA, 20 bp, Artificial Sequence
  Description of Artificial Sequence: Synthetic oligonucleotide
  Target: DMPK; (-) strand; PAM type: NRG; PAM sequence: GAG
atggtgcgctgctccggtag

SEQ ID NO: 10776 - DNA, 20 bp, Artificial Sequence
  Description of Artificial Sequence: Synthetic oligonucleotide
  Target: DMPK; (-) strand; PAM type: NRG; PAM sequence: AGG
gaatggtgcgctgctccggt

SEQ ID NO: 10777 - DNA, 20 bp, Artificial Sequence
  Description of Artificial Sequence: Synthetic oligonucleotide
  Target: DMPK; (-) strand; PAM type: NRG; PAM sequence: TAG
tgaatggtgcgctgctccgg

SEQ ID NO: 10778 - DNA, 20 bp, Artificial Sequence
  Description of Artificial Sequence: Synthetic oligonucleotide
  Target: DMPK; (-) strand; PAM type: NRG; PAM sequence: CGG
gattgaatggtgcgctgctc

SEQ ID NO: 10779 - DNA, 20 bp, Artificial Sequence
  Description of Artificial Sequence: Synthetic oligonucleotide
  Target: DMPK; (-) strand; PAM type: NRG; PAM sequence: TGG
gcactcttacgaggattgaa

SEQ ID NO: 10780 - DNA, 20 bp, Artificial Sequence
  Description of Artificial Sequence: Synthetic oligonucleotide
  Target: DMPK; (-) strand; PAM type: NRG; PAM sequence: AGG
gtggggttcgcactcttacg

SEQ ID NO: 10781 - DNA, 20 bp, Artificial Sequence
  Description of Artificial Sequence: Synthetic oligonucleotide
  Target: DMPK; (-) strand; PAM type: NRG; PAM sequence: GAG
ggtggggttcgcactcttac

SEQ ID NO: 10782 - DNA, 20 bp, Artificial Sequence
  Description of Artificial Sequence: Synthetic oligonucleotide
  Target: DMPK; (-) strand; PAM type: NRG; PAM sequence: GGG
cgcatgcatagttcatggtg

SEQ ID NO: 10783 - DNA, 20 bp, Artificial Sequence
  Description of Artificial Sequence: Synthetic oligonucleotide
  Target: DMPK; (-) strand; PAM type: NRG; PAM sequence: GGG
tcgcatgcatagttcatggt

SEQ ID NO: 10784 - DNA, 20 bp, Artificial Sequence
  Description of Artificial Sequence: Synthetic oligonucleotide
  Target: DMPK; (-) strand; PAM type: NRG; PAM sequence: TGG
ctcgcatgcatagttcatgg

SEQ ID NO: 10785 - DNA, 20 bp, Artificial Sequence
  Description of Artificial Sequence: Synthetic oligonucleotide
  Target: DMPK; (-) strand; PAM type: NRG; PAM sequence: TGG
tccctcgcatgcatagttca

SEQ ID NO: 10786 - DNA, 20 bp, Artificial Sequence
  Description of Artificial Sequence: Synthetic oligonucleotide
  Target: DMPK; (-) strand; PAM type: NRG; PAM sequence: TAG
acctagatccctcgcatgca

SEQ ID NO: 10787 - DNA, 20 bp, Artificial Sequence
  Description of Artificial Sequence: Synthetic oligonucleotide
  Target: DMPK; (-) strand; PAM type: NRG; PAM sequence: TAG
tctaataaggagcgcacacc

SEQ ID NO: 10788 - DNA, 20 bp, Artificial Sequence
  Description of Artificial Sequence: Synthetic oligonucleotide
  Target: DMPK; (-) strand; PAM type: NRG; PAM sequence: GAG
aggtgttagattctaataag

SEQ ID NO: 10789 - DNA, 20 bp, Artificial Sequence
  Description of Artificial Sequence: Synthetic oligonucleotide
  Target: DMPK; (-) strand; PAM type: NRG; PAM sequence: AGG
tcaggtgttagattctaata

SEQ ID NO: 10790 - DNA, 20 bp, Artificial Sequence
  Description of Artificial Sequence: Synthetic oligonucleotide
  Target: DMPK; (-) strand; PAM type: NRG; PAM sequence: AAG
atcaggtgttagattctaat

SEQ ID NO: 10791 - DNA, 20 bp, Artificial Sequence
  Description of Artificial Sequence: Synthetic oligonucleotide
  Target: DMPK; (-) strand; PAM type: NRG; PAM sequence: TAG
tgcctctgatcatcaggtgt

SEQ ID NO: 10792 - DNA, 20 bp, Artificial Sequence
  Description of Artificial Sequence: Synthetic oligonucleotide
  Target: DMPK; (-) strand; PAM type: NRG; PAM sequence: AGG
ccgttctgcctctgatcatc

SEQ ID NO: 10793 - DNA, 20 bp, Artificial Sequence
  Description of Artificial Sequence: Synthetic oligonucleotide
  Target: DMPK; (-) strand; PAM type: NRG; PAM sequence: CAG
accgttctgcctctgatcat

SEQ ID NO: 10794 - DNA, 20 bp, Artificial Sequence
  Description of Artificial Sequence: Synthetic oligonucleotide
  Target: DMPK; (-) strand; PAM type: NRG; PAM sequence: GGG
actgttggggggatggtttt

SEQ ID NO: 10795 - DNA, 20 bp, Artificial Sequence
  Description of Artificial Sequence: Synthetic oligonucleotide
  Target: DMPK; (-) strand; PAM type: NRG; PAM sequence: TGG
gactgttggggggatggttt

SEQ ID NO: 10796 - DNA, 20 bp, Artificial Sequence
  Description of Artificial Sequence: Synthetic oligonucleotide
  Target: DMPK; (-) strand; PAM type: NRG; PAM sequence: TGG
tccacagactgttgggggga

SEQ ID NO: 10797 - DNA, 20 bp, Artificial Sequence
  Description of Artificial Sequence: Synthetic oligonucleotide
  Target: DMPK; (-) strand; PAM type: NRG; PAM sequence: GGG
tttttccacagactgttggg

SEQ ID NO: 10798 - DNA, 20 bp, Artificial Sequence
  Description of Artificial Sequence: Synthetic oligonucleotide
  Target: DMPK; (-) strand; PAM type: NRG; PAM sequence: GGG
gtttttccacagactgttgg

SEQ ID NO: 10799 - DNA, 20 bp, Artificial Sequence
  Description of Artificial Sequence: Synthetic oligonucleotide
  Target: DMPK; (-) strand; PAM type: NRG; PAM sequence: GGG
agtttttccacagactgttg

SEQ ID NO: 10800 - DNA, 20 bp, Artificial Sequence
  Description of Artificial Sequence: Synthetic oligonucleotide
  Target: DMPK; (-) strand; PAM type: NRG; PAM sequence: GGG
cagtttttccacagactgtt

SEQ ID NO: 10801 - DNA, 20 bp, Artificial Sequence
  Description of Artificial Sequence: Synthetic oligonucleotide
  Target: DMPK; (-) strand; PAM type: NRG; PAM sequence: TGG
acagtttttccacagactgt

SEQ ID NO: 10802 - DNA, 20 bp, Artificial Sequence
  Description of Artificial Sequence: Synthetic oligonucleotide
  Target: DMPK; (-) strand; PAM type: NRG; PAM sequence: CAG
tatggaagacagtttttcca

SEQ ID NO: 10803 - DNA, 20 bp, Artificial Sequence
  Description of Artificial Sequence: Synthetic oligonucleotide
  Target: DMPK; (-) strand; PAM type: NRG; PAM sequence: CAG
gggactggtcttatggaaga

SEQ ID NO: 10804 - DNA, 20 bp, Artificial Sequence
  Description of Artificial Sequence: Synthetic oligonucleotide
  Target: DMPK; (+) strand; PAM type: NRG; PAM sequence: CAG
ctcgaggtgggctctgtgtt

SEQ ID NO: 10805 - DNA, 20 bp, Artificial Sequence
  Description of Artificial Sequence: Synthetic oligonucleotide
  Target: DMPK; (+) strand; PAM type: NRG; PAM sequence: TGG
ctctgtgttcagcgctgctt

SEQ ID NO: 10806 - DNA, 20 bp, Artificial Sequence
  Description of Artificial Sequence: Synthetic oligonucleotide
  Target: DMPK; (+) strand; PAM type: NRG; PAM sequence: CAG
gtgttcagcgctgctttgga

SEQ ID NO: 10807 - DNA, 20 bp, Artificial Sequence
  Description of Artificial Sequence: Synthetic oligonucleotide
  Target: DMPK; (+) strand; PAM type: NRG; PAM sequence: TGG
gcgctgctttggacagacac

SEQ ID NO: 10808 - DNA, 20 bp, Artificial Sequence
  Description of Artificial Sequence: Synthetic oligonucleotide
  Target: DMPK; (+) strand; PAM type: NRG; PAM sequence: AAG
ctgctttggacagacactgg

SEQ ID NO: 10809 - DNA, 20 bp, Artificial Sequence
  Description of Artificial Sequence: Synthetic oligonucleotide
  Target: DMPK; (+) strand; PAM type: NRG; PAM sequence: AGG
tgctttggacagacactgga

SEQ ID NO: 10810 - DNA, 20 bp, Artificial Sequence
  Description of Artificial Sequence: Synthetic oligonucleotide
  Target: DMPK; (+) strand; PAM type: NRG; PAM sequence: CAG
acagacactggaaggcaccc

SEQ ID NO: 10811 - DNA, 20 bp, Artificial Sequence
  Description of Artificial Sequence: Synthetic oligonucleotide
  Target: DMPK; (+) strand; PAM type: NRG; PAM sequence: TGG
tggaaggcaccccagacccc

SEQ ID NO: 10812 - DNA, 20 bp, Artificial Sequence
  Description of Artificial Sequence: Synthetic oligonucleotide
  Target: DMPK; (+) strand; PAM type: NRG; PAM sequence: TGG
aaggcaccccagacccctgg

SEQ ID NO: 10813 - DNA, 20 bp, Artificial Sequence
  Description of Artificial Sequence: Synthetic oligonucleotide
  Target: DMPK; (+) strand; PAM type: NRG; PAM sequence: TGG
gcaccccagacccctggtgg

SEQ ID NO: 10814 - DNA, 20 bp, Artificial Sequence
  Description of Artificial Sequence: Synthetic oligonucleotide
  Target: DMPK; (+) strand; PAM type: NRG; PAM sequence: TGG
aactttattttaattgaaaa

SEQ ID NO: 10815 - DNA, 20 bp, Artificial Sequence
  Description of Artificial Sequence: Synthetic oligonucleotide
  Target: DMPK; (+) strand; PAM type: NRG; PAM sequence: GAG
ctttattttaattgaaaatg

SEQ ID NO: 10816 - DNA, 20 bp, Artificial Sequence
  Description of Artificial Sequence: Synthetic oligonucleotide
  Target: DMPK; (+) strand; PAM type: NRG; PAM sequence: AGG
tttattttaattgaaaatgg

SEQ ID NO: 10817 - DNA, 20 bp, Artificial Sequence
  Description of Artificial Sequence: Synthetic oligonucleotide
  Target: DMPK; (+) strand; PAM type: NRG; PAM sequence: TAG
aatggaggcataacatgtcc

SEQ ID NO: 10818 - DNA, 20 bp, Artificial Sequence
  Description of Artificial Sequence: Synthetic oligonucleotide
  Target: DMPK; (+) strand; PAM type: NRG; PAM sequence: AAG
taacatgtcctagaaaaata

SEQ ID NO: 10819 - DNA, 20 bp, Artificial Sequence
  Description of Artificial Sequence: Synthetic oligonucleotide
  Target: DMPK; (+) strand; PAM type: NRG; PAM sequence: TAG
gtcctagaaaaataaagatt

SEQ ID NO: 10820 - DNA, 20 bp, Artificial Sequence
  Description of Artificial Sequence: Synthetic oligonucleotide
  Target: DMPK; (+) strand; PAM type: NRG; PAM sequence: AGG
tcctagaaaaataaagattt

SEQ ID NO: 10821 - DNA, 20 bp, Artificial Sequence
  Description of Artificial Sequence: Synthetic oligonucleotide
  Target: DMPK; (+) strand; PAM type: NRG; PAM sequence: AAG
aaataaagatttaggataca

SEQ ID NO: 10822 - DNA, 20 bp, Artificial Sequence
  Description of Artificial Sequence: Synthetic oligonucleotide
  Target: DMPK; (+) strand; PAM type: NRG; PAM sequence: AGG
aataaagatttaggatacaa

SEQ ID NO: 10823 - DNA, 20 bp, Artificial Sequence
  Description of Artificial Sequence: Synthetic oligonucleotide
  Target: DMPK; (+) strand; PAM type: NRG; PAM sequence: GAG
taaagatttaggatacaaag

SEQ ID NO: 10824 - DNA, 20 bp, Artificial Sequence
  Description of Artificial Sequence: Synthetic oligonucleotide
  Target: DMPK; (+) strand; PAM type: NRG; PAM sequence: CAG
tttaggatacaaaggagaca

SEQ ID NO: 10825 - DNA, 20 bp, Artificial Sequence
  Description of Artificial Sequence: Synthetic oligonucleotide
  Target: DMPK; (+) strand; PAM type: NRG; PAM sequence: CGG
aggatacaaaggagacacag

SEQ ID NO: 10826 - DNA, 20 bp, Artificial Sequence
  Description of Artificial Sequence: Synthetic oligonucleotide
  Target: DMPK; (+) strand; PAM type: NRG; PAM sequence: CAG
atacaaaggagacacagcgg

SEQ ID NO: 10827 - DNA, 20 bp, Artificial Sequence
  Description of Artificial Sequence: Synthetic oligonucleotide
  Target: DMPK; (+) strand; PAM type: NRG; PAM sequence: AGG
tacaaaggagacacagcggc

SEQ ID NO: 10828 - DNA, 20 bp, Artificial Sequence
  Description of Artificial Sequence: Synthetic oligonucleotide
  Target: DMPK; (+) strand; PAM type: NRG; PAM sequence: GGG
acaaaggagacacagcggca

SEQ ID NO: 10829 - DNA, 20 bp, Artificial Sequence
  Description of Artificial Sequence: Synthetic oligonucleotide
  Target: DMPK; (+) strand; PAM type: NRG; PAM sequence: CAG
cacagcggcagggctgcccc

SEQ ID NO: 10830 - DNA, 20 bp, Artificial Sequence
  Description of Artificial Sequence: Synthetic oligonucleotide
  Target: DMPK; (+) strand; PAM type: NRG; PAM sequence: AGG
acagcggcagggctgccccc

SEQ ID NO: 10831 - DNA, 20 bp, Artificial Sequence
  Description of Artificial Sequence: Synthetic oligonucleotide
  Target: DMPK; (+) strand; PAM type: NRG; PAM sequence: GGG
cagcggcagggctgccccca

SEQ ID NO: 10832 - DNA, 20 bp, Artificial Sequence
  Description of Artificial Sequence: Synthetic oligonucleotide
  Target: DMPK; (+) strand; PAM type: NRG; PAM sequence: GAG
gcagggctgcccccagggat

SEQ ID NO: 10833 - DNA, 20 bp, Artificial Sequence
  Description of Artificial Sequence: Synthetic oligonucleotide
  Target: DMPK; (+) strand; PAM type: NRG; PAM sequence: AGG
cagggctgcccccagggatg

SEQ ID NO: 10834 - DNA, 20 bp, Artificial Sequence
  Description of Artificial Sequence: Synthetic oligonucleotide
  Target: DMPK; (+) strand; PAM type: NRG; PAM sequence: GGG
agggctgcccccagggatga

SEQ ID NO: 10835 - DNA, 20 bp, Artificial Sequence
  Description of Artificial Sequence: Synthetic oligonucleotide
  Target: DMPK; (+) strand; PAM type: NRG; PAM sequence: TGG
cccagggatgagggaatctt

SEQ ID NO: 10836 - DNA, 20 bp, Artificial Sequence
  Description of Artificial Sequence: Synthetic oligonucleotide
  Target: DMPK; (+) strand; PAM type: NRG; PAM sequence: TGG
ggatgagggaatctttggtc

SEQ ID NO: 10837 - DNA, 20 bp, Artificial Sequence
  Description of Artificial Sequence: Synthetic oligonucleotide
  Target: DMPK; (+) strand; PAM type: NRG; PAM sequence: GGG
gatgagggaatctttggtct

SEQ ID NO: 10838 - DNA, 20 bp, Artificial Sequence
  Description of Artificial Sequence: Synthetic oligonucleotide
  Target: DMPK; (+) strand; PAM type: NRG; PAM sequence: CGG
agggaatctttggtctgggc

SEQ ID NO: 10839 - DNA, 20 bp, Artificial Sequence
  Description of Artificial Sequence: Synthetic oligonucleotide
  Target: DMPK; (+) strand; PAM type: NRG; PAM sequence: GAG
tttggtctgggccggataat

SEQ ID NO: 10840 - DNA, 20 bp, Artificial Sequence
  Description of Artificial Sequence: Synthetic oligonucleotide
  Target: DMPK; (+) strand; PAM type: NRG; PAM sequence: AGG
ttggtctgggccggataatg

SEQ ID NO: 10841 - DNA, 20 bp, Artificial Sequence
  Description of Artificial Sequence: Synthetic oligonucleotide
  Target: DMPK; (+) strand; PAM type: NRG; PAM sequence: AAG
ctgggccggataatgaggac

SEQ ID NO: 10842 - DNA, 20 bp, Artificial Sequence
  Description of Artificial Sequence: Synthetic oligonucleotide
  Target: DMPK; (+) strand; PAM type: NRG; PAM sequence: AGG
tgggccggataatgaggaca

SEQ ID NO: 10843 - DNA, 20 bp, Artificial Sequence
  Description of Artificial Sequence: Synthetic oligonucleotide
  Target: DMPK; (+) strand; PAM type: NRG; PAM sequence: GGG
gggccggataatgaggacaa

SEQ ID NO: 10844 - DNA, 20 bp, Artificial Sequence
  Description of Artificial Sequence: Synthetic oligonucleotide
  Target: DMPK; (+) strand; PAM type: NRG; PAM sequence: GAG
gataatgaggacaagggctt

SEQ ID NO: 10845 - DNA, 20 bp, Artificial Sequence
  Description of Artificial Sequence: Synthetic oligonucleotide
  Target: DMPK; (+) strand; PAM type: NRG; PAM sequence: GAG
tgaggacaagggcttgagtc

SEQ ID NO: 10846 - DNA, 20 bp, Artificial Sequence
  Description of Artificial Sequence: Synthetic oligonucleotide
  Target: DMPK; (+) strand; PAM type: NRG; PAM sequence: AGG
gaggacaagggcttgagtcg

SEQ ID NO: 10847 - DNA, 20 bp, Artificial Sequence
  Description of Artificial Sequence: Synthetic oligonucleotide
  Target: DMPK; (+) strand; PAM type: NRG; PAM sequence: GGG
aggacaagggcttgagtcga

SEQ ID NO: 10848 - DNA, 20 bp, Artificial Sequence
  Description of Artificial Sequence: Synthetic oligonucleotide
  Target: DMPK; (+) strand; PAM type: NRG; PAM sequence: GGG
ggacaagggcttgagtcgag

SEQ ID NO: 10849 - DNA, 20 bp, Artificial Sequence
  Description of Artificial Sequence: Synthetic oligonucleotide
  Target: DMPK; (+) strand; PAM type: NRG; PAM sequence: GAG
acaagggcttgagtcgaggg

SEQ ID NO: 10850 - DNA, 20 bp, Artificial Sequence
  Description of Artificial Sequence: Synthetic oligonucleotide
  Target: DMPK; (+) strand; PAM type: NRG; PAM sequence: TGG
gggcttgagtcgaggggagc

SEQ ID NO: 10851 - DNA, 20 bp, Artificial Sequence
  Description of Artificial Sequence: Synthetic oligonucleotide
  Target: DMPK; (+) strand; PAM type: NRG; PAM sequence: AAG
tgagtcgaggggagctggtg

SEQ ID NO: 10852 - DNA, 20 bp, Artificial Sequence
  Description of Artificial Sequence: Synthetic oligonucleotide
  Target: DMPK; (+) strand; PAM type: NRG; PAM sequence: AGG
gagtcgaggggagctggtga

SEQ ID NO: 10853 - DNA, 20 bp, Artificial Sequence
  Description of Artificial Sequence: Synthetic oligonucleotide
  Target: DMPK; (+) strand; PAM type: NRG; PAM sequence: AAG
tcgaggggagctggtgaagg

SEQ ID NO: 10854 - DNA, 20 bp, Artificial Sequence
  Description of Artificial Sequence: Synthetic oligonucleotide
  Target: DMPK; (+) strand; PAM type: NRG; PAM sequence: CAG
ggaagacccccgtctcccca

SEQ ID NO: 10855 - DNA, 20 bp, Artificial Sequence
  Description of Artificial Sequence: Synthetic oligonucleotide
  Target: DMPK; (+) strand; PAM type: NRG; PAM sequence: TGG
gctgccccaccccccgcccc

SEQ ID NO: 10856 - DNA, 20 bp, Artificial Sequence
  Description of Artificial Sequence: Synthetic oligonucleotide
  Target: DMPK; (+) strand; PAM type: NRG; PAM sequence: CAG
gccccaccccccgcccctgg

SEQ ID NO: 10857 - DNA, 20 bp, Artificial Sequence
  Description of Artificial Sequence: Synthetic oligonucleotide
  Target: DMPK; (+) strand; PAM type: NRG; PAM sequence: AGG
ccccaccccccgcccctggc

SEQ ID NO: 10858 - DNA, 20 bp, Artificial Sequence
  Description of Artificial Sequence: Synthetic oligonucleotide
  Target: DMPK; (+) strand; PAM type: NRG; PAM sequence: TGG
cctggcaggaaatgccacac

SEQ ID NO: 10859 - DNA, 20 bp, Artificial Sequence
  Description of Artificial Sequence: Synthetic oligonucleotide
  Target: DMPK; (+) strand; PAM type: NRG; PAM sequence: GGG
ctggcaggaaatgccacact

SEQ ID NO: 10860 - DNA, 20 bp, Artificial Sequence
  Description of Artificial Sequence: Synthetic oligonucleotide
  Target: DMPK; (+) strand; PAM type: NRG; PAM sequence: GGG
tggcaggaaatgccacactg

SEQ ID NO: 10861 - DNA, 20 bp, Artificial Sequence
  Description of Artificial Sequence: Synthetic oligonucleotide
  Target: DMPK; (+) strand; PAM type: NRG; PAM sequence: GAG
gcaggaaatgccacactggg

SEQ ID NO: 10862 - DNA, 20 bp, Artificial Sequence
  Description of Artificial Sequence: Synthetic oligonucleotide
  Target: DMPK; (+) strand; PAM type: NRG; PAM sequence: AGG
caggaaatgccacactgggg

SEQ ID NO: 10863 - DNA, 20 bp, Artificial Sequence
  Description of Artificial Sequence: Synthetic oligonucleotide
  Target: DMPK; (+) strand; PAM type: NRG; PAM sequence: GGG
aggaaatgccacactgggga

SEQ ID NO: 10864 - DNA, 20 bp, Artificial Sequence
  Description of Artificial Sequence: Synthetic oligonucleotide
  Target: DMPK; (+) strand; PAM type: NRG; PAM sequence: CAG
gccacactggggagggtctc

SEQ ID NO: 10865 - DNA, 20 bp, Artificial Sequence
  Description of Artificial Sequence: Synthetic oligonucleotide
  Target: DMPK; (+) strand; PAM type: NRG; PAM sequence: CAG
ctggggagggtctccagtct

SEQ ID NO: 10866 - DNA, 20 bp, Artificial Sequence
  Description of Artificial Sequence: Synthetic oligonucleotide
  Target: DMPK; (+) strand; PAM type: NRG; PAM sequence: AGG
tggggagggtctccagtctc

SEQ ID NO: 10867 - DNA, 20 bp, Artificial Sequence
  Description of Artificial Sequence: Synthetic oligonucleotide
  Target: DMPK; (+) strand; PAM type: NRG; PAM sequence: GGG
ggggagggtctccagtctca

SEQ ID NO: 10868 - DNA, 20 bp, Artificial Sequence
  Description of Artificial Sequence: Synthetic oligonucleotide
  Target: DMPK; (+) strand; PAM type: NRG; PAM sequence: GGG
gggagggtctccagtctcag

SEQ ID NO: 10869 - DNA, 20 bp, Artificial Sequence
  Description of Artificial Sequence: Synthetic oligonucleotide
  Target: DMPK; (+) strand; PAM type: NRG; PAM sequence: CGG
ggtctccagtctcaggggcg

SEQ ID NO: 10870 - DNA, 20 bp, Artificial Sequence
  Description of Artificial Sequence: Synthetic oligonucleotide
  Target: DMPK; (+) strand; PAM type: NRG; PAM sequence: GGG
gtctccagtctcaggggcgc

SEQ ID NO: 10871 - DNA, 20 bp, Artificial Sequence
  Description of Artificial Sequence: Synthetic oligonucleotide
  Target: DMPK; (+) strand; PAM type: NRG; PAM sequence: GGG
tctccagtctcaggggcgcg

SEQ ID NO: 10872 - DNA, 20 bp, Artificial Sequence
  Description of Artificial Sequence: Synthetic oligonucleotide
  Target: DMPK; (+) strand; PAM type: NRG; PAM sequence: CGG
ggctgcctgtcctccacctt

SEQ ID NO: 10873 - DNA, 20 bp, Artificial Sequence
  Description of Artificial Sequence: Synthetic oligonucleotide
  Target: DMPK; (+) strand; PAM type: NRG; PAM sequence: CAG
tgtcctccaccttcggattc

SEQ ID NO: 10874 - DNA, 20 bp, Artificial Sequence
  Description of Artificial Sequence: Synthetic oligonucleotide
  Target: DMPK; (+) strand; PAM type: NRG; PAM sequence: AGG
gtcctccaccttcggattcc

SEQ ID NO: 10875 - DNA, 20 bp, Artificial Sequence
  Description of Artificial Sequence: Synthetic oligonucleotide
  Target: DMPK; (+) strand; PAM type: NRG; PAM sequence: CAG
ctccaccttcggattccagg

SEQ ID NO: 10876 - DNA, 20 bp, Artificial Sequence
  Description of Artificial Sequence: Synthetic oligonucleotide
  Target: DMPK; (+) strand; PAM type: NRG; PAM sequence: CAG
ccaggcagttgtgacaacac

SEQ ID NO: 10877 - DNA, 20 bp, Artificial Sequence
  Description of Artificial Sequence: Synthetic oligonucleotide
  Target: DMPK; (+) strand; PAM type: NRG; PAM sequence: CGG
gttgtgacaacaccagctat

SEQ ID NO: 10878 - DNA, 20 bp, Artificial Sequence
  Description of Artificial Sequence: Synthetic oligonucleotide
  Target: DMPK; (+) strand; PAM type: NRG; PAM sequence: CAG
gtgacaacaccagctatcgg

SEQ ID NO: 10879 - DNA, 20 bp, Artificial Sequence
  Description of Artificial Sequence: Synthetic oligonucleotide
  Target: DMPK; (+) strand; PAM type: NRG; PAM sequence: GAG
gacaacaccagctatcggca

SEQ ID NO: 10880 - DNA, 20 bp, Artificial Sequence
  Description of Artificial Sequence: Synthetic oligonucleotide
  Target: DMPK; (+) strand; PAM type: NRG; PAM sequence: TAG
gctatcggcagagctattaa

SEQ ID NO: 10881 - DNA, 20 bp, Artificial Sequence
  Description of Artificial Sequence: Synthetic oligonucleotide
  Target: DMPK; (+) strand; PAM type: NRG; PAM sequence: CAG
cagagctattaatagtgttt

SEQ ID NO: 10882 - DNA, 20 bp, Artificial Sequence
  Description of Artificial Sequence: Synthetic oligonucleotide
  Target: DMPK; (+) strand; PAM type: NRG; PAM sequence: AGG
agagctattaatagtgtttc

SEQ ID NO: 10883 - DNA, 20 bp, Artificial Sequence
  Description of Artificial Sequence: Synthetic oligonucleotide
  Target: DMPK; (+) strand; PAM type: NRG; PAM sequence: GGG
gagctattaatagtgtttca

SEQ ID NO: 10884 - DNA, 20 bp, Artificial Sequence
  Description of Artificial Sequence: Synthetic oligonucleotide
  Target: DMPK; (+) strand; PAM type: NRG; PAM sequence: GAG
gctattaatagtgtttcagg

SEQ ID NO: 10885 - DNA, 20 bp, Artificial Sequence
  Description of Artificial Sequence: Synthetic oligonucleotide
  Target: DMPK; (+) strand; PAM type: NRG; PAM sequence: CAG
aatagtgtttcagggagtga

SEQ ID NO: 10886 - DNA, 20 bp, Artificial Sequence
  Description of Artificial Sequence: Synthetic oligonucleotide
  Target: DMPK; (+) strand; PAM type: NRG; PAM sequence: AGG
atagtgtttcagggagtgac

SEQ ID NO: 10887 - DNA, 20 bp, Artificial Sequence
  Description of Artificial Sequence: Synthetic oligonucleotide
  Target: DMPK; (+) strand; PAM type: NRG; PAM sequence: GGG
tagtgtttcagggagtgaca

SEQ ID NO: 10888 - DNA, 20 bp, Artificial Sequence
  Description of Artificial Sequence: Synthetic oligonucleotide
  Target: DMPK; (+) strand; PAM type: NRG; PAM sequence: GAG
gtgtttcagggagtgacagg

SEQ ID NO: 10889 - DNA, 20 bp, Artificial Sequence
  Description of Artificial Sequence: Synthetic oligonucleotide
  Target: DMPK; (+) strand; PAM type: NRG; PAM sequence: GAG
gtttcagggagtgacaggga

SEQ ID NO: 10890 - DNA, 20 bp, Artificial Sequence
  Description of Artificial Sequence: Synthetic oligonucleotide
  Target: DMPK; (+) strand; PAM type: NRG; PAM sequence: AGG
tttcagggagtgacagggag

SEQ ID NO: 10891 - DNA, 20 bp, Artificial Sequence
  Description of Artificial Sequence: Synthetic oligonucleotide
  Target: DMPK; (+) strand; PAM type: NRG; PAM sequence: GGG
ttcagggagtgacagggaga

SEQ ID NO: 10892 - DNA, 20 bp, Artificial Sequence
  Description of Artificial Sequence: Synthetic oligonucleotide
  Target: DMPK; (+) strand; PAM type: NRG; PAM sequence: TGG
gagtgacagggagagggctc

SEQ ID NO: 10893 - DNA, 20 bp, Artificial Sequence
  Description of Artificial Sequence: Synthetic oligonucleotide
  Target: DMPK; (+) strand; PAM type: NRG; PAM sequence: GGG
agtgacagggagagggctct

SEQ ID NO: 10894 - DNA, 20 bp, Artificial Sequence
  Description of Artificial Sequence: Synthetic oligonucleotide
  Target: DMPK; (+) strand; PAM type: NRG; PAM sequence: GGG
gtgacagggagagggctctg

SEQ ID NO: 10895 - DNA, 20 bp, Artificial Sequence
  Description of Artificial Sequence: Synthetic oligonucleotide
  Target: DMPK; (+) strand; PAM type: NRG; PAM sequence: GGG
tgacagggagagggctctgg

SEQ ID NO: 10896 - DNA, 20 bp, Artificial Sequence
  Description of Artificial Sequence: Synthetic oligonucleotide
  Target: DMPK; (+) strand; PAM type: NRG; PAM sequence: TGG
agggagagggctctgggggc

SEQ ID NO: 10897 - DNA, 20 bp, Artificial Sequence
  Description of Artificial Sequence: Synthetic oligonucleotide
  Target: DMPK; (+) strand; PAM type: NRG; PAM sequence: AAG
gagagggctctgggggctgg

SEQ ID NO: 10898 - DNA, 20 bp, Artificial Sequence
  Description of Artificial Sequence: Synthetic oligonucleotide
  Target: DMPK; (+) strand; PAM type: NRG; PAM sequence: CGG
ggctctgggggctggaagtc

SEQ ID NO: 10899 - DNA, 20 bp, Artificial Sequence
  Description of Artificial Sequence: Synthetic oligonucleotide
  Target: DMPK; (+) strand; PAM type: NRG; PAM sequence: TGG
gggggctggaagtccggccc

SEQ ID NO: 10900 - DNA, 20 bp, Artificial Sequence
  Description of Artificial Sequence: Synthetic oligonucleotide
  Target: DMPK; (+) strand; PAM type: NRG; PAM sequence: GGG
ggggctggaagtccggccct

SEQ ID NO: 10901 - DNA, 20 bp, Artificial Sequence
  Description of Artificial Sequence: Synthetic oligonucleotide
  Target: DMPK; (+) strand; PAM type: NRG; PAM sequence: GGG
gggctggaagtccggccctg

SEQ ID NO: 10902 - DNA, 20 bp, Artificial Sequence
  Description of Artificial Sequence: Synthetic oligonucleotide
  Target: DMPK; (+) strand; PAM type: NRG; PAM sequence: CAG
ctggaagtccggccctgggg

SEQ ID NO: 10903 - DNA, 20 bp, Artificial Sequence
  Description of Artificial Sequence: Synthetic oligonucleotide
  Target: DMPK; (+) strand; PAM type: NRG; PAM sequence: AGG
tggaagtccggccctggggc

SEQ ID NO: 10904 - DNA, 20 bp, Artificial Sequence
  Description of Artificial Sequence: Synthetic oligonucleotide
  Target: DMPK; (+) strand; PAM type: NRG; PAM sequence: GGG
ggaagtccggccctggggca

SEQ ID NO: 10905 - DNA, 20 bp, Artificial Sequence
  Description of Artificial Sequence: Synthetic oligonucleotide
  Target: DMPK; (+) strand; PAM type: NRG; PAM sequence: CAG
ggggcagggtgttccgctta

SEQ ID NO: 10906 - DNA, 20 bp, Artificial Sequence
  Description of Artificial Sequence: Synthetic oligonucleotide
  Target: DMPK; (+) strand; PAM type: NRG; PAM sequence: TAG
cagggtgttccgcttacagc

SEQ ID NO: 10907 - DNA, 20 bp, Artificial Sequence
  Description of Artificial Sequence: Synthetic oligonucleotide
  Target: DMPK; (+) strand; PAM type: NRG; PAM sequence: AAG
ttccgcttacagctagtacc

SEQ ID NO: 10908 - DNA, 20 bp, Artificial Sequence
  Description of Artificial Sequence: Synthetic oligonucleotide
  Target: DMPK; (+) strand; PAM type: NRG; PAM sequence: TGG
cgcttacagctagtaccaag

SEQ ID NO: 10909 - DNA, 20 bp, Artificial Sequence
  Description of Artificial Sequence: Synthetic oligonucleotide
  Target: DMPK; (+) strand; PAM type: NRG; PAM sequence: GAG
cttacagctagtaccaagtg

SEQ ID NO: 10910 - DNA, 20 bp, Artificial Sequence
  Description of Artificial Sequence: Synthetic oligonucleotide
  Target: DMPK; (+) strand; PAM type: NRG; PAM sequence: AGG
ttacagctagtaccaagtgg

SEQ ID NO: 10911 - DNA, 20 bp, Artificial Sequence
  Description of Artificial Sequence: Synthetic oligonucleotide
  Target: DMPK; (+) strand; PAM type: NRG; PAM sequence: GGG
tacagctagtaccaagtgga

SEQ ID NO: 10912 - DNA, 20 bp, Artificial Sequence
  Description of Artificial Sequence: Synthetic oligonucleotide
  Target: DMPK; (+) strand; PAM type: NRG; PAM sequence: GGG
acagctagtaccaagtggag

SEQ ID NO: 10913 - DNA, 20 bp, Artificial Sequence
  Description of Artificial Sequence: Synthetic oligonucleotide
  Target: DMPK; (+) strand; PAM type: NRG; PAM sequence: GGG
cagctagtaccaagtggagg

SEQ ID NO: 10914 - DNA, 20 bp, Artificial Sequence
  Description of Artificial Sequence: Synthetic oligonucleotide
  Target: DMPK; (+) strand; PAM type: NRG; PAM sequence: CAG
ctagtaccaagtggaggggg

SEQ ID NO: 10915 - DNA, 20 bp, Artificial Sequence
  Description of Artificial Sequence: Synthetic oligonucleotide
  Target: DMPK; (+) strand; PAM type: NRG; PAM sequence: AGG
tagtaccaagtggagggggc

SEQ ID NO: 10916 - DNA, 20 bp, Artificial Sequence
  Description of Artificial Sequence: Synthetic oligonucleotide
  Target: DMPK; (+) strand; PAM type: NRG; PAM sequence: GGG
agtaccaagtggagggggca

SEQ ID NO: 10917 - DNA, 20 bp, Artificial Sequence
  Description of Artificial Sequence: Synthetic oligonucleotide
  Target: DMPK; (+) strand; PAM type: NRG; PAM sequence: GAG
gtggagggggcagggcccct

SEQ ID NO: 10918 - DNA, 20 bp, Artificial Sequence
  Description of Artificial Sequence: Synthetic oligonucleotide
  Target: DMPK; (+) strand; PAM type: NRG; PAM sequence: CAG
agggggcagggcccctgagt

SEQ ID NO: 10919 - DNA, 20 bp, Artificial Sequence
  Description of Artificial Sequence: Synthetic oligonucleotide
  Target: DMPK; (+) strand; PAM type: NRG; PAM sequence: AGG
gggggcagggcccctgagtc

SEQ ID NO: 10920 - DNA, 20 bp, Artificial Sequence
  Description of Artificial Sequence: Synthetic oligonucleotide
  Target: DMPK; (+) strand; PAM type: NRG; PAM sequence: GAG
ggcccctgagtcaggaccct

SEQ ID NO: 10921 - DNA, 20 bp, Artificial Sequence
  Description of Artificial Sequence: Synthetic oligonucleotide
  Target: DMPK; (+) strand; PAM type: NRG; PAM sequence: TGG
ccctgagtcccccacgtata

SEQ ID NO: 10922 - DNA, 20 bp, Artificial Sequence
  Description of Artificial Sequence: Synthetic oligonucleotide
  Target: DMPK; (+) strand; PAM type: NRG; PAM sequence: CAG
tgagtcccccacgtatatgg

SEQ ID NO: 10923 - DNA, 20 bp, Artificial Sequence
  Description of Artificial Sequence: Synthetic oligonucleotide
  Target: DMPK; (+) strand; PAM type: NRG; PAM sequence: AGG
gagtcccccacgtatatggc

SEQ ID NO: 10924 - DNA, 20 bp, Artificial Sequence
  Description of Artificial Sequence: Synthetic oligonucleotide
  Target: DMPK; (+) strand; PAM type: NRG; PAM sequence: GGG
agtcccccacgtatatggca

SEQ ID NO: 10925 - DNA, 20 bp, Artificial Sequence
  Description of Artificial Sequence: Synthetic oligonucleotide
  Target: DMPK; (+) strand; PAM type: NRG; PAM sequence: CAG
cccacgtatatggcagggca

SEQ ID NO: 10926 - DNA, 20 bp, Artificial Sequence
  Description of Artificial Sequence: Synthetic oligonucleotide
  Target: DMPK; (+) strand; PAM type: NRG; PAM sequence: TGG
gtatatggcagggcacagca

SEQ ID NO: 10927 - DNA, 20 bp, Artificial Sequence
  Description of Artificial Sequence: Synthetic oligonucleotide
  Target: DMPK; (+) strand; PAM type: NRG; PAM sequence: GGG
tatatggcagggcacagcat

SEQ ID NO: 10928 - DNA, 20 bp, Artificial Sequence
  Description of Artificial Sequence: Synthetic oligonucleotide
  Target: DMPK; (+) strand; PAM type: NRG; PAM sequence: GGG
atatggcagggcacagcatg

SEQ ID NO: 10929 - DNA, 20 bp, Artificial Sequence
  Description of Artificial Sequence: Synthetic oligonucleotide
  Target: DMPK; (+) strand; PAM type: NRG; PAM sequence: GAG
atggcagggcacagcatggg

SEQ ID NO: 10930 - DNA, 20 bp, Artificial Sequence
  Description of Artificial Sequence: Synthetic oligonucleotide
  Target: DMPK; (+) strand; PAM type: NRG; PAM sequence: AGG
tggcagggcacagcatgggg

SEQ ID NO: 10931 - DNA, 20 bp, Artificial Sequence
  Description of Artificial Sequence: Synthetic oligonucleotide
  Target: DMPK; (+) strand; PAM type: NRG; PAM sequence: GGG
ggcagggcacagcatgggga

SEQ ID NO: 10932 - DNA, 20 bp, Artificial Sequence
  Description of Artificial Sequence: Synthetic oligonucleotide
  Target: DMPK; (+) strand; PAM type: NRG; PAM sequence: CAG
cagcatggggagggctgtaa

SEQ ID NO: 10933 - DNA, 20 bp, Artificial Sequence
  Description of Artificial Sequence: Synthetic oligonucleotide
  Target: DMPK; (+) strand; PAM type: NRG; PAM sequence: GAG
gcatggggagggctgtaaca

SEQ ID NO: 10934 - DNA, 20 bp, Artificial Sequence
  Description of Artificial Sequence: Synthetic oligonucleotide
  Target: DMPK; (+) strand; PAM type: NRG; PAM sequence: GAG
atggggagggctgtaacaga

SEQ ID NO: 10935 - DNA, 20 bp, Artificial Sequence
  Description of Artificial Sequence: Synthetic oligonucleotide
  Target: DMPK; (+) strand; PAM type: NRG; PAM sequence: AGG
tggggagggctgtaacagag

SEQ ID NO: 10936 - DNA, 20 bp, Artificial Sequence
  Description of Artificial Sequence: Synthetic oligonucleotide
  Target: DMPK; (+) strand; PAM type: NRG; PAM sequence: AAG
acagagaggcctcccatcca

SEQ ID NO: 10937 - DNA, 20 bp, Artificial Sequence
  Description of Artificial Sequence: Synthetic oligonucleotide
  Target: DMPK; (+) strand; PAM type: NRG; PAM sequence: AGG
cagagaggcctcccatccaa

SEQ ID NO: 10938 - DNA, 20 bp, Artificial Sequence
  Description of Artificial Sequence: Synthetic oligonucleotide
  Target: DMPK; (+) strand; PAM type: NRG; PAM sequence: GGG
agagaggcctcccatccaaa

SEQ ID NO: 10939 - DNA, 20 bp, Artificial Sequence
  Description of Artificial Sequence: Synthetic oligonucleotide
  Target: DMPK; (+) strand; PAM type: NRG; PAM sequence: GGG
gagaggcctcccatccaaag

SEQ ID NO: 10940 - DNA, 20 bp, Artificial Sequence
  Description of Artificial Sequence: Synthetic oligonucleotide
  Target: DMPK; (+) strand; PAM type: NRG; PAM sequence: GGG
agaggcctcccatccaaagg

SEQ ID NO: 10941 - DNA, 20 bp, Artificial Sequence
  Description of Artificial Sequence: Synthetic oligonucleotide
  Target: DMPK; (+) strand; PAM type: NRG; PAM sequence: TGG
gcctcccatccaaaggggga

SEQ ID NO: 10942 - DNA, 20 bp, Artificial Sequence
  Description of Artificial Sequence: Synthetic oligonucleotide
  Target: DMPK; (+) strand; PAM type: NRG; PAM sequence: GAG
ctcccatccaaagggggatg

SEQ ID NO: 10943 - DNA, 20 bp, Artificial Sequence
  Description of Artificial Sequence: Synthetic oligonucleotide
  Target: DMPK; (+) strand; PAM type: NRG; PAM sequence: TGG
tccaaagggggatggagacc

SEQ ID NO: 10944 - DNA, 20 bp, Artificial Sequence
  Description of Artificial Sequence: Synthetic oligonucleotide
  Target: DMPK; (+) strand; PAM type: NRG; PAM sequence: CAG
aagggggatggagacctgga

SEQ ID NO: 10945 - DNA, 20 bp, Artificial Sequence
  Description of Artificial Sequence: Synthetic oligonucleotide
  Target: DMPK; (+) strand; PAM type: NRG; PAM sequence: AGG
agggggatggagacctggac

SEQ ID NO: 10946 - DNA, 20 bp, Artificial Sequence
  Description of Artificial Sequence: Synthetic oligonucleotide
  Target: DMPK; (+) strand; PAM type: NRG; PAM sequence: GAG
ggggatggagacctggacag

SEQ ID NO: 10947 - DNA, 20 bp, Artificial Sequence
  Description of Artificial Sequence: Synthetic oligonucleotide
  Target: DMPK; (+) strand; PAM type: NRG; PAM sequence: AGG
gggatggagacctggacagg

SEQ ID NO: 10948 - DNA, 20 bp, Artificial Sequence
  Description of Artificial Sequence: Synthetic oligonucleotide
  Target: DMPK; (+) strand; PAM type: NRG; PAM sequence: TGG
atggagacctggacaggagg

SEQ ID NO: 10949 - DNA, 20 bp, Artificial Sequence
  Description of Artificial Sequence: Synthetic oligonucleotide
  Target: DMPK; (+) strand; PAM type: NRG; PAM sequence: CGG
agacctggacaggaggtggc

SEQ ID NO: 10950 - DNA, 20 bp, Artificial Sequence
  Description of Artificial Sequence: Synthetic oligonucleotide
  Target: DMPK; (+) strand; PAM type: NRG; PAM sequence: GGG
gacctggacaggaggtggcc

SEQ ID NO: 10951 - DNA, 20 bp, Artificial Sequence
  Description of Artificial Sequence: Synthetic oligonucleotide
  Target: DMPK; (+) strand; PAM type: NRG; PAM sequence: GGG
acctggacaggaggtggccg

SEQ ID NO: 10952 - DNA, 20 bp, Artificial Sequence
  Description of Artificial Sequence: Synthetic oligonucleotide
  Target: DMPK; (+) strand; PAM type: NRG; PAM sequence: CAG
gtggccggggatacaacccc

SEQ ID NO: 10953 - DNA, 20 bp, Artificial Sequence
  Description of Artificial Sequence: Synthetic oligonucleotide
  Target: DMPK; (+) strand; PAM type: NRG; PAM sequence: CAG
gatacaacccccagcaccac

SEQ ID NO: 10954 - DNA, 20 bp, Artificial Sequence
  Description of Artificial Sequence: Synthetic oligonucleotide
  Target: DMPK; (+) strand; PAM type: NRG; PAM sequence: AGG
atacaacccccagcaccacc

SEQ ID NO: 10955 - DNA, 20 bp, Artificial Sequence
  Description of Artificial Sequence: Synthetic oligonucleotide
  Target: DMPK; (+) strand; PAM type: NRG; PAM sequence: GGG
tacaacccccagcaccacca

SEQ ID NO: 10956 - DNA, 20 bp, Artificial Sequence
  Description of Artificial Sequence: Synthetic oligonucleotide
  Target: DMPK; (+) strand; PAM type: NRG; PAM sequence: TGG
cccccagcaccaccagggct

SEQ ID NO: 10957 - DNA, 20 bp, Artificial Sequence
  Description of Artificial Sequence: Synthetic oligonucleotide
  Target: DMPK; (+) strand; PAM type: NRG; PAM sequence: GAG
cccagcaccaccagggcttg

SEQ ID NO: 10958 - DNA, 20 bp, Artificial Sequence
  Description of Artificial Sequence: Synthetic oligonucleotide
  Target: DMPK; (+) strand; PAM type: NRG; PAM sequence: GAG
cagcaccaccagggcttgga

SEQ ID NO: 10959 - DNA, 20 bp, Artificial Sequence
  Description of Artificial Sequence: Synthetic oligonucleotide
  Target: DMPK; (+) strand; PAM type: NRG; PAM sequence: AGG
agcaccaccagggcttggag

SEQ ID NO: 10960 - DNA, 20 bp, Artificial Sequence
  Description of Artificial Sequence: Synthetic oligonucleotide
  Target: DMPK; (+) strand; PAM type: NRG; PAM sequence: CAG
cagggcttggagaggccacc

SEQ ID NO: 10961 - DNA, 20 bp, Artificial Sequence
  Description of Artificial Sequence: Synthetic oligonucleotide
  Target: DMPK; (+) strand; PAM type: NRG; PAM sequence: AGG
agggcttggagaggccaccc

SEQ ID NO: 10962 - DNA, 20 bp, Artificial Sequence
  Description of Artificial Sequence: Synthetic oligonucleotide
  Target: DMPK; (+) strand; PAM type: NRG; PAM sequence: CAG
gcttggagaggccacccagg

SEQ ID NO: 10963 - DNA, 20 bp, Artificial Sequence
  Description of Artificial Sequence: Synthetic oligonucleotide
  Target: DMPK; (+) strand; PAM type: NRG; PAM sequence: AAG
tggagaggccacccaggcag

SEQ ID NO: 10964 - DNA, 20 bp, Artificial Sequence
  Description of Artificial Sequence: Synthetic oligonucleotide
  Target: DMPK; (+) strand; PAM type: NRG; PAM sequence: AGG
ggagaggccacccaggcaga

SEQ ID NO: 10965 - DNA, 20 bp, Artificial Sequence
  Description of Artificial Sequence: Synthetic oligonucleotide
  Target: DMPK; (+) strand; PAM type: NRG; PAM sequence: TGG
gccacccaggcagaaggatg

SEQ ID NO: 10966 - DNA, 20 bp, Artificial Sequence
  Description of Artificial Sequence: Synthetic oligonucleotide
  Target: DMPK; (+) strand; PAM type: NRG; PAM sequence: TGG
aggcagaaggatgtggtgac

SEQ ID NO: 10967 - DNA, 20 bp, Artificial Sequence
  Description of Artificial Sequence: Synthetic oligonucleotide
  Target: DMPK; (+) strand; PAM type: NRG; PAM sequence: GGG
ggcagaaggatgtggtgact

SEQ ID NO: 10968 - DNA, 20 bp, Artificial Sequence
  Description of Artificial Sequence: Synthetic oligonucleotide
  Target: DMPK; (+) strand; PAM type: NRG; PAM sequence: GGG
gcagaaggatgtggtgactg

SEQ ID NO: 10969 - DNA, 20 bp, Artificial Sequence
  Description of Artificial Sequence: Synthetic oligonucleotide
  Target: DMPK; (+) strand; PAM type: NRG; PAM sequence: CAG
gatgtggtgactggggtctt

SEQ ID NO: 10970 - DNA, 20 bp, Artificial Sequence
  Description of Artificial Sequence: Synthetic oligonucleotide
  Target: DMPK; (+) strand; PAM type: NRG; PAM sequence: TGG
gtcttcagcaaccgcatttc

SEQ ID NO: 10971 - DNA, 20 bp, Artificial Sequence
  Description of Artificial Sequence: Synthetic oligonucleotide
  Target: DMPK; (+) strand; PAM type: NRG; PAM sequence: GGG
tcttcagcaaccgcatttct

SEQ ID NO: 10972 - DNA, 20 bp, Artificial Sequence
  Description of Artificial Sequence: Synthetic oligonucleotide
  Target: DMPK; (+) strand; PAM type: NRG; PAM sequence: GGG
cttcagcaaccgcatttctg

SEQ ID NO: 10973 - DNA, 20 bp, Artificial Sequence
  Description of Artificial Sequence: Synthetic oligonucleotide
  Target: DMPK; (+) strand; PAM type: NRG; PAM sequence: CAG
cattcctgtccctgcgtctt

SEQ ID NO: 10974 - DNA, 20 bp, Artificial Sequence
  Description of Artificial Sequence: Synthetic oligonucleotide
  Target: DMPK; (+) strand; PAM type: NRG; PAM sequence: CGG
tgcgtcttcagcaccaatgt

SEQ ID NO: 10975 - DNA, 20 bp, Artificial Sequence
  Description of Artificial Sequence: Synthetic oligonucleotide
  Target: DMPK; (+) strand; PAM type: NRG; PAM sequence: GGG
gcgtcttcagcaccaatgtc

SEQ ID NO: 10976 - DNA, 20 bp, Artificial Sequence
  Description of Artificial Sequence: Synthetic oligonucleotide
  Target: DMPK; (+) strand; PAM type: NRG; PAM sequence: GAG
gtcttcagcaccaatgtcgg

SEQ ID NO: 10977 - DNA, 20 bp, Artificial Sequence
  Description of Artificial Sequence: Synthetic oligonucleotide
  Target: DMPK; (+) strand; PAM type: NRG; PAM sequence: GAG
cttcagcaccaatgtcggga

SEQ ID NO: 10978 - DNA, 20 bp, Artificial Sequence
  Description of Artificial Sequence: Synthetic oligonucleotide
  Target: DMPK; (+) strand; PAM type: NRG; PAM sequence: AGG
ttcagcaccaatgtcgggag

SEQ ID NO: 10979 - DNA, 20 bp, Artificial Sequence
  Description of Artificial Sequence: Synthetic oligonucleotide
  Target: DMPK; (+) strand; PAM type: NRG; PAM sequence: CGG
accaatgtcgggagaggcca

SEQ ID NO: 10980 - DNA, 20 bp, Artificial Sequence
  Description of Artificial Sequence: Synthetic oligonucleotide
  Target: DMPK; (+) strand; PAM type: NRG; PAM sequence: GGG
ccaatgtcgggagaggccac

SEQ ID NO: 10981 - DNA, 20 bp, Artificial Sequence
  Description of Artificial Sequence: Synthetic oligonucleotide
  Target: DMPK; (+) strand; PAM type: NRG; PAM sequence: GGG
caatgtcgggagaggccacg

SEQ ID NO: 10982 - DNA, 20 bp, Artificial Sequence
  Description of Artificial Sequence: Synthetic oligonucleotide
  Target: DMPK; (+) strand; PAM type: NRG; PAM sequence: TGG
gagaggccacggggccacac

SEQ ID NO: 10983 - DNA, 20 bp, Artificial Sequence
  Description of Artificial Sequence: Synthetic oligonucleotide
  Target: DMPK; (+) strand; PAM type: NRG; PAM sequence: GGG
agaggccacggggccacact

SEQ ID NO: 10984 - DNA, 20 bp, Artificial Sequence
  Description of Artificial Sequence: Synthetic oligonucleotide
  Target: DMPK; (+) strand; PAM type: NRG; PAM sequence: CAG
cacggggccacactgggtca

SEQ ID NO: 10985 - DNA, 20 bp, Artificial Sequence
  Description of Artificial Sequence: Synthetic oligonucleotide
  Target: DMPK; (+) strand; PAM type: NRG; PAM sequence: AAG
ccacactgggtcacagttcc

SEQ ID NO: 10986 - DNA, 20 bp, Artificial Sequence
  Description of Artificial Sequence: Synthetic oligonucleotide
  Target: DMPK; (+) strand; PAM type: NRG; PAM sequence: AGG
cacactgggtcacagttcca

SEQ ID NO: 10987 - DNA, 20 bp, Artificial Sequence
  Description of Artificial Sequence: Synthetic oligonucleotide
  Target: DMPK; (+) strand; PAM type: NRG; PAM sequence: GGG
acactgggtcacagttccaa

SEQ ID NO: 10988 - DNA, 20 bp, Artificial Sequence
  Description of Artificial Sequence: Synthetic oligonucleotide
  Target: DMPK; (+) strand; PAM type: NRG; PAM sequence: CAG
cagttccaagggctcctcca

SEQ ID NO: 10989 - DNA, 20 bp, Artificial Sequence
  Description of Artificial Sequence: Synthetic oligonucleotide
  Target: DMPK; (+) strand; PAM type: NRG; PAM sequence: AGG
agttccaagggctcctccac

SEQ ID NO: 10990 - DNA, 20 bp, Artificial Sequence
  Description of Artificial Sequence: Synthetic oligonucleotide
  Target: DMPK; (+) strand; PAM type: NRG; PAM sequence: TGG
gctcctccacaggcaccgac

SEQ ID NO: 10991 - DNA, 20 bp, Artificial Sequence
  Description of Artificial Sequence: Synthetic oligonucleotide
  Target: DMPK; (+) strand; PAM type: NRG; PAM sequence: GAG
tcctccacaggcaccgactg

SEQ ID NO: 10992 - DNA, 20 bp, Artificial Sequence
  Description of Artificial Sequence: Synthetic oligonucleotide
  Target: DMPK; (+) strand; PAM type: NRG; PAM sequence: TGG
ccacaggcaccgactggagc

SEQ ID NO: 10993 - DNA, 20 bp, Artificial Sequence
  Description of Artificial Sequence: Synthetic oligonucleotide
  Target: DMPK; (+) strand; PAM type: NRG; PAM sequence: GGG
cacaggcaccgactggagct

SEQ ID NO: 10994 - DNA, 20 bp, Artificial Sequence
  Description of Artificial Sequence: Synthetic oligonucleotide
  Target: DMPK; (+) strand; PAM type: NRG; PAM sequence: CAG
ggcaccgactggagctgggt

SEQ ID NO: 10995 - DNA, 20 bp, Artificial Sequence
  Description of Artificial Sequence: Synthetic oligonucleotide
  Target: DMPK; (+) strand; PAM type: NRG; PAM sequence: TGG
ctggagctgggtcagaacct

SEQ ID NO: 10996 - DNA, 20 bp, Artificial Sequence
  Description of Artificial Sequence: Synthetic oligonucleotide
  Target: DMPK; (+) strand; PAM type: NRG; PAM sequence: CAG
ctgggtcagaaccttggcct

SEQ ID NO: 10997 - DNA, 20 bp, Artificial Sequence
  Description of Artificial Sequence: Synthetic oligonucleotide
  Target: DMPK; (+) strand; PAM type: NRG; PAM sequence: CGG
ctcgtcaacctcaccccctg

SEQ ID NO: 10998 - DNA, 20 bp, Artificial Sequence
  Description of Artificial Sequence: Synthetic oligonucleotide
  Target: DMPK; (+) strand; PAM type: NRG; PAM sequence: TGG
gtcaacctcaccccctgcgg

SEQ ID NO: 10999 - DNA, 20 bp, Artificial Sequence
  Description of Artificial Sequence: Synthetic oligonucleotide
  Target: DMPK; (+) strand; PAM type: NRG; PAM sequence: CAG
tcaccccctgcggtggcccc

SEQ ID NO: 11000 - DNA, 20 bp, Artificial Sequence
  Description of Artificial Sequence: Synthetic oligonucleotide
  Target: DMPK; (+) strand; PAM type: NRG; PAM sequence: AGG
caccccctgcggtggccccc

SEQ ID NO: 11001 - DNA, 20 bp, Artificial Sequence
  Description of Artificial Sequence: Synthetic oligonucleotide
  Target: DMPK; (+) strand; PAM type: NRG; PAM sequence: GAG
ccccctgcggtggcccccag

SEQ ID NO: 11002 - DNA, 20 bp, Artificial Sequence
  Description of Artificial Sequence: Synthetic oligonucleotide
  Target: DMPK; (+) strand; PAM type: NRG; PAM sequence: CAG
cctgcggtggcccccaggag

SEQ ID NO: 11003 - DNA, 20 bp, Artificial Sequence
  Description of Artificial Sequence: Synthetic oligonucleotide
  Target: DMPK; (+) strand; PAM type: NRG; PAM sequence: CAG
ggcccccaggagcagcccct

SEQ ID NO: 11004 - DNA, 20 bp, Artificial Sequence
  Description of Artificial Sequence: Synthetic oligonucleotide
  Target: DMPK; (+) strand; PAM type: NRG; PAM sequence: AGG
gcccccaggagcagcccctc

SEQ ID NO: 11005 - DNA, 20 bp, Artificial Sequence
  Description of Artificial Sequence: Synthetic oligonucleotide
  Target: DMPK; (+) strand; PAM type: NRG; PAM sequence: GGG
cccccaggagcagcccctca

SEQ ID NO: 11006 - DNA, 20 bp, Artificial Sequence
  Description of Artificial Sequence: Synthetic oligonucleotide
  Target: DMPK; (+) strand; PAM type: NRG; PAM sequence: CGG
caggagcagcccctcagggt

SEQ ID NO: 11007 - DNA, 20 bp, Artificial Sequence
  Description of Artificial Sequence: Synthetic oligonucleotide
  Target: DMPK; (+) strand; PAM type: NRG; PAM sequence: GGG
aggagcagcccctcagggtc

SEQ ID NO: 11008 - DNA, 20 bp, Artificial Sequence
  Description of Artificial Sequence: Synthetic oligonucleotide
  Target: DMPK; (+) strand; PAM type: NRG; PAM sequence: GGG
ggagcagcccctcagggtcg

SEQ ID NO: 11009 - DNA, 20 bp, Artificial Sequence
  Description of Artificial Sequence: Synthetic oligonucleotide
  Target: DMPK; (+) strand; PAM type: NRG; PAM sequence: TGG
agcccctcagggtcggggtc

SEQ ID NO: 11010 - DNA, 20 bp, Artificial Sequence
  Description of Artificial Sequence: Synthetic oligonucleotide
  Target: DMPK; (+) strand; PAM type: NRG; PAM sequence: CAG
ccctcagggtcggggtctgg

SEQ ID NO: 11011 - DNA, 20 bp, Artificial Sequence
  Description of Artificial Sequence: Synthetic oligonucleotide
  Target: DMPK; (+) strand; PAM type: NRG; PAM sequence: CAG
gggtcggggtctggcagcct

SEQ ID NO: 11012 - DNA, 20 bp, Artificial Sequence
  Description of Artificial Sequence: Synthetic oligonucleotide
  Target: DMPK; (+) strand; PAM type: NRG; PAM sequence: CGG
ggggtctggcagcctcagca

SEQ ID NO: 11013 - DNA, 20 bp, Artificial Sequence
  Description of Artificial Sequence: Synthetic oligonucleotide
  Target: DMPK; (+) strand; PAM type: NRG; PAM sequence: TGG
ctggcagcctcagcacggtg

SEQ ID NO: 11014 - DNA, 20 bp, Artificial Sequence
  Description of Artificial Sequence: Synthetic oligonucleotide
  Target: DMPK; (+) strand; PAM type: NRG; PAM sequence: GGG
tggcagcctcagcacggtgt

SEQ ID NO: 11015 - DNA, 20 bp, Artificial Sequence
  Description of Artificial Sequence: Synthetic oligonucleotide
  Target: DMPK; (+) strand; PAM type: NRG; PAM sequence: GGG
ggcagcctcagcacggtgtg

SEQ ID NO: 11016 - DNA, 20 bp, Artificial Sequence
  Description of Artificial Sequence: Synthetic oligonucleotide
  Target: DMPK; (+) strand; PAM type: NRG; PAM sequence: GGG
gcagcctcagcacggtgtgg

SEQ ID NO: 11017 - DNA, 20 bp, Artificial Sequence
  Description of Artificial Sequence: Synthetic oligonucleotide
  Target: DMPK; (+) strand; PAM type: NRG; PAM sequence: GGG
cagcctcagcacggtgtggg

SEQ ID NO: 11018 - DNA, 20 bp, Artificial Sequence
  Description of Artificial Sequence: Synthetic oligonucleotide
  Target: DMPK; (+) strand; PAM type: NRG; PAM sequence: CAG
gtgtggggggcctgtgtccc

SEQ ID NO: 11019 - DNA, 20 bp, Artificial Sequence
  Description of Artificial Sequence: Synthetic oligonucleotide
  Target: DMPK; (+) strand; PAM type: NRG; PAM sequence: CAG
cccagccccttttccgcttc

SEQ ID NO: 11020 - DNA, 20 bp, Artificial Sequence
  Description of Artificial Sequence: Synthetic oligonucleotide
  Target: DMPK; (+) strand; PAM type: NRG; PAM sequence: CAG
agccccttttccgcttccag

SEQ ID NO: 11021 - DNA, 20 bp, Artificial Sequence
  Description of Artificial Sequence: Synthetic oligonucleotide
  Target: DMPK; (+) strand; PAM type: NRG; PAM sequence: TAG
agcccctctgttcctgcgct

SEQ ID NO: 11022 - DNA, 20 bp, Artificial Sequence
  Description of Artificial Sequence: Synthetic oligonucleotide
  Target: DMPK; (+) strand; PAM type: NRG; PAM sequence: CAG
tctgttcctgcgcttagttc

SEQ ID NO: 11023 - DNA, 20 bp, Artificial Sequence
  Description of Artificial Sequence: Synthetic oligonucleotide
  Target: DMPK; (+) strand; PAM type: NRG; PAM sequence: CAG
ttagttccagccctgctgac

SEQ ID NO: 11024 - DNA, 20 bp, Artificial Sequence
  Description of Artificial Sequence: Synthetic oligonucleotide
  Target: DMPK; (+) strand; PAM type: NRG; PAM sequence: CAG
ttccagccctgctgaccaga

SEQ ID NO: 11025 - DNA, 20 bp, Artificial Sequence
  Description of Artificial Sequence: Synthetic oligonucleotide
  Target: DMPK; (+) strand; PAM type: NRG; PAM sequence: AGG
tccagccctgctgaccagac

SEQ ID NO: 11026 - DNA, 20 bp, Artificial Sequence
  Description of Artificial Sequence: Synthetic oligonucleotide
  Target: DMPK; (+) strand; PAM type: NRG; PAM sequence: CGG
ccctgctgaccagacaggca

SEQ ID NO: 11027 - DNA, 20 bp, Artificial Sequence
  Description of Artificial Sequence: Synthetic oligonucleotide
  Target: DMPK; (+) strand; PAM type: NRG; PAM sequence: CGG
tgaccagacaggcacggccg

SEQ ID NO: 11028 - DNA, 20 bp, Artificial Sequence
  Description of Artificial Sequence: Synthetic oligonucleotide
  Target: DMPK; (+) strand; PAM type: NRG; PAM sequence: GGG
gaccagacaggcacggccgc

SEQ ID NO: 11029 - DNA, 20 bp, Artificial Sequence
  Description of Artificial Sequence: Synthetic oligonucleotide
  Target: DMPK; (+) strand; PAM type: NRG; PAM sequence: CAG
acggccgcgggtgacaacat

SEQ ID NO: 11030 - DNA, 20 bp, Artificial Sequence
  Description of Artificial Sequence: Synthetic oligonucleotide
  Target: DMPK; (+) strand; PAM type: NRG; PAM sequence: TGG
ggtgacaacatcagcccctc

SEQ ID NO: 11031 - DNA, 20 bp, Artificial Sequence
  Description of Artificial Sequence: Synthetic oligonucleotide
  Target: DMPK; (+) strand; PAM type: NRG; PAM sequence: TGG
gacaacatcagcccctctgg

SEQ ID NO: 11032 - DNA, 20 bp, Artificial Sequence
  Description of Artificial Sequence: Synthetic oligonucleotide
  Target: DMPK; (+) strand; PAM type: NRG; PAM sequence: GGG
acaacatcagcccctctggt

SEQ ID NO: 11033 - DNA, 20 bp, Artificial Sequence
  Description of Artificial Sequence: Synthetic oligonucleotide
  Target: DMPK; (+) strand; PAM type: NRG; PAM sequence: GGG
caacatcagcccctctggtg

SEQ ID NO: 11034 - DNA, 20 bp, Artificial Sequence
  Description of Artificial Sequence: Synthetic oligonucleotide
  Target: DMPK; (+) strand; PAM type: NRG; PAM sequence: GGG
aacatcagcccctctggtgg

SEQ ID NO: 11035 - DNA, 20 bp, Artificial Sequence
  Description of Artificial Sequence: Synthetic oligonucleotide
  Target: DMPK; (+) strand; PAM type: NRG; PAM sequence: CGG
agcccctctggtgggggcgc

SEQ ID NO: 11036 - DNA, 20 bp, Artificial Sequence
  Description of Artificial Sequence: Synthetic oligonucleotide
  Target: DMPK; (+) strand; PAM type: NRG; PAM sequence: GGG
gcccctctggtgggggcgcc

SEQ ID NO: 11037 - DNA, 20 bp, Artificial Sequence
  Description of Artificial Sequence: Synthetic oligonucleotide
  Target: DMPK; (+) strand; PAM type: NRG; PAM sequence: AAG
cctctggtgggggcgccggg

SEQ ID NO: 11038 - DNA, 20 bp, Artificial Sequence
  Description of Artificial Sequence: Synthetic oligonucleotide
  Target: DMPK; (+) strand; PAM type: NRG; PAM sequence: TGG
tggtgggggcgccgggaagt

SEQ ID NO: 11039 - DNA, 20 bp, Artificial Sequence
  Description of Artificial Sequence: Synthetic oligonucleotide
  Target: DMPK; (+) strand; PAM type: NRG; PAM sequence: GGG
ggtgggggcgccgggaagtt

SEQ ID NO: 11040 - DNA, 20 bp, Artificial Sequence
  Description of Artificial Sequence: Synthetic oligonucleotide
  Target: DMPK; (+) strand; PAM type: NRG; PAM sequence: CAG
gggggcgccgggaagttggg

SEQ ID NO: 11041 - DNA, 20 bp, Artificial Sequence
  Description of Artificial Sequence: Synthetic oligonucleotide
  Target: DMPK; (+) strand; PAM type: NRG; PAM sequence: AGG
ggggcgccgggaagttgggc

SEQ ID NO: 11042 - DNA, 20 bp, Artificial Sequence
  Description of Artificial Sequence: Synthetic oligonucleotide
  Target: DMPK; (+) strand; PAM type: NRG; PAM sequence: GAG
ggcgccgggaagttgggcag

SEQ ID NO: 11043 - DNA, 20 bp, Artificial Sequence
  Description of Artificial Sequence: Synthetic oligonucleotide
  Target: DMPK; (+) strand; PAM type: NRG; PAM sequence: AGG
gcgccgggaagttgggcagg

SEQ ID NO: 11044 - DNA, 20 bp, Artificial Sequence
  Description of Artificial Sequence: Synthetic oligonucleotide
  Target: DMPK; (+) strand; PAM type: NRG; PAM sequence: CAG
cgggaagttgggcaggaggc

SEQ ID NO: 11045 - DNA, 20 bp, Artificial Sequence
  Description of Artificial Sequence: Synthetic oligonucleotide
  Target: DMPK; (+) strand; PAM type: NRG; PAM sequence: AGG
gggaagttgggcaggaggcc

SEQ ID NO: 11046 - DNA, 20 bp, Artificial Sequence
  Description of Artificial Sequence: Synthetic oligonucleotide
  Target: DMPK; (+) strand; PAM type: NRG; PAM sequence: GGG
ggaagttgggcaggaggcca

SEQ ID NO: 11047 - DNA, 20 bp, Artificial Sequence
  Description of Artificial Sequence: Synthetic oligonucleotide
  Target: DMPK; (+) strand; PAM type: NRG; PAM sequence: GGG
gaagttgggcaggaggccag

SEQ ID NO: 11048 - DNA, 20 bp, Artificial Sequence
  Description of Artificial Sequence: Synthetic oligonucleotide
  Target: DMPK; (+) strand; PAM type: NRG; PAM sequence: GAG
agttgggcaggaggccaggg

SEQ ID NO: 11049 - DNA, 20 bp, Artificial Sequence
  Description of Artificial Sequence: Synthetic oligonucleotide
  Target: DMPK; (+) strand; PAM type: NRG; PAM sequence: CAG
gggcaggaggccaggggagt

SEQ ID NO: 11050 - DNA, 20 bp, Artificial Sequence
  Description of Artificial Sequence: Synthetic oligonucleotide
  Target: DMPK; (+) strand; PAM type: NRG; PAM sequence: AGG
ggcaggaggccaggggagtc

SEQ ID NO: 11051 - DNA, 20 bp, Artificial Sequence
  Description of Artificial Sequence: Synthetic oligonucleotide
  Target: DMPK; (+) strand; PAM type: NRG; PAM sequence: GGG
gcaggaggccaggggagtca

SEQ ID NO: 11052 - DNA, 20 bp, Artificial Sequence
  Description of Artificial Sequence: Synthetic oligonucleotide
  Target: DMPK; (+) strand; PAM type: NRG; PAM sequence: GGG
caggaggccaggggagtcag

SEQ ID NO: 11053 - DNA, 20 bp, Artificial Sequence
  Description of Artificial Sequence: Synthetic oligonucleotide
  Target: DMPK; (+) strand; PAM type: NRG; PAM sequence: GAG
ggaggccaggggagtcaggg

SEQ ID NO: 11054 - DNA, 20 bp, Artificial Sequence
  Description of Artificial Sequence: Synthetic oligonucleotide
  Target: DMPK; (+) strand; PAM type: NRG; PAM sequence: AAG
ggccaggggagtcaggggag

SEQ ID NO: 11055 - DNA, 20 bp, Artificial Sequence
  Description of Artificial Sequence: Synthetic oligonucleotide
  Target: DMPK; (+) strand; PAM type: NRG; PAM sequence: AGG
gccaggggagtcaggggaga

SEQ ID NO: 11056 - DNA, 20 bp, Artificial Sequence
  Description of Artificial Sequence: Synthetic oligonucleotide
  Target: DMPK; (+) strand; PAM type: NRG; PAM sequence: GGG
ccaggggagtcaggggagaa

SEQ ID NO: 11057 - DNA, 20 bp, Artificial Sequence
  Description of Artificial Sequence: Synthetic oligonucleotide
  Target: DMPK; (+) strand; PAM type: NRG; PAM sequence: CAG
ggggagtcaggggagaaggg

SEQ ID NO: 11058 - DNA, 20 bp, Artificial Sequence
  Description of Artificial Sequence: Synthetic oligonucleotide
  Target: DMPK; (+) strand; PAM type: NRG; PAM sequence: AGG
gggagtcaggggagaagggc

SEQ ID NO: 11059 - DNA, 20 bp, Artificial Sequence
  Description of Artificial Sequence: Synthetic oligonucleotide
  Target: DMPK; (+) strand; PAM type: NRG; PAM sequence: TGG
gtcaggggagaagggcaggc

SEQ ID NO: 11060 - DNA, 20 bp, Artificial Sequence
  Description of Artificial Sequence: Synthetic oligonucleotide
  Target: DMPK; (+) strand; PAM type: NRG; PAM sequence: TGG
ggagaagggcaggctggtgc

SEQ ID NO: 11061 - DNA, 20 bp, Artificial Sequence
  Description of Artificial Sequence: Synthetic oligonucleotide
  Target: DMPK; (+) strand; PAM type: NRG; PAM sequence: GAG
agaagggcaggctggtgctg

SEQ ID NO: 11062 - DNA, 20 bp, Artificial Sequence
  Description of Artificial Sequence: Synthetic oligonucleotide
  Target: DMPK; (+) strand; PAM type: NRG; PAM sequence: AGG
gaagggcaggctggtgctgg

SEQ ID NO: 11063 - DNA, 20 bp, Artificial Sequence
  Description of Artificial Sequence: Synthetic oligonucleotide
  Target: DMPK; (+) strand; PAM type: NRG; PAM sequence: TGG
gggcaggctggtgctggagg

SEQ ID NO: 11064 - DNA, 20 bp, Artificial Sequence
  Description of Artificial Sequence: Synthetic oligonucleotide
  Target: DMPK; (+) strand; PAM type: NRG; PAM sequence: TGG
caggctggtgctggaggtgg

SEQ ID NO: 11065 - DNA, 20 bp, Artificial Sequence
  Description of Artificial Sequence: Synthetic oligonucleotide
  Target: DMPK; (+) strand; PAM type: NRG; PAM sequence: CAG
gctggtgctggaggtggtgg

SEQ ID NO: 11066 - DNA, 20 bp, Artificial Sequence
  Description of Artificial Sequence: Synthetic oligonucleotide
  Target: DMPK; (+) strand; PAM type: NRG; PAM sequence: CGG
ggtgctggaggtggtggcag

SEQ ID NO: 11067 - DNA, 20 bp, Artificial Sequence
  Description of Artificial Sequence: Synthetic oligonucleotide
  Target: DMPK; (+) strand; PAM type: NRG; PAM sequence: CGG
gctggaggtggtggcagcgg

SEQ ID NO: 11068 - DNA, 20 bp, Artificial Sequence
  Description of Artificial Sequence: Synthetic oligonucleotide
  Target: DMPK; (+) strand; PAM type: NRG; PAM sequence: GGG
ctggaggtggtggcagcggc

SEQ ID NO: 11069 - DNA, 20 bp, Artificial Sequence
  Description of Artificial Sequence: Synthetic oligonucleotide
  Target: DMPK; (+) strand; PAM type: NRG; PAM sequence: GGG
tggaggtggtggcagcggcg

SEQ ID NO: 11070 - DNA, 20 bp, Artificial Sequence
  Description of Artificial Sequence: Synthetic oligonucleotide
  Target: DMPK; (+) strand; PAM type: NRG; PAM sequence: GGG
ggaggtggtggcagcggcgg

SEQ ID NO: 11071 - DNA, 20 bp, Artificial Sequence
  Description of Artificial Sequence: Synthetic oligonucleotide
  Target: DMPK; (+) strand; PAM type: NRG; PAM sequence: GGG
gaggtggtggcagcggcggg

SEQ ID NO: 11072 - DNA, 20 bp, Artificial Sequence
  Description of Artificial Sequence: Synthetic oligonucleotide
  Target: DMPK; (+) strand; PAM type: NRG; PAM sequence: TGG
gtggtggcagcggcgggggg

SEQ ID NO: 11073 - DNA, 20 bp, Artificial Sequence
  Description of Artificial Sequence: Synthetic oligonucleotide
  Target: DMPK; (+) strand; PAM type: NRG; PAM sequence: CAG
ggcggggggtggctgctgtg

SEQ ID NO: 11074 - DNA, 20 bp, Artificial Sequence
  Description of Artificial Sequence: Synthetic oligonucleotide
  Target: DMPK; (+) strand; PAM type: NRG; PAM sequence: AAG
gggggtggctgctgtgcaga

SEQ ID NO: 11075 - DNA, 20 bp, Artificial Sequence
  Description of Artificial Sequence: Synthetic oligonucleotide
  Target: DMPK; (+) strand; PAM type: NRG; PAM sequence: AGG
ggggtggctgctgtgcagaa

SEQ ID NO: 11076 - DNA, 20 bp, Artificial Sequence
  Description of Artificial Sequence: Synthetic oligonucleotide
  Target: DMPK; (+) strand; PAM type: NRG; PAM sequence: GGG
gggtggctgctgtgcagaaa

SEQ ID NO: 11077 - DNA, 20 bp, Artificial Sequence
  Description of Artificial Sequence: Synthetic oligonucleotide
  Target: DMPK; (+) strand; PAM type: NRG; PAM sequence: TAG
tgctgtgcagaaagggtgcc

SEQ ID NO: 11078 - DNA, 20 bp, Artificial Sequence
  Description of Artificial Sequence: Synthetic oligonucleotide
  Target: DMPK; (+) strand; PAM type: NRG; PAM sequence: AGG
gctgtgcagaaagggtgcct

SEQ ID NO: 11079 - DNA, 20 bp, Artificial Sequence
  Description of Artificial Sequence: Synthetic oligonucleotide
  Target: DMPK; (+) strand; PAM type: NRG; PAM sequence: GGG
ctgtgcagaaagggtgccta

SEQ ID NO: 11080 - DNA, 20 bp, Artificial Sequence
  Description of Artificial Sequence: Synthetic oligonucleotide
  Target: DMPK; (+) strand; PAM type: NRG; PAM sequence: GAG
agaaagggtgcctagggcgt

SEQ ID NO: 11081 - DNA, 20 bp, Artificial Sequence
  Description of Artificial Sequence: Synthetic oligonucleotide
  Target: DMPK; (+) strand; PAM type: NRG; PAM sequence: TGG
gtgcctagggcgtgagcctc

SEQ ID NO: 11082 - DNA, 20 bp, Artificial Sequence
  Description of Artificial Sequence: Synthetic oligonucleotide
  Target: DMPK; (+) strand; PAM type: NRG; PAM sequence: GGG
tgcctagggcgtgagcctct

SEQ ID NO: 11083 - DNA, 20 bp, Artificial Sequence
  Description of Artificial Sequence: Synthetic oligonucleotide
  Target: DMPK; (+) strand; PAM type: NRG; PAM sequence: GAG
cctagggcgtgagcctctgg

SEQ ID NO: 11084 - DNA, 20 bp, Artificial Sequence
  Description of Artificial Sequence: Synthetic oligonucleotide
  Target: DMPK; (+) strand; PAM type: NRG; PAM sequence: GAG
tagggcgtgagcctctggga

SEQ ID NO: 11085 - DNA, 20 bp, Artificial Sequence
  Description of Artificial Sequence: Synthetic oligonucleotide
  Target: DMPK; (+) strand; PAM type: NRG; PAM sequence: CAG
ggcgtgagcctctgggagag

SEQ ID NO: 11086 - DNA, 20 bp, Artificial Sequence
  Description of Artificial Sequence: Synthetic oligonucleotide
  Target: DMPK; (+) strand; PAM type: NRG; PAM sequence: AGG
gcgtgagcctctgggagagc

SEQ ID NO: 11087 - DNA, 20 bp, Artificial Sequence
  Description of Artificial Sequence: Synthetic oligonucleotide
  Target: DMPK; (+) strand; PAM type: NRG; PAM sequence: GGG
cgtgagcctctgggagagca

SEQ ID NO: 11088 - DNA, 20 bp, Artificial Sequence
  Description of Artificial Sequence: Synthetic oligonucleotide
  Target: DMPK; (+) strand; PAM type: NRG; PAM sequence: TGG
agcctctgggagagcagggc

SEQ ID NO: 11089 - DNA, 20 bp, Artificial Sequence
  Description of Artificial Sequence: Synthetic oligonucleotide
  Target: DMPK; (+) strand; PAM type: NRG; PAM sequence: GGG
gcctctgggagagcagggct

SEQ ID NO: 11090 - DNA, 20 bp, Artificial Sequence
  Description of Artificial Sequence: Synthetic oligonucleotide
  Target: DMPK; (+) strand; PAM type: NRG; PAM sequence: GGG
cctctgggagagcagggctg

SEQ ID NO: 11091 - DNA, 20 bp, Artificial Sequence
  Description of Artificial Sequence: Synthetic oligonucleotide
  Target: DMPK; (+) strand; PAM type: NRG; PAM sequence: GGG
ctctgggagagcagggctgg

SEQ ID NO: 11092 - DNA, 20 bp, Artificial Sequence
  Description of Artificial Sequence: Synthetic oligonucleotide
  Target: DMPK; (+) strand; PAM type: NRG; PAM sequence: CGG
agagcagggctgggggccac

SEQ ID NO: 11093 - DNA, 20 bp, Artificial Sequence
  Description of Artificial Sequence: Synthetic oligonucleotide
  Target: DMPK; (+) strand; PAM type: NRG; PAM sequence: GGG
gagcagggctgggggccacc

SEQ ID NO: 11094 - DNA, 20 bp, Artificial Sequence
  Description of Artificial Sequence: Synthetic oligonucleotide
  Target: DMPK; (+) strand; PAM type: NRG; PAM sequence: GAG
gcagggctgggggccaccgg

SEQ ID NO: 11095 - DNA, 20 bp, Artificial Sequence
  Description of Artificial Sequence: Synthetic oligonucleotide
  Target: DMPK; (+) strand; PAM type: NRG; PAM sequence: AGG
cagggctgggggccaccggg

SEQ ID NO: 11096 - DNA, 20 bp, Artificial Sequence
  Description of Artificial Sequence: Synthetic oligonucleotide
  Target: DMPK; (+) strand; PAM type: NRG; PAM sequence: CAG
ggccaccgggaggcctccct

SEQ ID NO: 11097 - DNA, 20 bp, Artificial Sequence
  Description of Artificial Sequence: Synthetic oligonucleotide
  Target: DMPK; (+) strand; PAM type: NRG; PAM sequence: AGG
gccaccgggaggcctccctc

SEQ ID NO: 11098 - DNA, 20 bp, Artificial Sequence
  Description of Artificial Sequence: Synthetic oligonucleotide
  Target: DMPK; (+) strand; PAM type: NRG; PAM sequence: CGG
cgggaggcctccctcaggca

SEQ ID NO: 11099 - DNA, 20 bp, Artificial Sequence
  Description of Artificial Sequence: Synthetic oligonucleotide
  Target: DMPK; (+) strand; PAM type: NRG; PAM sequence: GAG
ggaggcctccctcaggcacg

SEQ ID NO: 11100 - DNA, 20 bp, Artificial Sequence
  Description of Artificial Sequence: Synthetic oligonucleotide
  Target: DMPK; (+) strand; PAM type: NRG; PAM sequence: TGG
gcctccctcaggcacggaga

SEQ ID NO: 11101 - DNA, 20 bp, Artificial Sequence
  Description of Artificial Sequence: Synthetic oligonucleotide
  Target: DMPK; (+) strand; PAM type: NRG; PAM sequence: TGG
ggcacggagatggccgtctc

SEQ ID NO: 11102 - DNA, 20 bp, Artificial Sequence
  Description of Artificial Sequence: Synthetic oligonucleotide
  Target: DMPK; (+) strand; PAM type: NRG; PAM sequence: CAG
gagatggccgtctctggctt

SEQ ID NO: 11103 - DNA, 20 bp, Artificial Sequence
  Description of Artificial Sequence: Synthetic oligonucleotide
  Target: DMPK; (+) strand; PAM type: NRG; PAM sequence: TGG
atggccgtctctggcttcag

SEQ ID NO: 11104 - DNA, 20 bp, Artificial Sequence
  Description of Artificial Sequence: Synthetic oligonucleotide
  Target: DMPK; (+) strand; PAM type: NRG; PAM sequence: CAG
gccgtctctggcttcagtgg

SEQ ID NO: 11105 - DNA, 20 bp, Artificial Sequence
  Description of Artificial Sequence: Synthetic oligonucleotide
  Target: DMPK; (+) strand; PAM type: NRG; PAM sequence: AGG
ccgtctctggcttcagtggc

SEQ ID NO: 11106 - DNA, 20 bp, Artificial Sequence
  Description of Artificial Sequence: Synthetic oligonucleotide
  Target: DMPK; (+) strand; PAM type: NRG; PAM sequence: GGG
cgtctctggcttcagtggca

SEQ ID NO: 11107 - DNA, 20 bp, Artificial Sequence
  Description of Artificial Sequence: Synthetic oligonucleotide
  Target: DMPK; (+) strand; PAM type: NRG; PAM sequence: CAG
tctggcttcagtggcagggc

SEQ ID NO: 11108 - DNA, 20 bp, Artificial Sequence
  Description of Artificial Sequence: Synthetic oligonucleotide
  Target: DMPK; (+) strand; PAM type: NRG; PAM sequence: AGG
ctggcttcagtggcagggcc

SEQ ID NO: 11109 - DNA, 20 bp, Artificial Sequence
  Description of Artificial Sequence: Synthetic oligonucleotide
  Target: DMPK; (+) strand; PAM type: NRG; PAM sequence: CGG
cttcagtggcagggccaggc

SEQ ID NO: 11110 - DNA, 20 bp, Artificial Sequence
  Description of Artificial Sequence: Synthetic oligonucleotide
  Target: DMPK; (+) strand; PAM type: NRG; PAM sequence: GGG
ttcagtggcagggccaggcc

SEQ ID NO: 11111 - DNA, 20 bp, Artificial Sequence
  Description of Artificial Sequence: Synthetic oligonucleotide
  Target: DMPK; (+) strand; PAM type: NRG; PAM sequence: GGG
tcagtggcagggccaggccg

SEQ ID NO: 11112 - DNA, 20 bp, Artificial Sequence
  Description of Artificial Sequence: Synthetic oligonucleotide
  Target: DMPK; (+) strand; PAM type: NRG; PAM sequence: GGG
cagtggcagggccaggccgg

SEQ ID NO: 11113 - DNA, 20 bp, Artificial Sequence
  Description of Artificial Sequence: Synthetic oligonucleotide
  Target: DMPK; (+) strand; PAM type: NRG; PAM sequence: TGG
ggcagggccaggccgggggc

SEQ ID NO: 11114 - DNA, 20 bp, Artificial Sequence
  Description of Artificial Sequence: Synthetic oligonucleotide
  Target: DMPK; (+) strand; PAM type: NRG; PAM sequence: CGG
agggccaggccgggggctgg

SEQ ID NO: 11115 - DNA, 20 bp, Artificial Sequence
  Description of Artificial Sequence: Synthetic oligonucleotide
  Target: DMPK; (+) strand; PAM type: NRG; PAM sequence: CAG
gccaggccgggggctggcgg

SEQ ID NO: 11116 - DNA, 20 bp, Artificial Sequence
  Description of Artificial Sequence: Synthetic oligonucleotide
  Target: DMPK; (+) strand; PAM type: NRG; PAM sequence: AGG
ccaggccgggggctggcggc

SEQ ID NO: 11117 - DNA, 20 bp, Artificial Sequence
  Description of Artificial Sequence: Synthetic oligonucleotide
  Target: DMPK; (+) strand; PAM type: NRG; PAM sequence: TGG
cgggggctggcggcaggacc

SEQ ID NO: 11118 - DNA, 20 bp, Artificial Sequence
  Description of Artificial Sequence: Synthetic oligonucleotide
  Target: DMPK; (+) strand; PAM type: NRG; PAM sequence: GGG
gggggctggcggcaggacct

SEQ ID NO: 11119 - DNA, 20 bp, Artificial Sequence
  Description of Artificial Sequence: Synthetic oligonucleotide
  Target: DMPK; (+) strand; PAM type: NRG; PAM sequence: GAG
gggctggcggcaggacctgg

SEQ ID NO: 11120 - DNA, 20 bp, Artificial Sequence
  Description of Artificial Sequence: Synthetic oligonucleotide
  Target: DMPK; (+) strand; PAM type: NRG; PAM sequence: GAG
ggcggcaggacctgggagac

SEQ ID NO: 11121 - DNA, 20 bp, Artificial Sequence
  Description of Artificial Sequence: Synthetic oligonucleotide
  Target: DMPK; (+) strand; PAM type: NRG; PAM sequence: TGG
gacctgggagacgagcatgc

SEQ ID NO: 11122 - DNA, 20 bp, Artificial Sequence
  Description of Artificial Sequence: Synthetic oligonucleotide
  Target: DMPK; (+) strand; PAM type: NRG; PAM sequence: TGG
ctgggagacgagcatgctgg

SEQ ID NO: 11123 - DNA, 20 bp, Artificial Sequence
  Description of Artificial Sequence: Synthetic oligonucleotide
  Target: DMPK; (+) strand; PAM type: NRG; PAM sequence: GGG
tgggagacgagcatgctggt

SEQ ID NO: 11124 - DNA, 20 bp, Artificial Sequence
  Description of Artificial Sequence: Synthetic oligonucleotide
  Target: DMPK; (+) strand; PAM type: NRG; PAM sequence: GGG
gggagacgagcatgctggtg

SEQ ID NO: 11125 - DNA, 20 bp, Artificial Sequence
  Description of Artificial Sequence: Synthetic oligonucleotide
  Target: DMPK; (+) strand; PAM type: NRG; PAM sequence: AAG
agacgagcatgctggtgggg

SEQ ID NO: 11126 - DNA, 20 bp, Artificial Sequence
  Description of Artificial Sequence: Synthetic oligonucleotide
  Target: DMPK; (+) strand; PAM type: NRG; PAM sequence: AGG
gacgagcatgctggtgggga

SEQ ID NO: 11127 - DNA, 20 bp, Artificial Sequence
  Description of Artificial Sequence: Synthetic oligonucleotide
  Target: DMPK; (+) strand; PAM type: NRG; PAM sequence: TGG
gagcatgctggtggggaagg

SEQ ID NO: 11128 - DNA, 20 bp, Artificial Sequence
  Description of Artificial Sequence: Synthetic oligonucleotide
  Target: DMPK; (+) strand; PAM type: NRG; PAM sequence: CGG
catgctggtggggaaggtgg

SEQ ID NO: 11129 - DNA, 20 bp, Artificial Sequence
  Description of Artificial Sequence: Synthetic oligonucleotide
  Target: DMPK; (+) strand; PAM type: NRG; PAM sequence: GAG
ctggtggggaaggtggcggt

SEQ ID NO: 11130 - DNA, 20 bp, Artificial Sequence
  Description of Artificial Sequence: Synthetic oligonucleotide
  Target: DMPK; (+) strand; PAM type: NRG; PAM sequence: AGG
tggtggggaaggtggcggtg

SEQ ID NO: 11131 - DNA, 20 bp, Artificial Sequence
  Description of Artificial Sequence: Synthetic oligonucleotide
  Target: DMPK; (+) strand; PAM type: NRG; PAM sequence: CAG
aggatgatcttgccctgctg

SEQ ID NO: 11132 - DNA, 20 bp, Artificial Sequence
  Description of Artificial Sequence: Synthetic oligonucleotide
  Target: DMPK; (+) strand; PAM type: NRG; PAM sequence: AGG
ggatgatcttgccctgctgc

SEQ ID NO: 11133 - DNA, 20 bp, Artificial Sequence
  Description of Artificial Sequence: Synthetic oligonucleotide
  Target: DMPK; (+) strand; PAM type: NRG; PAM sequence: GGG
gatgatcttgccctgctgca

SEQ ID NO: 11134 - DNA, 20 bp, Artificial Sequence
  Description of Artificial Sequence: Synthetic oligonucleotide
  Target: DMPK; (+) strand; PAM type: NRG; PAM sequence: TGG
cagggccacacccgtcacga

SEQ ID NO: 11135 - DNA, 20 bp, Artificial Sequence
  Description of Artificial Sequence: Synthetic oligonucleotide
  Target: DMPK; (+) strand; PAM type: NRG; PAM sequence: GGG
agggccacacccgtcacgat

SEQ ID NO: 11136 - DNA, 20 bp, Artificial Sequence
  Description of Artificial Sequence: Synthetic oligonucleotide
  Target: DMPK; (+) strand; PAM type: NRG; PAM sequence: GGG
gggccacacccgtcacgatg

SEQ ID NO: 11137 - DNA, 20 bp, Artificial Sequence
  Description of Artificial Sequence: Synthetic oligonucleotide
  Target: DMPK; (+) strand; PAM type: NRG; PAM sequence: CAG
acccgtcacgatggggctgc

SEQ ID NO: 11138 - DNA, 20 bp, Artificial Sequence
  Description of Artificial Sequence: Synthetic oligonucleotide
  Target: DMPK; (+) strand; PAM type: NRG; PAM sequence: CAG
cacgatggggctgccagaca

SEQ ID NO: 11139 - DNA, 20 bp, Artificial Sequence
  Description of Artificial Sequence: Synthetic oligonucleotide
  Target: DMPK; (+) strand; PAM type: NRG; PAM sequence: AGG
acgatggggctgccagacac

SEQ ID NO: 11140 - DNA, 20 bp, Artificial Sequence
  Description of Artificial Sequence: Synthetic oligonucleotide
  Target: DMPK; (+) strand; PAM type: NRG; PAM sequence: GGG
cgatggggctgccagacaca

SEQ ID NO: 11141 - DNA, 20 bp, Artificial Sequence
  Description of Artificial Sequence: Synthetic oligonucleotide
  Target: DMPK; (+) strand; PAM type: NRG; PAM sequence: TGG
ggggctgccagacacagggt

SEQ ID NO: 11142 - DNA, 20 bp, Artificial Sequence
  Description of Artificial Sequence: Synthetic oligonucleotide
  Target: DMPK; (+) strand; PAM type: NRG; PAM sequence: CAG
ctgccagacacagggttggc

SEQ ID NO: 11143 - DNA, 20 bp, Artificial Sequence
  Description of Artificial Sequence: Synthetic oligonucleotide
  Target: DMPK; (+) strand; PAM type: NRG; PAM sequence: AGG
tgccagacacagggttggcc

SEQ ID NO: 11144 - DNA, 20 bp, Artificial Sequence
  Description of Artificial Sequence: Synthetic oligonucleotide
  Target: DMPK; (+) strand; PAM type: NRG; PAM sequence: GAG
ccagacacagggttggccag

SEQ ID NO: 11145 - DNA, 20 bp, Artificial Sequence
  Description of Artificial Sequence: Synthetic oligonucleotide
  Target: DMPK; (+) strand; PAM type: NRG; PAM sequence: AGG
cagacacagggttggccagg

SEQ ID NO: 11146 - DNA, 20 bp, Artificial Sequence
  Description of Artificial Sequence: Synthetic oligonucleotide
  Target: DMPK; (+) strand; PAM type: NRG; PAM sequence: AAG
acacagggttggccaggagg

SEQ ID NO: 11147 - DNA, 20 bp, Artificial Sequence
  Description of Artificial Sequence: Synthetic oligonucleotide
  Target: DMPK; (+) strand; PAM type: NRG; PAM sequence: TGG
ggccaggaggaagtttcctg

SEQ ID NO: 11148 - DNA, 20 bp, Artificial Sequence
  Description of Artificial Sequence: Synthetic oligonucleotide
  Target: DMPK; (+) strand; PAM type: NRG; PAM sequence: GGG
gccaggaggaagtttcctgt

SEQ ID NO: 11149 - DNA, 20 bp, Artificial Sequence
  Description of Artificial Sequence: Synthetic oligonucleotide
  Target: DMPK; (+) strand; PAM type: NRG; PAM sequence: GGG
ccaggaggaagtttcctgtg

SEQ ID NO: 11150 - DNA, 20 bp, Artificial Sequence
  Description of Artificial Sequence: Synthetic oligonucleotide
  Target: DMPK; (+) strand; PAM type: NRG; PAM sequence: GAG
aggaggaagtttcctgtggg

SEQ ID NO: 11151 - DNA, 20 bp, Artificial Sequence
  Description of Artificial Sequence: Synthetic oligonucleotide
  Target: DMPK; (+) strand; PAM type: NRG; PAM sequence: GAG
gaggaagtttcctgtgggga

SEQ ID NO: 11152 - DNA, 20 bp, Artificial Sequence
  Description of Artificial Sequence: Synthetic oligonucleotide
  Target: DMPK; (+) strand; PAM type: NRG; PAM sequence: GAG
ggaagtttcctgtggggaga

SEQ ID NO: 11153 - DNA, 20 bp, Artificial Sequence
  Description of Artificial Sequence: Synthetic oligonucleotide
  Target: DMPK; (+) strand; PAM type: NRG; PAM sequence: AGG
gaagtttcctgtggggagag

SEQ ID NO: 11154 - DNA, 20 bp, Artificial Sequence
  Description of Artificial Sequence: Synthetic oligonucleotide
  Target: DMPK; (+) strand; PAM type: NRG; PAM sequence: GGG
aagtttcctgtggggagaga

SEQ ID NO: 11155 - DNA, 20 bp, Artificial Sequence
  Description of Artificial Sequence: Synthetic oligonucleotide
  Target: DMPK; (+) strand; PAM type: NRG; PAM sequence: GAG
cctgtggggagagagggacc

SEQ ID NO: 11156 - DNA, 20 bp, Artificial Sequence
  Description of Artificial Sequence: Synthetic oligonucleotide
  Target: DMPK; (+) strand; PAM type: NRG; PAM sequence: CAG
ggggagagagggaccgagcg

SEQ ID NO: 11157 - DNA, 20 bp, Artificial Sequence
  Description of Artificial Sequence: Synthetic oligonucleotide
  Target: DMPK; (+) strand; PAM type: NRG; PAM sequence: AGG
gggagagagggaccgagcgc

SEQ ID NO: 11158 - DNA, 20 bp, Artificial Sequence
  Description of Artificial Sequence: Synthetic oligonucleotide
  Target: DMPK; (+) strand; PAM type: NRG; PAM sequence: GAG
gagagggaccgagcgcaggt

SEQ ID NO: 11159 - DNA, 20 bp, Artificial Sequence
  Description of Artificial Sequence: Synthetic oligonucleotide
  Target: DMPK; (+) strand; PAM type: NRG; PAM sequence: GAG
gagggaccgagcgcaggtga

SEQ ID NO: 11160 - DNA, 20 bp, Artificial Sequence
  Description of Artificial Sequence: Synthetic oligonucleotide
  Target: DMPK; (+) strand; PAM type: NRG; PAM sequence: CAG
gaccgagcgcaggtgagagc

SEQ ID NO: 11161 - DNA, 20 bp, Artificial Sequence
  Description of Artificial Sequence: Synthetic oligonucleotide
  Target: DMPK; (+) strand; PAM type: NRG; PAM sequence: AGG
accgagcgcaggtgagagcc

SEQ ID NO: 11162 - DNA, 20 bp, Artificial Sequence
  Description of Artificial Sequence: Synthetic oligonucleotide
  Target: DMPK; (+) strand; PAM type: NRG; PAM sequence: GAG
cgagcgcaggtgagagccag

SEQ ID NO: 11163 - DNA, 20 bp, Artificial Sequence
  Description of Artificial Sequence: Synthetic oligonucleotide
  Target: DMPK; (+) strand; PAM type: NRG; PAM sequence: GAG
agcgcaggtgagagccagga

SEQ ID NO: 11164 - DNA, 20 bp, Artificial Sequence
  Description of Artificial Sequence: Synthetic oligonucleotide
  Target: DMPK; (+) strand; PAM type: NRG; PAM sequence: CAG
gcaggtgagagccaggagag

SEQ ID NO: 11165 - DNA, 20 bp, Artificial Sequence
  Description of Artificial Sequence: Synthetic oligonucleotide
  Target: DMPK; (+) strand; PAM type: NRG; PAM sequence: AGG
caggtgagagccaggagagc

SEQ ID NO: 11166 - DNA, 20 bp, Artificial Sequence
  Description of Artificial Sequence: Synthetic oligonucleotide
  Target: DMPK; (+) strand; PAM type: NRG; PAM sequence: AAG
gagagccaggagagcaggcc

SEQ ID NO: 11167 - DNA, 20 bp, Artificial Sequence
  Description of Artificial Sequence: Synthetic oligonucleotide
  Target: DMPK; (+) strand; PAM type: NRG; PAM sequence: CAG
gccaggagagcaggccaagc

SEQ ID NO: 11168 - DNA, 20 bp, Artificial Sequence
  Description of Artificial Sequence: Synthetic oligonucleotide
  Target: DMPK; (+) strand; PAM type: NRG; PAM sequence: GAG
caggagagcaggccaagcca

SEQ ID NO: 11169 - DNA, 20 bp, Artificial Sequence
  Description of Artificial Sequence: Synthetic oligonucleotide
  Target: DMPK; (+) strand; PAM type: NRG; PAM sequence: GAG
ggagagcaggccaagccaga

SEQ ID NO: 11170 - DNA, 20 bp, Artificial Sequence
  Description of Artificial Sequence: Synthetic oligonucleotide
  Target: DMPK; (+) strand; PAM type: NRG; PAM sequence: AAG
gagcaggccaagccagagag

SEQ ID NO: 11171 - DNA, 20 bp, Artificial Sequence
  Description of Artificial Sequence: Synthetic oligonucleotide
  Target: DMPK; (+) strand; PAM type: NRG; PAM sequence: TGG
caggccaagccagagagaag

SEQ ID NO: 11172 - DNA, 20 bp, Artificial Sequence
  Description of Artificial Sequence: Synthetic oligonucleotide
  Target: DMPK; (+) strand; PAM type: NRG; PAM sequence: GAG
ggccaagccagagagaagtg

SEQ ID NO: 11173 - DNA, 20 bp, Artificial Sequence
  Description of Artificial Sequence: Synthetic oligonucleotide
  Target: DMPK; (+) strand; PAM type: NRG; PAM sequence: CAG
agagagaagtggagactgtg

SEQ ID NO: 11174 - DNA, 20 bp, Artificial Sequence
  Description of Artificial Sequence: Synthetic oligonucleotide
  Target: DMPK; (+) strand; PAM type: NRG; PAM sequence: TGG
agaagtggagactgtgcagc

SEQ ID NO: 11175 - DNA, 20 bp, Artificial Sequence
  Description of Artificial Sequence: Synthetic oligonucleotide
  Target: DMPK; (+) strand; PAM type: NRG; PAM sequence: GAG
aagtggagactgtgcagctg

SEQ ID NO: 11176 - DNA, 20 bp, Artificial Sequence
  Description of Artificial Sequence: Synthetic oligonucleotide
  Target: DMPK; (+) strand; PAM type: NRG; PAM sequence: AGG
agtggagactgtgcagctgg

SEQ ID NO: 11177 - DNA, 20 bp, Artificial Sequence
  Description of Artificial Sequence: Synthetic oligonucleotide
  Target: DMPK; (+) strand; PAM type: NRG; PAM sequence: GGG
gtggagactgtgcagctgga

SEQ ID NO: 11178 - DNA, 20 bp, Artificial Sequence
  Description of Artificial Sequence: Synthetic oligonucleotide
  Target: DMPK; (+) strand; PAM type: NRG; PAM sequence: CGG
gagactgtgcagctggaggg

SEQ ID NO: 11179 - DNA, 20 bp, Artificial Sequence
  Description of Artificial Sequence: Synthetic oligonucleotide
  Target: DMPK; (+) strand; PAM type: NRG; PAM sequence: GGG
agactgtgcagctggagggc

SEQ ID NO: 11180 - DNA, 20 bp, Artificial Sequence
  Description of Artificial Sequence: Synthetic oligonucleotide
  Target: DMPK; (+) strand; PAM type: NRG; PAM sequence: CGG
ctgtgcagctggagggcggg

SEQ ID NO: 11181 - DNA, 20 bp, Artificial Sequence
  Description of Artificial Sequence: Synthetic oligonucleotide
  Target: DMPK; (+) strand; PAM type: NRG; PAM sequence: GAG
gtgcagctggagggcgggcg

SEQ ID NO: 11182 - DNA, 20 bp, Artificial Sequence
  Description of Artificial Sequence: Synthetic oligonucleotide
  Target: DMPK; (+) strand; PAM type: NRG; PAM sequence: AGG
tgcagctggagggcgggcgg

SEQ ID NO: 11183 - DNA, 20 bp, Artificial Sequence
  Description of Artificial Sequence: Synthetic oligonucleotide
  Target: DMPK; (+) strand; PAM type: NRG; PAM sequence: GGG
gcagctggagggcgggcgga

SEQ ID NO: 11184 - DNA, 20 bp, Artificial Sequence
  Description of Artificial Sequence: Synthetic oligonucleotide
  Target: DMPK; (+) strand; PAM type: NRG; PAM sequence: GAG
agctggagggcgggcggagg

SEQ ID NO: 11185 - DNA, 20 bp, Artificial Sequence
  Description of Artificial Sequence: Synthetic oligonucleotide
  Target: DMPK; (+) strand; PAM type: NRG; PAM sequence: TGG
ggcgggcggagggagccttg

SEQ ID NO: 11186 - DNA, 20 bp, Artificial Sequence
  Description of Artificial Sequence: Synthetic oligonucleotide
  Target: DMPK; (+) strand; PAM type: NRG; PAM sequence: TGG
gggcggagggagccttgtgg

SEQ ID NO: 11187 - DNA, 20 bp, Artificial Sequence
  Description of Artificial Sequence: Synthetic oligonucleotide
  Target: DMPK; (+) strand; PAM type: NRG; PAM sequence: GGG
ggcggagggagccttgtggt

SEQ ID NO: 11188 - DNA, 20 bp, Artificial Sequence
  Description of Artificial Sequence: Synthetic oligonucleotide
  Target: DMPK; (+) strand; PAM type: NRG; PAM sequence: TGG
gggagccttgtggtgggcct

SEQ ID NO: 11189 - DNA, 20 bp, Artificial Sequence
  Description of Artificial Sequence: Synthetic oligonucleotide
  Target: DMPK; (+) strand; PAM type: NRG; PAM sequence: GGG
ggagccttgtggtgggcctt

SEQ ID NO: 11190 - DNA, 20 bp, Artificial Sequence
  Description of Artificial Sequence: Synthetic oligonucleotide
  Target: DMPK; (+) strand; PAM type: NRG; PAM sequence: GGG
gagccttgtggtgggccttg

SEQ ID NO: 11191 - DNA, 20 bp, Artificial Sequence
  Description of Artificial Sequence: Synthetic oligonucleotide
  Target: DMPK; (+) strand; PAM type: NRG; PAM sequence: TGG
tgtggtgggccttggggcac

SEQ ID NO: 11192 - DNA, 20 bp, Artificial Sequence
  Description of Artificial Sequence: Synthetic oligonucleotide
  Target: DMPK; (+) strand; PAM type: NRG; PAM sequence: GGG
gtggtgggccttggggcact

SEQ ID NO: 11193 - DNA, 20 bp, Artificial Sequence
  Description of Artificial Sequence: Synthetic oligonucleotide
  Target: DMPK; (+) strand; PAM type: NRG; PAM sequence: CAG
cttggggcactgggacttgc

SEQ ID NO: 11194 - DNA, 20 bp, Artificial Sequence
  Description of Artificial Sequence: Synthetic oligonucleotide
  Target: DMPK; (+) strand; PAM type: NRG; PAM sequence: AGG
ttggggcactgggacttgcc

SEQ ID NO: 11195 - DNA, 20 bp, Artificial Sequence
  Description of Artificial Sequence: Synthetic oligonucleotide
  Target: DMPK; (+) strand; PAM type: NRG; PAM sequence: GGG
tggggcactgggacttgcca

SEQ ID NO: 11196 - DNA, 20 bp, Artificial Sequence
  Description of Artificial Sequence: Synthetic oligonucleotide
  Target: DMPK; (+) strand; PAM type: NRG; PAM sequence: GAG
cactgggacttgccagggat

SEQ ID NO: 11197 - DNA, 20 bp, Artificial Sequence
  Description of Artificial Sequence: Synthetic oligonucleotide
  Target: DMPK; (+) strand; PAM type: NRG; PAM sequence: CAG
gccagggatgagatgccctc

SEQ ID NO: 11198 - DNA, 20 bp, Artificial Sequence
  Description of Artificial Sequence: Synthetic oligonucleotide
  Target: DMPK; (+) strand; PAM type: NRG; PAM sequence: AGG
ccagggatgagatgccctcc

SEQ ID NO: 11199 - DNA, 20 bp, Artificial Sequence
  Description of Artificial Sequence: Synthetic oligonucleotide
  Target: DMPK; (+) strand; PAM type: NRG; PAM sequence: GAG
agggatgagatgccctccag

SEQ ID NO: 11200 - DNA, 20 bp, Artificial Sequence
  Description of Artificial Sequence: Synthetic oligonucleotide
  Target: DMPK; (+) strand; PAM type: NRG; PAM sequence: CAG
tgagatgccctccaggagcc

SEQ ID NO: 11201 - DNA, 20 bp, Artificial Sequence
  Description of Artificial Sequence: Synthetic oligonucleotide
  Target: DMPK; (+) strand; PAM type: NRG; PAM sequence: AGG
gagatgccctccaggagccc

SEQ ID NO: 11202 - DNA, 20 bp, Artificial Sequence
  Description of Artificial Sequence: Synthetic oligonucleotide
  Target: DMPK; (+) strand; PAM type: NRG; PAM sequence: GGG
agatgccctccaggagccca

SEQ ID NO: 11203 - DNA, 20 bp, Artificial Sequence
  Description of Artificial Sequence: Synthetic oligonucleotide
  Target: DMPK; (+) strand; PAM type: NRG; PAM sequence: CAG
gccctccaggagcccaggga

SEQ ID NO: 11204 - DNA, 20 bp, Artificial Sequence
  Description of Artificial Sequence: Synthetic oligonucleotide
  Target: DMPK; (+) strand; PAM type: NRG; PAM sequence: GAG
gggacagcccctccctctcc

SEQ ID NO: 11205 - DNA, 20 bp, Artificial Sequence
  Description of Artificial Sequence: Synthetic oligonucleotide
  Target: DMPK; (+) strand; PAM type: NRG; PAM sequence: CGG
gagatgactgcacccctccc

SEQ ID NO: 11206 - DNA, 20 bp, Artificial Sequence
  Description of Artificial Sequence: Synthetic oligonucleotide
  Target: DMPK; (+) strand; PAM type: NRG; PAM sequence: TAG
acccctccccggctctcacc

SEQ ID NO: 11207 - DNA, 20 bp, Artificial Sequence
  Description of Artificial Sequence: Synthetic oligonucleotide
  Target: DMPK; (+) strand; PAM type: NRG; PAM sequence: AGG
cccctccccggctctcacct

SEQ ID NO: 11208 - DNA, 20 bp, Artificial Sequence
  Description of Artificial Sequence: Synthetic oligonucleotide
  Target: DMPK; (+) strand; PAM type: NRG; PAM sequence: GAG
cccggctctcacctaggcct

SEQ ID NO: 11209 - DNA, 20 bp, Artificial Sequence
  Description of Artificial Sequence: Synthetic oligonucleotide
  Target: DMPK; (+) strand; PAM type: NRG; PAM sequence: AGG
ccggctctcacctaggcctg

SEQ ID NO: 11210 - DNA, 20 bp, Artificial Sequence
  Description of Artificial Sequence: Synthetic oligonucleotide
  Target: DMPK; (+) strand; PAM type: NRG; PAM sequence: GGG
cggctctcacctaggcctga

SEQ ID NO: 11211 - DNA, 20 bp, Artificial Sequence
  Description of Artificial Sequence: Synthetic oligonucleotide
  Target: DMPK; (+) strand; PAM type: NRG; PAM sequence: GAG
gctctcacctaggcctgagg

SEQ ID NO: 11212 - DNA, 20 bp, Artificial Sequence
  Description of Artificial Sequence: Synthetic oligonucleotide
  Target: DMPK; (+) strand; PAM type: NRG; PAM sequence: AGG
ctctcacctaggcctgaggg

SEQ ID NO: 11213 - DNA, 20 bp, Artificial Sequence
  Description of Artificial Sequence: Synthetic oligonucleotide
  Target: DMPK; (+) strand; PAM type: NRG; PAM sequence: GGG
tctcacctaggcctgaggga

SEQ ID NO: 11214 - DNA, 20 bp, Artificial Sequence
  Description of Artificial Sequence: Synthetic oligonucleotide
  Target: DMPK; (+) strand; PAM type: NRG; PAM sequence: GAG
tcacctaggcctgagggagg

SEQ ID NO: 11215 - DNA, 20 bp, Artificial Sequence
  Description of Artificial Sequence: Synthetic oligonucleotide
  Target: DMPK; (+) strand; PAM type: NRG; PAM sequence: TGG
ctaggcctgagggagggaga

SEQ ID NO: 11216 - DNA, 20 bp, Artificial Sequence
  Description of Artificial Sequence: Synthetic oligonucleotide
  Target: DMPK; (+) strand; PAM type: NRG; PAM sequence: GGG
taggcctgagggagggagat

SEQ ID NO: 11217 - DNA, 20 bp, Artificial Sequence
  Description of Artificial Sequence: Synthetic oligonucleotide
  Target: DMPK; (+) strand; PAM type: NRG; PAM sequence: GGG
aggcctgagggagggagatg

SEQ ID NO: 11218 - DNA, 20 bp, Artificial Sequence
  Description of Artificial Sequence: Synthetic oligonucleotide
  Target: DMPK; (+) strand; PAM type: NRG; PAM sequence: GGG
ggcctgagggagggagatgg

SEQ ID NO: 11219 - DNA, 20 bp, Artificial Sequence
  Description of Artificial Sequence: Synthetic oligonucleotide
  Target: DMPK; (+) strand; PAM type: NRG; PAM sequence: TGG
gggagggagatgggggtacc

SEQ ID NO: 11220 - DNA, 20 bp, Artificial Sequence
  Description of Artificial Sequence: Synthetic oligonucleotide
  Target: DMPK; (+) strand; PAM type: NRG; PAM sequence: GGG
ggagggagatgggggtacct

SEQ ID NO: 11221 - DNA, 20 bp, Artificial Sequence
  Description of Artificial Sequence: Synthetic oligonucleotide
  Target: DMPK; (+) strand; PAM type: NRG; PAM sequence: GGG
gagggagatgggggtacctg

SEQ ID NO: 11222 - DNA, 20 bp, Artificial Sequence
  Description of Artificial Sequence: Synthetic oligonucleotide
  Target: DMPK; (+) strand; PAM type: NRG; PAM sequence: CAG
ggagatgggggtacctgggg

SEQ ID NO: 11223 - DNA, 20 bp, Artificial Sequence
  Description of Artificial Sequence: Synthetic oligonucleotide
  Target: DMPK; (+) strand; PAM type: NRG; PAM sequence: TGG
gatgggggtacctggggcag

SEQ ID NO: 11224 - DNA, 20 bp, Artificial Sequence
  Description of Artificial Sequence: Synthetic oligonucleotide
  Target: DMPK; (+) strand; PAM type: NRG; PAM sequence: AAG
ggtacctggggcagtggccg

SEQ ID NO: 11225 - DNA, 20 bp, Artificial Sequence
  Description of Artificial Sequence: Synthetic oligonucleotide
  Target: DMPK; (+) strand; PAM type: NRG; PAM sequence: AGG
gtacctggggcagtggccga

SEQ ID NO: 11226 - DNA, 20 bp, Artificial Sequence
  Description of Artificial Sequence: Synthetic oligonucleotide
  Target: DMPK; (+) strand; PAM type: NRG; PAM sequence: CAG
cctggggcagtggccgaagg

SEQ ID NO: 11227 - DNA, 20 bp, Artificial Sequence
  Description of Artificial Sequence: Synthetic oligonucleotide
  Target: DMPK; (+) strand; PAM type: NRG; PAM sequence: CAG
gcagtggccgaaggcagctg

SEQ ID NO: 11228 - DNA, 20 bp, Artificial Sequence
  Description of Artificial Sequence: Synthetic oligonucleotide
  Target: DMPK; (+) strand; PAM type: NRG; PAM sequence: AGG
cagtggccgaaggcagctgc

SEQ ID NO: 11229 - DNA, 20 bp, Artificial Sequence
  Description of Artificial Sequence: Synthetic oligonucleotide
  Target: DMPK; (+) strand; PAM type: NRG; PAM sequence: GGG
agtggccgaaggcagctgca

SEQ ID NO: 11230 - DNA, 20 bp, Artificial Sequence
  Description of Artificial Sequence: Synthetic oligonucleotide
  Target: DMPK; (+) strand; PAM type: NRG; PAM sequence: CAG
ggccgaaggcagctgcaggg

SEQ ID NO: 11231 - DNA, 20 bp, Artificial Sequence
  Description of Artificial Sequence: Synthetic oligonucleotide
  Target: DMPK; (+) strand; PAM type: NRG; PAM sequence: CGG
cagggcagtcacgcccaccc

SEQ ID NO: 11232 - DNA, 20 bp, Artificial Sequence
  Description of Artificial Sequence: Synthetic oligonucleotide
  Target: DMPK; (+) strand; PAM type: NRG; PAM sequence: GAG
gggcagtcacgcccaccccg

SEQ ID NO: 11233 - DNA, 20 bp, Artificial Sequence
  Description of Artificial Sequence: Synthetic oligonucleotide
  Target: DMPK; (+) strand; PAM type: NRG; PAM sequence: GAG
acgcccaccccggagttgat

SEQ ID NO: 11234 - DNA, 20 bp, Artificial Sequence
  Description of Artificial Sequence: Synthetic oligonucleotide
  Target: DMPK; (+) strand; PAM type: NRG; PAM sequence: AGG
cgcccaccccggagttgatg

SEQ ID NO: 11235 - DNA, 20 bp, Artificial Sequence
  Description of Artificial Sequence: Synthetic oligonucleotide
  Target: DMPK; (+) strand; PAM type: NRG; PAM sequence: TGG
ggagttgatgaggtgcacat

SEQ ID NO: 11236 - DNA, 20 bp, Artificial Sequence
  Description of Artificial Sequence: Synthetic oligonucleotide
  Target: DMPK; (+) strand; PAM type: NRG; PAM sequence: CAG
gttgatgaggtgcacattgg

SEQ ID NO: 11237 - DNA, 20 bp, Artificial Sequence
  Description of Artificial Sequence: Synthetic oligonucleotide
  Target: DMPK; (+) strand; PAM type: NRG; PAM sequence: AGG
ttgatgaggtgcacattggc

SEQ ID NO: 11238 - DNA, 20 bp, Artificial Sequence
  Description of Artificial Sequence: Synthetic oligonucleotide
  Target: DMPK; (+) strand; PAM type: NRG; PAM sequence: GGG
tgatgaggtgcacattggca

SEQ ID NO: 11239 - DNA, 20 bp, Artificial Sequence
  Description of Artificial Sequence: Synthetic oligonucleotide
  Target: DMPK; (+) strand; PAM type: NRG; PAM sequence: CAG
cacattggcagggcctgctg

SEQ ID NO: 11240 - DNA, 20 bp, Artificial Sequence
  Description of Artificial Sequence: Synthetic oligonucleotide
  Target: DMPK; (+) strand; PAM type: NRG; PAM sequence: CAG
tgctgcagctgccaccttca

SEQ ID NO: 11241 - DNA, 20 bp, Artificial Sequence
  Description of Artificial Sequence: Synthetic oligonucleotide
  Target: DMPK; (+) strand; PAM type: NRG; PAM sequence: AGG
gctgcagctgccaccttcac

SEQ ID NO: 11242 - DNA, 20 bp, Artificial Sequence
  Description of Artificial Sequence: Synthetic oligonucleotide
  Target: DMPK; (+) strand; PAM type: NRG; PAM sequence: GGG
ctgcagctgccaccttcaca

SEQ ID NO: 11243 - DNA, 20 bp, Artificial Sequence
  Description of Artificial Sequence: Synthetic oligonucleotide
  Target: DMPK; (+) strand; PAM type: NRG; PAM sequence: TGG
gccaccttcacagggctgcc

SEQ ID NO: 11244 - DNA, 20 bp, Artificial Sequence
  Description of Artificial Sequence: Synthetic oligonucleotide
  Target: DMPK; (+) strand; PAM type: NRG; PAM sequence: CGG
cttcacagggctgcctggcc

SEQ ID NO: 11245 - DNA, 20 bp, Artificial Sequence
  Description of Artificial Sequence: Synthetic oligonucleotide
  Target: DMPK; (+) strand; PAM type: NRG; PAM sequence: CAG
ctgcctggcccggctgccaa

SEQ ID NO: 11246 - DNA, 20 bp, Artificial Sequence
  Description of Artificial Sequence: Synthetic oligonucleotide
  Target: DMPK; (+) strand; PAM type: NRG; PAM sequence: CAG
ggcccggctgccaacagctg

SEQ ID NO: 11247 - DNA, 20 bp, Artificial Sequence
  Description of Artificial Sequence: Synthetic oligonucleotide
  Target: DMPK; (+) strand; PAM type: NRG; PAM sequence: AGG
gcccggctgccaacagctgc

SEQ ID NO: 11248 - DNA, 20 bp, Artificial Sequence
  Description of Artificial Sequence: Synthetic oligonucleotide
  Target: DMPK; (+) strand; PAM type: NRG; PAM sequence: GGG
cccggctgccaacagctgca

SEQ ID NO: 11249 - DNA, 20 bp, Artificial Sequence
  Description of Artificial Sequence: Synthetic oligonucleotide
  Target: DMPK; (+) strand; PAM type: NRG; PAM sequence: GGG
ccggctgccaacagctgcag

SEQ ID NO: 11250 - DNA, 20 bp, Artificial Sequence
  Description of Artificial Sequence: Synthetic oligonucleotide
  Target: DMPK; (+) strand; PAM type: NRG; PAM sequence: CAG
caacagctgcaggggcccca

SEQ ID NO: 11251 - DNA, 20 bp, Artificial Sequence
  Description of Artificial Sequence: Synthetic oligonucleotide
  Target: DMPK; (+) strand; PAM type: NRG; PAM sequence: TGG
gctgcaggggccccacagcc

SEQ ID NO: 11252 - DNA, 20 bp, Artificial Sequence
  Description of Artificial Sequence: Synthetic oligonucleotide
  Target: DMPK; (+) strand; PAM type: NRG; PAM sequence: GGG
ctgcaggggccccacagcct

SEQ ID NO: 11253 - DNA, 20 bp, Artificial Sequence
  Description of Artificial Sequence: Synthetic oligonucleotide
  Target: DMPK; (+) strand; PAM type: NRG; PAM sequence: GGG
tgcaggggccccacagcctg

SEQ ID NO: 11254 - DNA, 20 bp, Artificial Sequence
  Description of Artificial Sequence: Synthetic oligonucleotide
  Target: DMPK; (+) strand; PAM type: NRG; PAM sequence: CAG
aggggccccacagcctgggg

SEQ ID NO: 11255 - DNA, 20 bp, Artificial Sequence
  Description of Artificial Sequence: Synthetic oligonucleotide
  Target: DMPK; (+) strand; PAM type: NRG; PAM sequence: AGG
ggggccccacagcctggggc

SEQ ID NO: 11256 - DNA, 20 bp, Artificial Sequence
  Description of Artificial Sequence: Synthetic oligonucleotide
  Target: DMPK; (+) strand; PAM type: NRG; PAM sequence: GGG
gggccccacagcctggggca

SEQ ID NO: 11257 - DNA, 20 bp, Artificial Sequence
  Description of Artificial Sequence: Synthetic oligonucleotide
  Target: DMPK; (+) strand; PAM type: NRG; PAM sequence: GAG
ggggcagggtcaccacctgt

SEQ ID NO: 11258 - DNA, 20 bp, Artificial Sequence
  Description of Artificial Sequence: Synthetic oligonucleotide
  Target: DMPK; (+) strand; PAM type: NRG; PAM sequence: AGG
gggcagggtcaccacctgtg

SEQ ID NO: 11259 - DNA, 20 bp, Artificial Sequence
  Description of Artificial Sequence: Synthetic oligonucleotide
  Target: DMPK; (+) strand; PAM type: NRG; PAM sequence: TGG
cagggtcaccacctgtgagg

SEQ ID NO: 11260 - DNA, 20 bp, Artificial Sequence
  Description of Artificial Sequence: Synthetic oligonucleotide
  Target: DMPK; (+) strand; PAM type: NRG; PAM sequence: GGG
agggtcaccacctgtgaggt

SEQ ID NO: 11261 - DNA, 20 bp, Artificial Sequence
  Description of Artificial Sequence: Synthetic oligonucleotide
  Target: DMPK; (+) strand; PAM type: NRG; PAM sequence: TGG
cctgtgaggtgggtactacc

SEQ ID NO: 11262 - DNA, 20 bp, Artificial Sequence
  Description of Artificial Sequence: Synthetic oligonucleotide
  Target: DMPK; (+) strand; PAM type: NRG; PAM sequence: GGG
ctgtgaggtgggtactacct

SEQ ID NO: 11263 - DNA, 20 bp, Artificial Sequence
  Description of Artificial Sequence: Synthetic oligonucleotide
  Target: DMPK; (+) strand; PAM type: NRG; PAM sequence: GGG
tgtgaggtgggtactacctg

SEQ ID NO: 11264 - DNA, 20 bp, Artificial Sequence
  Description of Artificial Sequence: Synthetic oligonucleotide
  Target: DMPK; (+) strand; PAM type: NRG; PAM sequence: CAG
gaggtgggtactacctgggg

SEQ ID NO: 11265 - DNA, 20 bp, Artificial Sequence
  Description of Artificial Sequence: Synthetic oligonucleotide
  Target: DMPK; (+) strand; PAM type: NRG; PAM sequence: AGG
aggtgggtactacctggggc

SEQ ID NO: 11266 - DNA, 20 bp, Artificial Sequence
  Description of Artificial Sequence: Synthetic oligonucleotide
  Target: DMPK; (+) strand; PAM type: NRG; PAM sequence: TAG
actacctggggcaggttcaa

SEQ ID NO: 11267 - DNA, 20 bp, Artificial Sequence
  Description of Artificial Sequence: Synthetic oligonucleotide
  Target: DMPK; (+) strand; PAM type: NRG; PAM sequence: TGG
acctggggcaggttcaatag

SEQ ID NO: 11268 - DNA, 20 bp, Artificial Sequence
  Description of Artificial Sequence: Synthetic oligonucleotide
  Target: DMPK; (+) strand; PAM type: NRG; PAM sequence: GGG
cctggggcaggttcaatagt

SEQ ID NO: 11269 - DNA, 20 bp, Artificial Sequence
  Description of Artificial Sequence: Synthetic oligonucleotide
  Target: DMPK; (+) strand; PAM type: NRG; PAM sequence: GGG
ctggggcaggttcaatagtg

SEQ ID NO: 11270 - DNA, 20 bp, Artificial Sequence
  Description of Artificial Sequence: Synthetic oligonucleotide
  Target: DMPK; (+) strand; PAM type: NRG; PAM sequence: GAG
ggggcaggttcaatagtggg

SEQ ID NO: 11271 - DNA, 20 bp, Artificial Sequence
  Description of Artificial Sequence: Synthetic oligonucleotide
  Target: DMPK; (+) strand; PAM type: NRG; PAM sequence: AGG
gggcaggttcaatagtgggg

SEQ ID NO: 11272 - DNA, 20 bp, Artificial Sequence
  Description of Artificial Sequence: Synthetic oligonucleotide
  Target: DMPK; (+) strand; PAM type: NRG; PAM sequence: TGG
caggttcaatagtggggagg

SEQ ID NO: 11273 - DNA, 20 bp, Artificial Sequence
  Description of Artificial Sequence: Synthetic oligonucleotide
  Target: DMPK; (+) strand; PAM type: NRG; PAM sequence: GGG
aggttcaatagtggggaggt

SEQ ID NO: 11274 - DNA, 20 bp, Artificial Sequence
  Description of Artificial Sequence: Synthetic oligonucleotide
  Target: DMPK; (+) strand; PAM type: NRG; PAM sequence: GGG
ggttcaatagtggggaggtg

SEQ ID NO: 11275 - DNA, 20 bp, Artificial Sequence
  Description of Artificial Sequence: Synthetic oligonucleotide
  Target: DMPK; (+) strand; PAM type: NRG; PAM sequence: CAG
aatagtggggaggtggggct

SEQ ID NO: 11276 - DNA, 20 bp, Artificial Sequence
  Description of Artificial Sequence: Synthetic oligonucleotide
  Target: DMPK; (+) strand; PAM type: NRG; PAM sequence: AGG
atagtggggaggtggggctc

SEQ ID NO: 11277 - DNA, 20 bp, Artificial Sequence
  Description of Artificial Sequence: Synthetic oligonucleotide
  Target: DMPK; (+) strand; PAM type: NRG; PAM sequence: TGG
ggaggtggggctcaggcccg

SEQ ID NO: 11278 - DNA, 20 bp, Artificial Sequence
  Description of Artificial Sequence: Synthetic oligonucleotide
  Target: DMPK; (+) strand; PAM type: NRG; PAM sequence: GGG
gaggtggggctcaggcccgt

SEQ ID NO: 11279 - DNA, 20 bp, Artificial Sequence
  Description of Artificial Sequence: Synthetic oligonucleotide
  Target: DMPK; (+) strand; PAM type: NRG; PAM sequence: CGG
ctcaggcccgtgggataccc

SEQ ID NO: 11280 - DNA, 20 bp, Artificial Sequence
  Description of Artificial Sequence: Synthetic oligonucleotide
  Target: DMPK; (+) strand; PAM type: NRG; PAM sequence: GGG
tcaggcccgtgggatacccc

SEQ ID NO: 11281 - DNA, 20 bp, Artificial Sequence
  Description of Artificial Sequence: Synthetic oligonucleotide
  Target: DMPK; (+) strand; PAM type: NRG; PAM sequence: GGG
caggcccgtgggataccccg

SEQ ID NO: 11282 - DNA, 20 bp, Artificial Sequence
  Description of Artificial Sequence: Synthetic oligonucleotide
  Target: DMPK; (+) strand; PAM type: NRG; PAM sequence: GGG
aggcccgtgggataccccgg

SEQ ID NO: 11283 - DNA, 20 bp, Artificial Sequence
  Description of Artificial Sequence: Synthetic oligonucleotide
  Target: DMPK; (+) strand; PAM type: NRG; PAM sequence: TGG
cccgtgggataccccggggg

SEQ ID NO: 11284 - DNA, 20 bp, Artificial Sequence
  Description of Artificial Sequence: Synthetic oligonucleotide
  Target: DMPK; (+) strand; PAM type: NRG; PAM sequence: GGG
ccgtgggataccccgggggt

SEQ ID NO: 11285 - DNA, 20 bp, Artificial Sequence
  Description of Artificial Sequence: Synthetic oligonucleotide
  Target: DMPK; (+) strand; PAM type: NRG; PAM sequence: GGG
cgtgggataccccgggggtg

SEQ ID NO: 11286 - DNA, 20 bp, Artificial Sequence
  Description of Artificial Sequence: Synthetic oligonucleotide
  Target: DMPK; (+) strand; PAM type: NRG; PAM sequence: GAG
tgggataccccgggggtggg

SEQ ID NO: 11287 - DNA, 20 bp, Artificial Sequence
  Description of Artificial Sequence: Synthetic oligonucleotide
  Target: DMPK; (+) strand; PAM type: NRG; PAM sequence: GAG
ggataccccgggggtgggga

SEQ ID NO: 11288 - DNA, 20 bp, Artificial Sequence
  Description of Artificial Sequence: Synthetic oligonucleotide
  Target: DMPK; (+) strand; PAM type: NRG; PAM sequence: CGG
taccccgggggtggggagag

SEQ ID NO: 11289 - DNA, 20 bp, Artificial Sequence
  Description of Artificial Sequence: Synthetic oligonucleotide
  Target: DMPK; (+) strand; PAM type: NRG; PAM sequence: TGG
ggggagagcggtaccacttg

SEQ ID NO: 11290 - DNA, 20 bp, Artificial Sequence
  Description of Artificial Sequence: Synthetic oligonucleotide
  Target: DMPK; (+) strand; PAM type: NRG; PAM sequence: GGG
gggagagcggtaccacttgt

SEQ ID NO: 11291 - DNA, 20 bp, Artificial Sequence
  Description of Artificial Sequence: Synthetic oligonucleotide
  Target: DMPK; (+) strand; PAM type: NRG; PAM sequence: GGG
ggagagcggtaccacttgtg

SEQ ID NO: 11292 - DNA, 20 bp, Artificial Sequence
  Description of Artificial Sequence: Synthetic oligonucleotide
  Target: DMPK; (+) strand; PAM type: NRG; PAM sequence: CAG
gagcggtaccacttgtgggg

SEQ ID NO: 11293 - DNA, 20 bp, Artificial Sequence
  Description of Artificial Sequence: Synthetic oligonucleotide
  Target: DMPK; (+) strand; PAM type: NRG; PAM sequence: CAG
taccacttgtggggcagcca

SEQ ID NO: 11294 - DNA, 20 bp, Artificial Sequence
  Description of Artificial Sequence: Synthetic oligonucleotide
  Target: DMPK; (+) strand; PAM type: NRG; PAM sequence: CAG
cacttgtggggcagccacag

SEQ ID NO: 11295 - DNA, 20 bp, Artificial Sequence
  Description of Artificial Sequence: Synthetic oligonucleotide
  Target: DMPK; (+) strand; PAM type: NRG; PAM sequence: AGG
acttgtggggcagccacagc

SEQ ID NO: 11296 - DNA, 20 bp, Artificial Sequence
  Description of Artificial Sequence: Synthetic oligonucleotide
  Target: DMPK; (+) strand; PAM type: NRG; PAM sequence: TGG
ggggcagccacagcaggcac

SEQ ID NO: 11297 - DNA, 20 bp, Artificial Sequence
  Description of Artificial Sequence: Synthetic oligonucleotide
  Target: DMPK; (+) strand; PAM type: NRG; PAM sequence: CGG
gccacagcaggcactggccc

SEQ ID NO: 11298 - DNA, 20 bp, Artificial Sequence
  Description of Artificial Sequence: Synthetic oligonucleotide
  Target: DMPK; (+) strand; PAM type: NRG; PAM sequence: GGG
ccacagcaggcactggcccc

SEQ ID NO: 11299 - DNA, 20 bp, Artificial Sequence
  Description of Artificial Sequence: Synthetic oligonucleotide
  Target: DMPK; (+) strand; PAM type: NRG; PAM sequence: GGG
cacagcaggcactggccccg

SEQ ID NO: 11300 - DNA, 20 bp, Artificial Sequence
  Description of Artificial Sequence: Synthetic oligonucleotide
  Target: DMPK; (+) strand; PAM type: NRG; PAM sequence: GGG
acagcaggcactggccccgg

SEQ ID NO: 11301 - DNA, 20 bp, Artificial Sequence
  Description of Artificial Sequence: Synthetic oligonucleotide
  Target: DMPK; (+) strand; PAM type: NRG; PAM sequence: CAG
gcaggcactggccccggggg

SEQ ID NO: 11302 - DNA, 20 bp, Artificial Sequence
  Description of Artificial Sequence: Synthetic oligonucleotide
  Target: DMPK; (+) strand; PAM type: NRG; PAM sequence: GAG
aggcactggccccgggggca

SEQ ID NO: 11303 - DNA, 20 bp, Artificial Sequence
  Description of Artificial Sequence: Synthetic oligonucleotide
  Target: DMPK; (+) strand; PAM type: NRG; PAM sequence: AGG
ggcactggccccgggggcag

SEQ ID NO: 11304 - DNA, 20 bp, Artificial Sequence
  Description of Artificial Sequence: Synthetic oligonucleotide
  Target: DMPK; (+) strand; PAM type: NRG; PAM sequence: AAG
ctggccccgggggcagagga

SEQ ID NO: 11305 - DNA, 20 bp, Artificial Sequence
  Description of Artificial Sequence: Synthetic oligonucleotide
  Target: DMPK; (+) strand; PAM type: NRG; PAM sequence: AGG
tggccccgggggcagaggaa

SEQ ID NO: 11306 - DNA, 20 bp, Artificial Sequence
  Description of Artificial Sequence: Synthetic oligonucleotide
  Target: DMPK; (+) strand; PAM type: NRG; PAM sequence: TGG
ccccgggggcagaggaaagg

SEQ ID NO: 11307 - DNA, 20 bp, Artificial Sequence
  Description of Artificial Sequence: Synthetic oligonucleotide
  Target: DMPK; (+) strand; PAM type: NRG; PAM sequence: CAG
cgggggcagaggaaaggtgg

SEQ ID NO: 11308 - DNA, 20 bp, Artificial Sequence
  Description of Artificial Sequence: Synthetic oligonucleotide
  Target: DMPK; (+) strand; PAM type: NRG; PAM sequence: CGG
agaggaaaggtggcagccgt

SEQ ID NO: 11309 - DNA, 20 bp, Artificial Sequence
  Description of Artificial Sequence: Synthetic oligonucleotide
  Target: DMPK; (+) strand; PAM type: NRG; PAM sequence: GGG
gaggaaaggtggcagccgtc

SEQ ID NO: 11310 - DNA, 20 bp, Artificial Sequence
  Description of Artificial Sequence: Synthetic oligonucleotide
  Target: DMPK; (+) strand; PAM type: NRG; PAM sequence: GGG
aggaaaggtggcagccgtcg

SEQ ID NO: 11311 - DNA, 20 bp, Artificial Sequence
  Description of Artificial Sequence: Synthetic oligonucleotide
  Target: DMPK; (+) strand; PAM type: NRG; PAM sequence: GGG
ggaaaggtggcagccgtcgg

SEQ ID NO: 11312 - DNA, 20 bp, Artificial Sequence
  Description of Artificial Sequence: Synthetic oligonucleotide
  Target: DMPK; (+) strand; PAM type: NRG; PAM sequence: GGG
gaaaggtggcagccgtcggg

SEQ ID NO: 11313 - DNA, 20 bp, Artificial Sequence
  Description of Artificial Sequence: Synthetic oligonucleotide
  Target: DMPK; (+) strand; PAM type: NRG; PAM sequence: CAG
ggtggcagccgtcggggggc

SEQ ID NO: 11314 - DNA, 20 bp, Artificial Sequence
  Description of Artificial Sequence: Synthetic oligonucleotide
  Target: DMPK; (+) strand; PAM type: NRG; PAM sequence: AGG
gtggcagccgtcggggggcc

SEQ ID NO: 11315 - DNA, 20 bp, Artificial Sequence
  Description of Artificial Sequence: Synthetic oligonucleotide
  Target: DMPK; (+) strand; PAM type: NRG; PAM sequence: TGG
tcggggggccaggcaccact

SEQ ID NO: 11316 - DNA, 20 bp, Artificial Sequence
  Description of Artificial Sequence: Synthetic oligonucleotide
  Target: DMPK; (+) strand; PAM type: NRG; PAM sequence: GGG
cggggggccaggcaccactt

SEQ ID NO: 11317 - DNA, 20 bp, Artificial Sequence
  Description of Artificial Sequence: Synthetic oligonucleotide
  Target: DMPK; (+) strand; PAM type: NRG; PAM sequence: CAG
gggccaggcaccacttgggc

SEQ ID NO: 11318 - DNA, 20 bp, Artificial Sequence
  Description of Artificial Sequence: Synthetic oligonucleotide
  Target: DMPK; (+) strand; PAM type: NRG; PAM sequence: AGG
ggccaggcaccacttgggcc

SEQ ID NO: 11319 - DNA, 20 bp, Artificial Sequence
  Description of Artificial Sequence: Synthetic oligonucleotide
  Target: DMPK; (+) strand; PAM type: NRG; PAM sequence: GGG
gccaggcaccacttgggcca

SEQ ID NO: 11320 - DNA, 20 bp, Artificial Sequence
  Description of Artificial Sequence: Synthetic oligonucleotide
  Target: DMPK; (+) strand; PAM type: NRG; PAM sequence: GGG
ccaggcaccacttgggccag

SEQ ID NO: 11321 - DNA, 20 bp, Artificial Sequence
  Description of Artificial Sequence: Synthetic oligonucleotide
  Target: DMPK; (+) strand; PAM type: NRG; PAM sequence: CAG
accacttgggccaggggccc

SEQ ID NO: 11322 - DNA, 20 bp, Artificial Sequence
  Description of Artificial Sequence: Synthetic oligonucleotide
  Target: DMPK; (+) strand; PAM type: NRG; PAM sequence: AGG
ccacttgggccaggggcccc

SEQ ID NO: 11323 - DNA, 20 bp, Artificial Sequence
  Description of Artificial Sequence: Synthetic oligonucleotide
  Target: DMPK; (+) strand; PAM type: NRG; PAM sequence: AAG
ggccccaggacctcctctcc

SEQ ID NO: 11324 - DNA, 20 bp, Artificial Sequence
  Description of Artificial Sequence: Synthetic oligonucleotide
  Target: DMPK; (+) strand; PAM type: NRG; PAM sequence: AGG
gccccaggacctcctctcca

SEQ ID NO: 11325 - DNA, 20 bp, Artificial Sequence
  Description of Artificial Sequence: Synthetic oligonucleotide
  Target: DMPK; (+) strand; PAM type: NRG; PAM sequence: GGG
ccccaggacctcctctccaa

SEQ ID NO: 11326 - DNA, 20 bp, Artificial Sequence
  Description of Artificial Sequence: Synthetic oligonucleotide
  Target: DMPK; (+) strand; PAM type: NRG; PAM sequence: TGG
aggacctcctctccaagggc

SEQ ID NO: 11327 - DNA, 20 bp, Artificial Sequence
  Description of Artificial Sequence: Synthetic oligonucleotide
  Target: DMPK; (+) strand; PAM type: NRG; PAM sequence: CGG
tcctctccaagggctggtcc

SEQ ID NO: 11328 - DNA, 20 bp, Artificial Sequence
  Description of Artificial Sequence: Synthetic oligonucleotide
  Target: DMPK; (+) strand; PAM type: NRG; PAM sequence: GAG
ctctccaagggctggtcccg

SEQ ID NO: 11329 - DNA, 20 bp, Artificial Sequence
  Description of Artificial Sequence: Synthetic oligonucleotide
  Target: DMPK; (+) strand; PAM type: NRG; PAM sequence: CAG
tccaagggctggtcccggag

SEQ ID NO: 11330 - DNA, 20 bp, Artificial Sequence
  Description of Artificial Sequence: Synthetic oligonucleotide
  Target: DMPK; (+) strand; PAM type: NRG; PAM sequence: TGG
ctggtcccggagcagccacc

SEQ ID NO: 11331 - DNA, 20 bp, Artificial Sequence
  Description of Artificial Sequence: Synthetic oligonucleotide
  Target: DMPK; (+) strand; PAM type: NRG; PAM sequence: GGG
tggtcccggagcagccacct

SEQ ID NO: 11332 - DNA, 20 bp, Artificial Sequence
  Description of Artificial Sequence: Synthetic oligonucleotide
  Target: DMPK; (+) strand; PAM type: NRG; PAM sequence: TGG
agcagccacctgggcccctt

SEQ ID NO: 11333 - DNA, 20 bp, Artificial Sequence
  Description of Artificial Sequence: Synthetic oligonucleotide
  Target: DMPK; (+) strand; PAM type: NRG; PAM sequence: CAG
cacctgggcccctttggtct

SEQ ID NO: 11334 - DNA, 20 bp, Artificial Sequence
  Description of Artificial Sequence: Synthetic oligonucleotide
  Target: DMPK; (+) strand; PAM type: NRG; PAM sequence: AGG
acctgggcccctttggtctc

SEQ ID NO: 11335 - DNA, 20 bp, Artificial Sequence
  Description of Artificial Sequence: Synthetic oligonucleotide
  Target: DMPK; (+) strand; PAM type: NRG; PAM sequence: GGG
cctgggcccctttggtctca

SEQ ID NO: 11336 - DNA, 20 bp, Artificial Sequence
  Description of Artificial Sequence: Synthetic oligonucleotide
  Target: DMPK; (+) strand; PAM type: NRG; PAM sequence: GGG
ctgggcccctttggtctcag

SEQ ID NO: 11337 - DNA, 20 bp, Artificial Sequence
  Description of Artificial Sequence: Synthetic oligonucleotide
  Target: DMPK; (+) strand; PAM type: NRG; PAM sequence: GAG
ggtctcaggggcctccgact

SEQ ID NO: 11338 - DNA, 20 bp, Artificial Sequence
  Description of Artificial Sequence: Synthetic oligonucleotide
  Target: DMPK; (+) strand; PAM type: NRG; PAM sequence: CAG
gcctccgactgagcctcctc

SEQ ID NO: 11339 - DNA, 20 bp, Artificial Sequence
  Description of Artificial Sequence: Synthetic oligonucleotide
  Target: DMPK; (+) strand; PAM type: NRG; PAM sequence: GAG
cagccgcacctcccctgtct

SEQ ID NO: 11340 - DNA, 20 bp, Artificial Sequence
  Description of Artificial Sequence: Synthetic oligonucleotide
  Target: DMPK; (+) strand; PAM type: NRG; PAM sequence: AGG
agccgcacctcccctgtctg

SEQ ID NO: 11341 - DNA, 20 bp, Artificial Sequence
  Description of Artificial Sequence: Synthetic oligonucleotide
  Target: DMPK; (+) strand; PAM type: NRG; PAM sequence: GGG
gccgcacctcccctgtctga

SEQ ID NO: 11342 - DNA, 20 bp, Artificial Sequence
  Description of Artificial Sequence: Synthetic oligonucleotide
  Target: DMPK; (+) strand; PAM type: NRG; PAM sequence: CAG
acctcccctgtctgagggtc

SEQ ID NO: 11343 - DNA, 20 bp, Artificial Sequence
  Description of Artificial Sequence: Synthetic oligonucleotide
  Target: DMPK; (+) strand; PAM type: NRG; PAM sequence: AGG
cctcccctgtctgagggtcc

SEQ ID NO: 11344 - DNA, 20 bp, Artificial Sequence
  Description of Artificial Sequence: Synthetic oligonucleotide
  Target: DMPK; (+) strand; PAM type: NRG; PAM sequence: CAG
cctgtctgagggtccaggac

SEQ ID NO: 11345 - DNA, 20 bp, Artificial Sequence
  Description of Artificial Sequence: Synthetic oligonucleotide
  Target: DMPK; (+) strand; PAM type: NRG; PAM sequence: GAG
tgtctgagggtccaggacca

SEQ ID NO: 11346 - DNA, 20 bp, Artificial Sequence
  Description of Artificial Sequence: Synthetic oligonucleotide
  Target: DMPK; (+) strand; PAM type: NRG; PAM sequence: GAG
tctgagggtccaggaccaga

SEQ ID NO: 11347 - DNA, 20 bp, Artificial Sequence
  Description of Artificial Sequence: Synthetic oligonucleotide
  Target: DMPK; (+) strand; PAM type: NRG; PAM sequence: AGG
ctgagggtccaggaccagag

SEQ ID NO: 11348 - DNA, 20 bp, Artificial Sequence
  Description of Artificial Sequence: Synthetic oligonucleotide
  Target: DMPK; (+) strand; PAM type: NRG; PAM sequence: TGG
gtccaggaccagagaggtct

SEQ ID NO: 11349 - DNA, 20 bp, Artificial Sequence
  Description of Artificial Sequence: Synthetic oligonucleotide
  Target: DMPK; (+) strand; PAM type: NRG; PAM sequence: TGG
cagagaggtcttggtctcgc

SEQ ID NO: 11350 - DNA, 20 bp, Artificial Sequence
  Description of Artificial Sequence: Synthetic oligonucleotide
  Target: DMPK; (+) strand; PAM type: NRG; PAM sequence: GAG
cttggtctcgctggccccct

SEQ ID NO: 11351 - DNA, 20 bp, Artificial Sequence
  Description of Artificial Sequence: Synthetic oligonucleotide
  Target: DMPK; (+) strand; PAM type: NRG; PAM sequence: AGG
ttggtctcgctggccccctg

SEQ ID NO: 11352 - DNA, 20 bp, Artificial Sequence
  Description of Artificial Sequence: Synthetic oligonucleotide
  Target: DMPK; (+) strand; PAM type: NRG; PAM sequence: GGG
tggtctcgctggccccctga

SEQ ID NO: 11353 - DNA, 20 bp, Artificial Sequence
  Description of Artificial Sequence: Synthetic oligonucleotide
  Target: DMPK; (+) strand; PAM type: NRG; PAM sequence: TGG
ctcgctggccccctgagggc

SEQ ID NO: 11354 - DNA, 20 bp, Artificial Sequence
  Description of Artificial Sequence: Synthetic oligonucleotide
  Target: DMPK; (+) strand; PAM type: NRG; PAM sequence: GGG
tcgctggccccctgagggct

SEQ ID NO: 11355 - DNA, 20 bp, Artificial Sequence
  Description of Artificial Sequence: Synthetic oligonucleotide
  Target: DMPK; (+) strand; PAM type: NRG; PAM sequence: CGG
gccccctgagggctgggctg

SEQ ID NO: 11356 - DNA, 20 bp, Artificial Sequence
  Description of Artificial Sequence: Synthetic oligonucleotide
  Target: DMPK; (+) strand; PAM type: NRG; PAM sequence: TGG
ccctgagggctgggctgcgg

SEQ ID NO: 11357 - DNA, 20 bp, Artificial Sequence
  Description of Artificial Sequence: Synthetic oligonucleotide
  Target: DMPK; (+) strand; PAM type: NRG; PAM sequence: GAG
ctgagggctgggctgcggtg

SEQ ID NO: 11358 - DNA, 20 bp, Artificial Sequence
  Description of Artificial Sequence: Synthetic oligonucleotide
  Target: DMPK; (+) strand; PAM type: NRG; PAM sequence: AGG
tgagggctgggctgcggtgg

SEQ ID NO: 11359 - DNA, 20 bp, Artificial Sequence
  Description of Artificial Sequence: Synthetic oligonucleotide
  Target: DMPK; (+) strand; PAM type: NRG; PAM sequence: GGG
gagggctgggctgcggtgga

SEQ ID NO: 11360 - DNA, 20 bp, Artificial Sequence
  Description of Artificial Sequence: Synthetic oligonucleotide
  Target: DMPK; (+) strand; PAM type: NRG; PAM sequence: GGG
agggctgggctgcggtggag

SEQ ID NO: 11361 - DNA, 20 bp, Artificial Sequence
  Description of Artificial Sequence: Synthetic oligonucleotide
  Target: DMPK; (+) strand; PAM type: NRG; PAM sequence: CAG
tggaggggcacccccgcccc

SEQ ID NO: 11362 - DNA, 20 bp, Artificial Sequence
  Description of Artificial Sequence: Synthetic oligonucleotide
  Target: DMPK; (+) strand; PAM type: NRG; PAM sequence: GAG
ggggcacccccgcccccagt

SEQ ID NO: 11363 - DNA, 20 bp, Artificial Sequence
  Description of Artificial Sequence: Synthetic oligonucleotide
  Target: DMPK; (+) strand; PAM type: NRG; PAM sequence: CAG
gcacccccgcccccagtgag

SEQ ID NO: 11364 - DNA, 20 bp, Artificial Sequence
  Description of Artificial Sequence: Synthetic oligonucleotide
  Target: DMPK; (+) strand; PAM type: NRG; PAM sequence: CAG
cccccgcccccagtgagcag

SEQ ID NO: 11365 - DNA, 20 bp, Artificial Sequence
  Description of Artificial Sequence: Synthetic oligonucleotide
  Target: DMPK; (+) strand; PAM type: NRG; PAM sequence: CGG
ccgcccccagtgagcagcag

SEQ ID NO: 11366 - DNA, 20 bp, Artificial Sequence
  Description of Artificial Sequence: Synthetic oligonucleotide
  Target: DMPK; (+) strand; PAM type: NRG; PAM sequence: GGG
cgcccccagtgagcagcagc

SEQ ID NO: 11367 - DNA, 20 bp, Artificial Sequence
  Description of Artificial Sequence: Synthetic oligonucleotide
  Target: DMPK; (+) strand; PAM type: NRG; PAM sequence: CAG
ccagtgagcagcagcgggcc

SEQ ID NO: 11368 - DNA, 20 bp, Artificial Sequence
  Description of Artificial Sequence: Synthetic oligonucleotide
  Target: DMPK; (+) strand; PAM type: NRG; PAM sequence: AGG
cagtgagcagcagcgggccc

SEQ ID NO: 11369 - DNA, 20 bp, Artificial Sequence
  Description of Artificial Sequence: Synthetic oligonucleotide
  Target: DMPK; (+) strand; PAM type: NRG; PAM sequence: TGG
gagcagcagcgggcccaggc

SEQ ID NO: 11370 - DNA, 20 bp, Artificial Sequence
  Description of Artificial Sequence: Synthetic oligonucleotide
  Target: DMPK; (+) strand; PAM type: NRG; PAM sequence: GAG
gcagcagcgggcccaggctg

SEQ ID NO: 11371 - DNA, 20 bp, Artificial Sequence
  Description of Artificial Sequence: Synthetic oligonucleotide
  Target: DMPK; (+) strand; PAM type: NRG; PAM sequence: AGG
cagcagcgggcccaggctgg

SEQ ID NO: 11372 - DNA, 20 bp, Artificial Sequence
  Description of Artificial Sequence: Synthetic oligonucleotide
  Target: DMPK; (+) strand; PAM type: NRG; PAM sequence: CAG
cccaggctggaggcctcgcc

SEQ ID NO: 11373 - DNA, 20 bp, Artificial Sequence
  Description of Artificial Sequence: Synthetic oligonucleotide
  Target: DMPK; (+) strand; PAM type: NRG; PAM sequence: AGG
ccaggctggaggcctcgccc

SEQ ID NO: 11374 - DNA, 20 bp, Artificial Sequence
  Description of Artificial Sequence: Synthetic oligonucleotide
  Target: DMPK; (+) strand; PAM type: NRG; PAM sequence: GGG
caggctggaggcctcgccca

SEQ ID NO: 11375 - DNA, 20 bp, Artificial Sequence
  Description of Artificial Sequence: Synthetic oligonucleotide
  Target: DMPK; (+) strand; PAM type: NRG; PAM sequence: CAG
ctggaggcctcgcccagggc

SEQ ID NO: 11376 - DNA, 20 bp, Artificial Sequence
  Description of Artificial Sequence: Synthetic oligonucleotide
  Target: DMPK; (+) strand; PAM type: NRG; PAM sequence: AGG
tggaggcctcgcccagggcc

SEQ ID NO: 11377 - DNA, 20 bp, Artificial Sequence
  Description of Artificial Sequence: Synthetic oligonucleotide
  Target: DMPK; (+) strand; PAM type: NRG; PAM sequence: CGG
ggccaggccgttgatgatga

SEQ ID NO: 11378 - DNA, 20 bp, Artificial Sequence
  Description of Artificial Sequence: Synthetic oligonucleotide
  Target: DMPK; (+) strand; PAM type: NRG; PAM sequence: GGG
gccaggccgttgatgatgac

SEQ ID NO: 11379 - DNA, 20 bp, Artificial Sequence
  Description of Artificial Sequence: Synthetic oligonucleotide
  Target: DMPK; (+) strand; PAM type: NRG; PAM sequence: GGG
ccaggccgttgatgatgacg

SEQ ID NO: 11380 - DNA, 20 bp, Artificial Sequence
  Description of Artificial Sequence: Synthetic oligonucleotide
  Target: DMPK; (+) strand; PAM type: NRG; PAM sequence: GAG
atgatgacggggcccccgtt

SEQ ID NO: 11381 - DNA, 20 bp, Artificial Sequence
  Description of Artificial Sequence: Synthetic oligonucleotide
  Target: DMPK; (+) strand; PAM type: NRG; PAM sequence: AGG
tgatgacggggcccccgttg

SEQ ID NO: 11382 - DNA, 20 bp, Artificial Sequence
  Description of Artificial Sequence: Synthetic oligonucleotide
  Target: DMPK; (+) strand; PAM type: NRG; PAM sequence: GAG
atgacggggcccccgttgag

SEQ ID NO: 11383 - DNA, 20 bp, Artificial Sequence
  Description of Artificial Sequence: Synthetic oligonucleotide
  Target: DMPK; (+) strand; PAM type: NRG; PAM sequence: TGG
cccccgttgaggagcactgc

SEQ ID NO: 11384 - DNA, 20 bp, Artificial Sequence
  Description of Artificial Sequence: Synthetic oligonucleotide
  Target: DMPK; (+) strand; PAM type: NRG; PAM sequence: GGG
ccccgttgaggagcactgct

SEQ ID NO: 11385 - DNA, 20 bp, Artificial Sequence
  Description of Artificial Sequence: Synthetic oligonucleotide
  Target: DMPK; (+) strand; PAM type: NRG; PAM sequence: GGG
cccgttgaggagcactgctg

SEQ ID NO: 11386 - DNA, 20 bp, Artificial Sequence
  Description of Artificial Sequence: Synthetic oligonucleotide
  Target: DMPK; (+) strand; PAM type: NRG; PAM sequence: GAG
cgttgaggagcactgctggg

SEQ ID NO: 11387 - DNA, 20 bp, Artificial Sequence
  Description of Artificial Sequence: Synthetic oligonucleotide
  Target: DMPK; (+) strand; PAM type: NRG; PAM sequence: TGG
gagcactgctggggagccgc

SEQ ID NO: 11388 - DNA, 20 bp, Artificial Sequence
  Description of Artificial Sequence: Synthetic oligonucleotide
  Target: DMPK; (+) strand; PAM type: NRG; PAM sequence: CAG
gctggggagccgctggctgc

SEQ ID NO: 11389 - DNA, 20 bp, Artificial Sequence
  Description of Artificial Sequence: Synthetic oligonucleotide
  Target: DMPK; (+) strand; PAM type: NRG; PAM sequence: AGG
ctggggagccgctggctgcc

SEQ ID NO: 11390 - DNA, 20 bp, Artificial Sequence
  Description of Artificial Sequence: Synthetic oligonucleotide
  Target: DMPK; (+) strand; PAM type: NRG; PAM sequence: AAG
gggagccgctggctgccagg

SEQ ID NO: 11391 - DNA, 20 bp, Artificial Sequence
  Description of Artificial Sequence: Synthetic oligonucleotide
  Target: DMPK; (+) strand; PAM type: NRG; PAM sequence: CAG
gccaggaagctcccgttcac

SEQ ID NO: 11392 - DNA, 20 bp, Artificial Sequence
  Description of Artificial Sequence: Synthetic oligonucleotide
  Target: DMPK; (+) strand; PAM type: NRG; PAM sequence: AGG
ccaggaagctcccgttcacc

SEQ ID NO: 11393 - DNA, 20 bp, Artificial Sequence
  Description of Artificial Sequence: Synthetic oligonucleotide
  Target: DMPK; (+) strand; PAM type: NRG; PAM sequence: TGG
gaagctcccgttcaccagga

SEQ ID NO: 11394 - DNA, 20 bp, Artificial Sequence
  Description of Artificial Sequence: Synthetic oligonucleotide
  Target: DMPK; (+) strand; PAM type: NRG; PAM sequence: GAG
agctcccgttcaccaggatg

SEQ ID NO: 11395 - DNA, 20 bp, Artificial Sequence
  Description of Artificial Sequence: Synthetic oligonucleotide
  Target: DMPK; (+) strand; PAM type: NRG; PAM sequence: AGG
gctcccgttcaccaggatgg

SEQ ID NO: 11396 - DNA, 20 bp, Artificial Sequence
  Description of Artificial Sequence: Synthetic oligonucleotide
  Target: DMPK; (+) strand; PAM type: NRG; PAM sequence: GAG
tcccgttcaccaggatggag

SEQ ID NO: 11397 - DNA, 20 bp, Artificial Sequence
  Description of Artificial Sequence: Synthetic oligonucleotide
  Target: DMPK; (+) strand; PAM type: NRG; PAM sequence: AGG
cccgttcaccaggatggagg

SEQ ID NO: 11398 - DNA, 20 bp, Artificial Sequence
  Description of Artificial Sequence: Synthetic oligonucleotide
  Target: DMPK; (+) strand; PAM type: NRG; PAM sequence: AAG
gttcaccaggatggaggagg

SEQ ID NO: 11399 - DNA, 20 bp, Artificial Sequence
  Description of Artificial Sequence: Synthetic oligonucleotide
  Target: DMPK; (+) strand; PAM type: NRG; PAM sequence: CGG
accaggatggaggaggaagc

SEQ ID NO: 11400 - DNA, 20 bp, Artificial Sequence
  Description of Artificial Sequence: Synthetic oligonucleotide
  Target: DMPK; (+) strand; PAM type: NRG; PAM sequence: GGG
ccaggatggaggaggaagcc

SEQ ID NO: 11401 - DNA, 20 bp, Artificial Sequence
  Description of Artificial Sequence: Synthetic oligonucleotide
  Target: DMPK; (+) strand; PAM type: NRG; PAM sequence: AAG
gatggaggaggaagccgggc

SEQ ID NO: 11402 - DNA, 20 bp, Artificial Sequence
  Description of Artificial Sequence: Synthetic oligonucleotide
  Target: DMPK; (+) strand; PAM type: NRG; PAM sequence: AGG
atggaggaggaagccgggca

SEQ ID NO: 11403 - DNA, 20 bp, Artificial Sequence
  Description of Artificial Sequence: Synthetic oligonucleotide
  Target: DMPK; (+) strand; PAM type: NRG; PAM sequence: CGG
ggaggaagccgggcaaggcg

SEQ ID NO: 11404 - DNA, 20 bp, Artificial Sequence
  Description of Artificial Sequence: Synthetic oligonucleotide
  Target: DMPK; (+) strand; PAM type: NRG; PAM sequence: GGG
gaggaagccgggcaaggcgc

SEQ ID NO: 11405 - DNA, 20 bp, Artificial Sequence
  Description of Artificial Sequence: Synthetic oligonucleotide
  Target: DMPK; (+) strand; PAM type: NRG; PAM sequence: GAG
ggaagccgggcaaggcgcgg

SEQ ID NO: 11406 - DNA, 20 bp, Artificial Sequence
  Description of Artificial Sequence: Synthetic oligonucleotide
  Target: DMPK; (+) strand; PAM type: NRG; PAM sequence: AGG
gaagccgggcaaggcgcggg

SEQ ID NO: 11407 - DNA, 20 bp, Artificial Sequence
  Description of Artificial Sequence: Synthetic oligonucleotide
  Target: DMPK; (+) strand; PAM type: NRG; PAM sequence: GGG
aagccgggcaaggcgcggga

SEQ ID NO: 11408 - DNA, 20 bp, Artificial Sequence
  Description of Artificial Sequence: Synthetic oligonucleotide
  Target: DMPK; (+) strand; PAM type: NRG; PAM sequence: CGG
cgggcaaggcgcgggagggc

SEQ ID NO: 11409 - DNA, 20 bp, Artificial Sequence
  Description of Artificial Sequence: Synthetic oligonucleotide
  Target: DMPK; (+) strand; PAM type: NRG; PAM sequence: CAG
gcgggagggccggtccctgc

SEQ ID NO: 11410 - DNA, 20 bp, Artificial Sequence
  Description of Artificial Sequence: Synthetic oligonucleotide
  Target: DMPK; (+) strand; PAM type: NRG; PAM sequence: AGG
cgggagggccggtccctgcc

SEQ ID NO: 11411 - DNA, 20 bp, Artificial Sequence
  Description of Artificial Sequence: Synthetic oligonucleotide
  Target: DMPK; (+) strand; PAM type: NRG; PAM sequence: TGG
gccggtccctgccaggaata

SEQ ID NO: 11412 - DNA, 20 bp, Artificial Sequence
  Description of Artificial Sequence: Synthetic oligonucleotide
  Target: DMPK; (+) strand; PAM type: NRG; PAM sequence: GAG
cggtccctgccaggaatatg

SEQ ID NO: 11413 - DNA, 20 bp, Artificial Sequence
  Description of Artificial Sequence: Synthetic oligonucleotide
  Target: DMPK; (+) strand; PAM type: NRG; PAM sequence: TGG
ctgccaggaatatggagccc

SEQ ID NO: 11414 - DNA, 20 bp, Artificial Sequence
  Description of Artificial Sequence: Synthetic oligonucleotide
  Target: DMPK; (+) strand; PAM type: NRG; PAM sequence: GGG
tgccaggaatatggagccct

SEQ ID NO: 11415 - DNA, 20 bp, Artificial Sequence
  Description of Artificial Sequence: Synthetic oligonucleotide
  Target: DMPK; (+) strand; PAM type: NRG; PAM sequence: CAG
caggaatatggagccctggg

SEQ ID NO: 11416 - DNA, 20 bp, Artificial Sequence
  Description of Artificial Sequence: Synthetic oligonucleotide
  Target: DMPK; (+) strand; PAM type: NRG; PAM sequence: CGG
gaatatggagccctgggcag

SEQ ID NO: 11417 - DNA, 20 bp, Artificial Sequence
  Description of Artificial Sequence: Synthetic oligonucleotide
  Target: DMPK; (+) strand; PAM type: NRG; PAM sequence: CGG
ggagccctgggcagcggcct

SEQ ID NO: 11418 - DNA, 20 bp, Artificial Sequence
  Description of Artificial Sequence: Synthetic oligonucleotide
  Target: DMPK; (+) strand; PAM type: NRG; PAM sequence: CGG
gccctgggcagcggcctcgg

SEQ ID NO: 11419 - DNA, 20 bp, Artificial Sequence
  Description of Artificial Sequence: Synthetic oligonucleotide
  Target: DMPK; (+) strand; PAM type: NRG; PAM sequence: TGG
gcagcggcctcggcggacac

SEQ ID NO: 11420 - DNA, 20 bp, Artificial Sequence
  Description of Artificial Sequence: Synthetic oligonucleotide
  Target: DMPK; (+) strand; PAM type: NRG; PAM sequence: GGG
cagcggcctcggcggacact

SEQ ID NO: 11421 - DNA, 20 bp, Artificial Sequence
  Description of Artificial Sequence: Synthetic oligonucleotide
  Target: DMPK; (+) strand; PAM type: NRG; PAM sequence: GGG
agcggcctcggcggacactg

SEQ ID NO: 11422 - DNA, 20 bp, Artificial Sequence
  Description of Artificial Sequence: Synthetic oligonucleotide
  Target: DMPK; (+) strand; PAM type: NRG; PAM sequence: CAG
actggggccgcccctctctc

SEQ ID NO: 11423 - DNA, 20 bp, Artificial Sequence
  Description of Artificial Sequence: Synthetic oligonucleotide
  Target: DMPK; (+) strand; PAM type: NRG; PAM sequence: AGG
ctggggccgcccctctctcc

SEQ ID NO: 11424 - DNA, 20 bp, Artificial Sequence
  Description of Artificial Sequence: Synthetic oligonucleotide
  Target: DMPK; (+) strand; PAM type: NRG; PAM sequence: CAG
cgcccctctctccaggtcct

SEQ ID NO: 11425 - DNA, 20 bp, Artificial Sequence
  Description of Artificial Sequence: Synthetic oligonucleotide
  Target: DMPK; (+) strand; PAM type: NRG; PAM sequence: AGG
gcccctctctccaggtcctc

SEQ ID NO: 11426 - DNA, 20 bp, Artificial Sequence
  Description of Artificial Sequence: Synthetic oligonucleotide
  Target: DMPK; (+) strand; PAM type: NRG; PAM sequence: CGG
tctccaggtcctcaggactt

SEQ ID NO: 11427 - DNA, 20 bp, Artificial Sequence
  Description of Artificial Sequence: Synthetic oligonucleotide
  Target: DMPK; (+) strand; PAM type: NRG; PAM sequence: TGG
caggtcctcaggacttcggc

SEQ ID NO: 11428 - DNA, 20 bp, Artificial Sequence
  Description of Artificial Sequence: Synthetic oligonucleotide
  Target: DMPK; (+) strand; PAM type: NRG; PAM sequence: CAG
acttcggctggactcgtcct

SEQ ID NO: 11429 - DNA, 20 bp, Artificial Sequence
  Description of Artificial Sequence: Synthetic oligonucleotide
  Target: DMPK; (+) strand; PAM type: NRG; PAM sequence: TGG
gctggactcgtcctcagtcg

SEQ ID NO: 11430 - DNA, 20 bp, Artificial Sequence
  Description of Artificial Sequence: Synthetic oligonucleotide
  Target: DMPK; (+) strand; PAM type: NRG; PAM sequence: GGG
ctggactcgtcctcagtcgt

SEQ ID NO: 11431 - DNA, 20 bp, Artificial Sequence
  Description of Artificial Sequence: Synthetic oligonucleotide
  Target: DMPK; (+) strand; PAM type: NRG; PAM sequence: CAG
ctcagtcgtgggattcccat

SEQ ID NO: 11432 - DNA, 20 bp, Artificial Sequence
  Description of Artificial Sequence: Synthetic oligonucleotide
  Target: DMPK; (+) strand; PAM type: NRG; PAM sequence: TGG
gggattcccatcagactcgc

SEQ ID NO: 11433 - DNA, 20 bp, Artificial Sequence
  Description of Artificial Sequence: Synthetic oligonucleotide
  Target: DMPK; (+) strand; PAM type: NRG; PAM sequence: CGG
ttcccatcagactcgctggc

SEQ ID NO: 11434 - DNA, 20 bp, Artificial Sequence
  Description of Artificial Sequence: Synthetic oligonucleotide
  Target: DMPK; (+) strand; PAM type: NRG; PAM sequence: GAG
cccatcagactcgctggccg

SEQ ID NO: 11435 - DNA, 20 bp, Artificial Sequence
  Description of Artificial Sequence: Synthetic oligonucleotide
  Target: DMPK; (+) strand; PAM type: NRG; PAM sequence: TGG
agactcgctggccggagaaa

SEQ ID NO: 11436 - DNA, 20 bp, Artificial Sequence
  Description of Artificial Sequence: Synthetic oligonucleotide
  Target: DMPK; (+) strand; PAM type: NRG; PAM sequence: CAG
ctggccggagaaatggctgt

SEQ ID NO: 11437 - DNA, 20 bp, Artificial Sequence
  Description of Artificial Sequence: Synthetic oligonucleotide
  Target: DMPK; (+) strand; PAM type: NRG; PAM sequence: TGG
ccggagaaatggctgtcagc

SEQ ID NO: 11438 - DNA, 20 bp, Artificial Sequence
  Description of Artificial Sequence: Synthetic oligonucleotide
  Target: DMPK; (+) strand; PAM type: NRG; PAM sequence: GGG
cggagaaatggctgtcagct

SEQ ID NO: 11439 - DNA, 20 bp, Artificial Sequence
  Description of Artificial Sequence: Synthetic oligonucleotide
  Target: DMPK; (+) strand; PAM type: NRG; PAM sequence: GGG
ggagaaatggctgtcagctg

SEQ ID NO: 11440 - DNA, 20 bp, Artificial Sequence
  Description of Artificial Sequence: Synthetic oligonucleotide
  Target: DMPK; (+) strand; PAM type: NRG; PAM sequence: TAG
ggctgtcagctggggtccct

SEQ ID NO: 11441 - DNA, 20 bp, Artificial Sequence
  Description of Artificial Sequence: Synthetic oligonucleotide
  Target: DMPK; (+) strand; PAM type: NRG; PAM sequence: TGG
agctggggtcccttagcctg

SEQ ID NO: 11442 - DNA, 20 bp, Artificial Sequence
  Description of Artificial Sequence: Synthetic oligonucleotide
  Target: DMPK; (+) strand; PAM type: NRG; PAM sequence: GGG
gctggggtcccttagcctgt

SEQ ID NO: 11443 - DNA, 20 bp, Artificial Sequence
  Description of Artificial Sequence: Synthetic oligonucleotide
  Target: DMPK; (+) strand; PAM type: NRG; PAM sequence: GGG
ctggggtcccttagcctgtg

SEQ ID NO: 11444 - DNA, 20 bp, Artificial Sequence
  Description of Artificial Sequence: Synthetic oligonucleotide
  Target: DMPK; (+) strand; PAM type: NRG; PAM sequence: TAG
agcctgtggggcctcccgca

SEQ ID NO: 11445 - DNA, 20 bp, Artificial Sequence
  Description of Artificial Sequence: Synthetic oligonucleotide
  Target: DMPK; (+) strand; PAM type: NRG; PAM sequence: CAG
tgtggggcctcccgcatagc

SEQ ID NO: 11446 - DNA, 20 bp, Artificial Sequence
  Description of Artificial Sequence: Synthetic oligonucleotide
  Target: DMPK; (+) strand; PAM type: NRG; PAM sequence: CAG
gggcctcccgcatagccagc

SEQ ID NO: 11447 - DNA, 20 bp, Artificial Sequence
  Description of Artificial Sequence: Synthetic oligonucleotide
  Target: DMPK; (+) strand; PAM type: NRG; PAM sequence: TGG
gctgctcccccacctttccc

SEQ ID NO: 11448 - DNA, 20 bp, Artificial Sequence
  Description of Artificial Sequence: Synthetic oligonucleotide
  Target: DMPK; (+) strand; PAM type: NRG; PAM sequence: AAG
cccccacctttccctggccc

SEQ ID NO: 11449 - DNA, 20 bp, Artificial Sequence
  Description of Artificial Sequence: Synthetic oligonucleotide
  Target: DMPK; (+) strand; PAM type: NRG; PAM sequence: CGG
cctttccctggcccaagttt

SEQ ID NO: 11450 - DNA, 20 bp, Artificial Sequence
  Description of Artificial Sequence: Synthetic oligonucleotide
  Target: DMPK; (+) strand; PAM type: NRG; PAM sequence: TGG
ttccctggcccaagtttcgg

SEQ ID NO: 11451 - DNA, 20 bp, Artificial Sequence
  Description of Artificial Sequence: Synthetic oligonucleotide
  Target: DMPK; (+) strand; PAM type: NRG; PAM sequence: CAG
caagtttcggtggatcattc

SEQ ID NO: 11452 - DNA, 20 bp, Artificial Sequence
  Description of Artificial Sequence: Synthetic oligonucleotide
  Target: DMPK; (+) strand; PAM type: NRG; PAM sequence: AGG
aagtttcggtggatcattcc

SEQ ID NO: 11453 - DNA, 20 bp, Artificial Sequence
  Description of Artificial Sequence: Synthetic oligonucleotide
  Target: DMPK; (+) strand; PAM type: NRG; PAM sequence: GGG
agtttcggtggatcattcca

SEQ ID NO: 11454 - DNA, 20 bp, Artificial Sequence
  Description of Artificial Sequence: Synthetic oligonucleotide
  Target: DMPK; (+) strand; PAM type: NRG; PAM sequence: GGG
gtttcggtggatcattccag

SEQ ID NO: 11455 - DNA, 20 bp, Artificial Sequence
  Description of Artificial Sequence: Synthetic oligonucleotide
  Target: DMPK; (+) strand; PAM type: NRG; PAM sequence: GAG
aggggttatgacgcctctct

SEQ ID NO: 11456 - DNA, 20 bp, Artificial Sequence
  Description of Artificial Sequence: Synthetic oligonucleotide
  Target: DMPK; (+) strand; PAM type: NRG; PAM sequence: CAG
tctgagaccactccaaactc

SEQ ID NO: 11457 - DNA, 20 bp, Artificial Sequence
  Description of Artificial Sequence: Synthetic oligonucleotide
  Target: DMPK; (+) strand; PAM type: NRG; PAM sequence: AGG
ctgagaccactccaaactcc

SEQ ID NO: 11458 - DNA, 20 bp, Artificial Sequence
  Description of Artificial Sequence: Synthetic oligonucleotide
  Target: DMPK; (+) strand; PAM type: NRG; PAM sequence: GGG
tgagaccactccaaactcca

SEQ ID NO: 11459 - DNA, 20 bp, Artificial Sequence
  Description of Artificial Sequence: Synthetic oligonucleotide
  Target: DMPK; (+) strand; PAM type: NRG; PAM sequence: AAG
caaactccagggccttttgc

SEQ ID NO: 11460 - DNA, 20 bp, Artificial Sequence
  Description of Artificial Sequence: Synthetic oligonucleotide
  Target: DMPK; (+) strand; PAM type: NRG; PAM sequence: TGG
ggccttttgcaagccctgcg

SEQ ID NO: 11461 - DNA, 20 bp, Artificial Sequence
  Description of Artificial Sequence: Synthetic oligonucleotide
  Target: DMPK; (+) strand; PAM type: NRG; PAM sequence: CAG
gccctgcgtggacaccactg

SEQ ID NO: 11462 - DNA, 20 bp, Artificial Sequence
  Description of Artificial Sequence: Synthetic oligonucleotide
  Target: DMPK; (+) strand; PAM type: NRG; PAM sequence: GAG
cctgcgtggacaccactgca

SEQ ID NO: 11463 - DNA, 20 bp, Artificial Sequence
  Description of Artificial Sequence: Synthetic oligonucleotide
  Target: DMPK; (+) strand; PAM type: NRG; PAM sequence: AAG
gcgtggacaccactgcagag

SEQ ID NO: 11464 - DNA, 20 bp, Artificial Sequence
  Description of Artificial Sequence: Synthetic oligonucleotide
  Target: DMPK; (+) strand; PAM type: NRG; PAM sequence: TGG
acaccactgcagagaagcgc

SEQ ID NO: 11465 - DNA, 20 bp, Artificial Sequence
  Description of Artificial Sequence: Synthetic oligonucleotide
  Target: DMPK; (+) strand; PAM type: NRG; PAM sequence: GGG
caccactgcagagaagcgct

SEQ ID NO: 11466 - DNA, 20 bp, Artificial Sequence
  Description of Artificial Sequence: Synthetic oligonucleotide
  Target: DMPK; (+) strand; PAM type: NRG; PAM sequence: GGG
accactgcagagaagcgctg

SEQ ID NO: 11467 - DNA, 20 bp, Artificial Sequence
  Description of Artificial Sequence: Synthetic oligonucleotide
  Target: DMPK; (+) strand; PAM type: NRG; PAM sequence: GAG
cactgcagagaagcgctggg

SEQ ID NO: 11468 - DNA, 20 bp, Artificial Sequence
  Description of Artificial Sequence: Synthetic oligonucleotide
  Target: DMPK; (+) strand; PAM type: NRG; PAM sequence: AGG
actgcagagaagcgctgggg

SEQ ID NO: 11469 - DNA, 20 bp, Artificial Sequence
  Description of Artificial Sequence: Synthetic oligonucleotide
  Target: DMPK; (+) strand; PAM type: NRG; PAM sequence: GGG
ctgcagagaagcgctgggga

SEQ ID NO: 11470 - DNA, 20 bp, Artificial Sequence
  Description of Artificial Sequence: Synthetic oligonucleotide
  Target: DMPK; (+) strand; PAM type: NRG; PAM sequence: AAG
cagagaagcgctggggaggg

SEQ ID NO: 11471 - DNA, 20 bp, Artificial Sequence
  Description of Artificial Sequence: Synthetic oligonucleotide
  Target: DMPK; (+) strand; PAM type: NRG; PAM sequence: GAG
gagaagcgctggggagggaa

SEQ ID NO: 11472 - DNA, 20 bp, Artificial Sequence
  Description of Artificial Sequence: Synthetic oligonucleotide
  Target: DMPK; (+) strand; PAM type: NRG; PAM sequence: AGG
agaagcgctggggagggaag

SEQ ID NO: 11473 - DNA, 20 bp, Artificial Sequence
  Description of Artificial Sequence: Synthetic oligonucleotide
  Target: DMPK; (+) strand; PAM type: NRG; PAM sequence: CGG
gcccttgctctcccccacct

SEQ ID NO: 11474 - DNA, 20 bp, Artificial Sequence
  Description of Artificial Sequence: Synthetic oligonucleotide
  Target: DMPK; (+) strand; PAM type: NRG; PAM sequence: CGG
gctctcccccacctcggcct

SEQ ID NO: 11475 - DNA, 20 bp, Artificial Sequence
  Description of Artificial Sequence: Synthetic oligonucleotide
  Target: DMPK; (+) strand; PAM type: NRG; PAM sequence: GGG
ctctcccccacctcggcctc

SEQ ID NO: 11476 - DNA, 20 bp, Artificial Sequence
  Description of Artificial Sequence: Synthetic oligonucleotide
  Target: DMPK; (+) strand; PAM type: NRG; PAM sequence: CAG
ccacctcggcctcgggtccc

SEQ ID NO: 11477 - DNA, 20 bp, Artificial Sequence
  Description of Artificial Sequence: Synthetic oligonucleotide
  Target: DMPK; (+) strand; PAM type: NRG; PAM sequence: GAG
acctcggcctcgggtcccca

SEQ ID NO: 11478 - DNA, 20 bp, Artificial Sequence
  Description of Artificial Sequence: Synthetic oligonucleotide
  Target: DMPK; (+) strand; PAM type: NRG; PAM sequence: AGG
cctcggcctcgggtccccag

SEQ ID NO: 11479 - DNA, 20 bp, Artificial Sequence
  Description of Artificial Sequence: Synthetic oligonucleotide
  Target: DMPK; (+) strand; PAM type: NRG; PAM sequence: GAG
gcctcgggtccccagaggct

SEQ ID NO: 11480 - DNA, 20 bp, Artificial Sequence
  Description of Artificial Sequence: Synthetic oligonucleotide
  Target: DMPK; (+) strand; PAM type: NRG; PAM sequence: CAG
gtccccagaggctgagctcc

SEQ ID NO: 11481 - DNA, 20 bp, Artificial Sequence
  Description of Artificial Sequence: Synthetic oligonucleotide
  Target: DMPK; (+) strand; PAM type: NRG; PAM sequence: AGG
tccccagaggctgagctccc

SEQ ID NO: 11482 - DNA, 20 bp, Artificial Sequence
  Description of Artificial Sequence: Synthetic oligonucleotide
  Target: DMPK; (+) strand; PAM type: NRG; PAM sequence: AAG
gagctcccaggttgccctaa

SEQ ID NO: 11483 - DNA, 20 bp, Artificial Sequence
  Description of Artificial Sequence: Synthetic oligonucleotide
  Target: DMPK; (+) strand; PAM type: NRG; PAM sequence: TGG
aggttgccctaaaagttcct

SEQ ID NO: 11484 - DNA, 20 bp, Artificial Sequence
  Description of Artificial Sequence: Synthetic oligonucleotide
  Target: DMPK; (+) strand; PAM type: NRG; PAM sequence: TGG
tgccctaaaagttccttggt

SEQ ID NO: 11485 - DNA, 20 bp, Artificial Sequence
  Description of Artificial Sequence: Synthetic oligonucleotide
  Target: DMPK; (+) strand; PAM type: NRG; PAM sequence: GGG
gccctaaaagttccttggtt

SEQ ID NO: 11486 - DNA, 20 bp, Artificial Sequence
  Description of Artificial Sequence: Synthetic oligonucleotide
  Target: DMPK; (+) strand; PAM type: NRG; PAM sequence: CGG
ctaaaagttccttggttggg

SEQ ID NO: 11487 - DNA, 20 bp, Artificial Sequence
  Description of Artificial Sequence: Synthetic oligonucleotide
  Target: DMPK; (+) strand; PAM type: NRG; PAM sequence: AAG
aagttccttggttgggcgga

SEQ ID NO: 11488 - DNA, 20 bp, Artificial Sequence
  Description of Artificial Sequence: Synthetic oligonucleotide
  Target: DMPK; (+) strand; PAM type: NRG; PAM sequence: CGG
ttccttggttgggcggaaag

SEQ ID NO: 11489 - DNA, 20 bp, Artificial Sequence
  Description of Artificial Sequence: Synthetic oligonucleotide
  Target: DMPK; (+) strand; PAM type: NRG; PAM sequence: GGG
tccttggttgggcggaaagc

SEQ ID NO: 11490 - DNA, 20 bp, Artificial Sequence
  Description of Artificial Sequence: Synthetic oligonucleotide
  Target: DMPK; (+) strand; PAM type: NRG; PAM sequence: GAG
tggttgggcggaaagcgggc

SEQ ID NO: 11491 - DNA, 20 bp, Artificial Sequence
  Description of Artificial Sequence: Synthetic oligonucleotide
  Target: DMPK; (+) strand; PAM type: NRG; PAM sequence: TGG
ttgggcggaaagcgggcgag

SEQ ID NO: 11492 - DNA, 20 bp, Artificial Sequence
  Description of Artificial Sequence: Synthetic oligonucleotide
  Target: DMPK; (+) strand; PAM type: NRG; PAM sequence: TGG
cggaaagcgggcgagtggcc

SEQ ID NO: 11493 - DNA, 20 bp, Artificial Sequence
  Description of Artificial Sequence: Synthetic oligonucleotide
  Target: DMPK; (+) strand; PAM type: NRG; PAM sequence: GAG
gaaagcgggcgagtggcctg

SEQ ID NO: 11494 - DNA, 20 bp, Artificial Sequence
  Description of Artificial Sequence: Synthetic oligonucleotide
  Target: DMPK; (+) strand; PAM type: NRG; PAM sequence: GAG
aagcgggcgagtggcctgga

SEQ ID NO: 11495 - DNA, 20 bp, Artificial Sequence
  Description of Artificial Sequence: Synthetic oligonucleotide
  Target: DMPK; (+) strand; PAM type: NRG; PAM sequence: GAG
gcgggcgagtggcctggaga

SEQ ID NO: 11496 - DNA, 20 bp, Artificial Sequence
  Description of Artificial Sequence: Synthetic oligonucleotide
  Target: DMPK; (+) strand; PAM type: NRG; PAM sequence: AGG
cgggcgagtggcctggagag

SEQ ID NO: 11497 - DNA, 20 bp, Artificial Sequence
  Description of Artificial Sequence: Synthetic oligonucleotide
  Target: DMPK; (+) strand; PAM type: NRG; PAM sequence: GGG
gggcgagtggcctggagaga

SEQ ID NO: 11498 - DNA, 20 bp, Artificial Sequence
  Description of Artificial Sequence: Synthetic oligonucleotide
  Target: DMPK; (+) strand; PAM type: NRG; PAM sequence: GAG
gcgagtggcctggagagagg

SEQ ID NO: 11499 - DNA, 20 bp, Artificial Sequence
  Description of Artificial Sequence: Synthetic oligonucleotide
  Target: DMPK; (+) strand; PAM type: NRG; PAM sequence: CAG
agtggcctggagagagggag

SEQ ID NO: 11500 - DNA, 20 bp, Artificial Sequence
  Description of Artificial Sequence: Synthetic oligonucleotide
  Target: DMPK; (+) strand; PAM type: NRG; PAM sequence: CAG
ggcctggagagagggagcag

SEQ ID NO: 11501 - DNA, 20 bp, Artificial Sequence
  Description of Artificial Sequence: Synthetic oligonucleotide
  Target: DMPK; (+) strand; PAM type: NRG; PAM sequence: CAG
agagagggagcagcagccgc

SEQ ID NO: 11502 - DNA, 20 bp, Artificial Sequence
  Description of Artificial Sequence: Synthetic oligonucleotide
  Target: DMPK; (+) strand; PAM type: NRG; PAM sequence: CAG
gggagcagcagccgccagcc

SEQ ID NO: 11503 - DNA, 20 bp, Artificial Sequence
  Description of Artificial Sequence: Synthetic oligonucleotide
  Target: DMPK; (+) strand; PAM type: NRG; PAM sequence: CGG
gcagccgccagcccagttcc

SEQ ID NO: 11504 - DNA, 20 bp, Artificial Sequence
  Description of Artificial Sequence: Synthetic oligonucleotide
  Target: DMPK; (+) strand; PAM type: NRG; PAM sequence: CGG
agttcccggtgccctccccg

SEQ ID NO: 11505 - DNA, 20 bp, Artificial Sequence
  Description of Artificial Sequence: Synthetic oligonucleotide
  Target: DMPK; (+) strand; PAM type: NRG; PAM sequence: GGG
gttcccggtgccctccccgc

SEQ ID NO: 11506 - DNA, 20 bp, Artificial Sequence
  Description of Artificial Sequence: Synthetic oligonucleotide
  Target: DMPK; (+) strand; PAM type: NRG; PAM sequence: GGG
ttcccggtgccctccccgcg

SEQ ID NO: 11507 - DNA, 20 bp, Artificial Sequence
  Description of Artificial Sequence: Synthetic oligonucleotide
  Target: DMPK; (+) strand; PAM type: NRG; PAM sequence: CAG
gtgccctccccgcggggcgt

SEQ ID NO: 11508 - DNA, 20 bp, Artificial Sequence
  Description of Artificial Sequence: Synthetic oligonucleotide
  Target: DMPK; (+) strand; PAM type: NRG; PAM sequence: GAG
gccctccccgcggggcgtca

SEQ ID NO: 11509 - DNA, 20 bp, Artificial Sequence
  Description of Artificial Sequence: Synthetic oligonucleotide
  Target: DMPK; (+) strand; PAM type: NRG; PAM sequence: AAG
ctccccgcggggcgtcagag

SEQ ID NO: 11510 - DNA, 20 bp, Artificial Sequence
  Description of Artificial Sequence: Synthetic oligonucleotide
  Target: DMPK; (+) strand; PAM type: NRG; PAM sequence: AGG
tccccgcggggcgtcagaga

SEQ ID NO: 11511 - DNA, 20 bp, Artificial Sequence
  Description of Artificial Sequence: Synthetic oligonucleotide
  Target: DMPK; (+) strand; PAM type: NRG; PAM sequence: GGG
ccccgcggggcgtcagagaa

SEQ ID NO: 11512 - DNA, 20 bp, Artificial Sequence
  Description of Artificial Sequence: Synthetic oligonucleotide
  Target: DMPK; (+) strand; PAM type: NRG; PAM sequence: GAG
ccgcggggcgtcagagaagg

SEQ ID NO: 11513 - DNA, 20 bp, Artificial Sequence
  Description of Artificial Sequence: Synthetic oligonucleotide
  Target: DMPK; (+) strand; PAM type: NRG; PAM sequence: GAG
gcggggcgtcagagaaggga

SEQ ID NO: 11514 - DNA, 20 bp, Artificial Sequence
  Description of Artificial Sequence: Synthetic oligonucleotide
  Target: DMPK; (+) strand; PAM type: NRG; PAM sequence: AGG
cggggcgtcagagaagggag

SEQ ID NO: 11515 - DNA, 20 bp, Artificial Sequence
  Description of Artificial Sequence: Synthetic oligonucleotide
  Target: DMPK; (+) strand; PAM type: NRG; PAM sequence: CGG
gcgtcagagaagggagaggc

SEQ ID NO: 11516 - DNA, 20 bp, Artificial Sequence
  Description of Artificial Sequence: Synthetic oligonucleotide
  Target: DMPK; (+) strand; PAM type: NRG; PAM sequence: CAG
agaagggagaggccggcgct

SEQ ID NO: 11517 - DNA, 20 bp, Artificial Sequence
  Description of Artificial Sequence: Synthetic oligonucleotide
  Target: DMPK; (+) strand; PAM type: NRG; PAM sequence: AGG
gaagggagaggccggcgctc

SEQ ID NO: 11518 - DNA, 20 bp, Artificial Sequence
  Description of Artificial Sequence: Synthetic oligonucleotide
  Target: DMPK; (+) strand; PAM type: NRG; PAM sequence: GGG
aagggagaggccggcgctca

SEQ ID NO: 11519 - DNA, 20 bp, Artificial Sequence
  Description of Artificial Sequence: Synthetic oligonucleotide
  Target: DMPK; (+) strand; PAM type: NRG; PAM sequence: TGG
ggagaggccggcgctcaggg

SEQ ID NO: 11520 - DNA, 20 bp, Artificial Sequence
  Description of Artificial Sequence: Synthetic oligonucleotide
  Target: DMPK; (+) strand; PAM type: NRG; PAM sequence: GGG
gagaggccggcgctcagggt

SEQ ID NO: 11521 - DNA, 20 bp, Artificial Sequence
  Description of Artificial Sequence: Synthetic oligonucleotide
  Target: DMPK; (+) strand; PAM type: NRG; PAM sequence: GAG
gaggccggcgctcagggtgg

SEQ ID NO: 11522 - DNA, 20 bp, Artificial Sequence
  Description of Artificial Sequence: Synthetic oligonucleotide
  Target: DMPK; (+) strand; PAM type: NRG; PAM sequence: AGG
aggccggcgctcagggtggg

SEQ ID NO: 11523 - DNA, 20 bp, Artificial Sequence
  Description of Artificial Sequence: Synthetic oligonucleotide
  Target: DMPK; (+) strand; PAM type: NRG; PAM sequence: GAG
gccggcgctcagggtgggag

SEQ ID NO: 11524 - DNA, 20 bp, Artificial Sequence
  Description of Artificial Sequence: Synthetic oligonucleotide
  Target: DMPK; (+) strand; PAM type: NRG; PAM sequence: AAG
ggcgctcagggtgggaggag

SEQ ID NO: 11525 - DNA, 20 bp, Artificial Sequence
  Description of Artificial Sequence: Synthetic oligonucleotide
  Target: DMPK; (+) strand; PAM type: NRG; PAM sequence: AGG
gcgctcagggtgggaggaga

SEQ ID NO: 11526 - DNA, 20 bp, Artificial Sequence
  Description of Artificial Sequence: Synthetic oligonucleotide
  Target: DMPK; (+) strand; PAM type: NRG; PAM sequence: GGG
cgctcagggtgggaggagaa

SEQ ID NO: 11527 - DNA, 20 bp, Artificial Sequence
  Description of Artificial Sequence: Synthetic oligonucleotide
  Target: DMPK; (+) strand; PAM type: NRG; PAM sequence: TGG
agggtgggaggagaagggtt

SEQ ID NO: 11528 - DNA, 20 bp, Artificial Sequence
  Description of Artificial Sequence: Synthetic oligonucleotide
  Target: DMPK; (+) strand; PAM type: NRG; PAM sequence: GGG
gggtgggaggagaagggttt

SEQ ID NO: 11529 - DNA, 20 bp, Artificial Sequence
  Description of Artificial Sequence: Synthetic oligonucleotide
  Target: DMPK; (+) strand; PAM type: NRG; PAM sequence: CAG
gaggagaagggtttgggtta

SEQ ID NO: 11530 - DNA, 20 bp, Artificial Sequence
  Description of Artificial Sequence: Synthetic oligonucleotide
  Target: DMPK; (+) strand; PAM type: NRG; PAM sequence: AGG
aggagaagggtttgggttac

SEQ ID NO: 11531 - DNA, 20 bp, Artificial Sequence
  Description of Artificial Sequence: Synthetic oligonucleotide
  Target: DMPK; (+) strand; PAM type: NRG; PAM sequence: GGG
ggagaagggtttgggttaca

SEQ ID NO: 11532 - DNA, 20 bp, Artificial Sequence
  Description of Artificial Sequence: Synthetic oligonucleotide
  Target: DMPK; (+) strand; PAM type: NRG; PAM sequence: CGG
ggtttgggttacagggaaac

SEQ ID NO: 11533 - DNA, 20 bp, Artificial Sequence
  Description of Artificial Sequence: Synthetic oligonucleotide
  Target: DMPK; (+) strand; PAM type: NRG; PAM sequence: GAG
tttgggttacagggaaaccg

SEQ ID NO: 11534 - DNA, 20 bp, Artificial Sequence
  Description of Artificial Sequence: Synthetic oligonucleotide
  Target: DMPK; (+) strand; PAM type: NRG; PAM sequence: TGG
ggttacagggaaaccggagc

SEQ ID NO: 11535 - DNA, 20 bp, Artificial Sequence
  Description of Artificial Sequence: Synthetic oligonucleotide
  Target: DMPK; (+) strand; PAM type: NRG; PAM sequence: GGG
gttacagggaaaccggagct

SEQ ID NO: 11536 - DNA, 20 bp, Artificial Sequence
  Description of Artificial Sequence: Synthetic oligonucleotide
  Target: DMPK; (+) strand; PAM type: NRG; PAM sequence: AAG
cagggaaaccggagctggga

SEQ ID NO: 11537 - DNA, 20 bp, Artificial Sequence
  Description of Artificial Sequence: Synthetic oligonucleotide
  Target: DMPK; (+) strand; PAM type: NRG; PAM sequence: AGG
agggaaaccggagctgggaa

SEQ ID NO: 11538 - DNA, 20 bp, Artificial Sequence
  Description of Artificial Sequence: Synthetic oligonucleotide
  Target: DMPK; (+) strand; PAM type: NRG; PAM sequence: AAG
aaggttcacgtttcacaaca

SEQ ID NO: 11539 - DNA, 20 bp, Artificial Sequence
  Description of Artificial Sequence: Synthetic oligonucleotide
  Target: DMPK; (+) strand; PAM type: NRG; PAM sequence: AGG
aggttcacgtttcacaacaa

SEQ ID NO: 11540 - DNA, 20 bp, Artificial Sequence
  Description of Artificial Sequence: Synthetic oligonucleotide
  Target: DMPK; (+) strand; PAM type: NRG; PAM sequence: CAG
ttcacgtttcacaacaaagg

SEQ ID NO: 11541 - DNA, 20 bp, Artificial Sequence
  Description of Artificial Sequence: Synthetic oligonucleotide
  Target: DMPK; (+) strand; PAM type: NRG; PAM sequence: AAG
acgtttcacaacaaaggcag

SEQ ID NO: 11542 - DNA, 20 bp, Artificial Sequence
  Description of Artificial Sequence: Synthetic oligonucleotide
  Target: DMPK; (+) strand; PAM type: NRG; PAM sequence: CGG
ttcacaacaaaggcagaaga

SEQ ID NO: 11543 - DNA, 20 bp, Artificial Sequence
  Description of Artificial Sequence: Synthetic oligonucleotide
  Target: DMPK; (+) strand; PAM type: NRG; PAM sequence: CGG
agaagacggaccacgccgtc

SEQ ID NO: 11544 - DNA, 20 bp, Artificial Sequence
  Description of Artificial Sequence: Synthetic oligonucleotide
  Target: DMPK; (+) strand; PAM type: NRG; PAM sequence: GGG
gaagacggaccacgccgtcc

SEQ ID NO: 11545 - DNA, 20 bp, Artificial Sequence
  Description of Artificial Sequence: Synthetic oligonucleotide
  Target: DMPK; (+) strand; PAM type: NRG; PAM sequence: CGG
cggaccacgccgtccgggcc

SEQ ID NO: 11546 - DNA, 20 bp, Artificial Sequence
  Description of Artificial Sequence: Synthetic oligonucleotide
  Target: DMPK; (+) strand; PAM type: NRG; PAM sequence: GAG
gaccacgccgtccgggcccg

SEQ ID NO: 11547 - DNA, 20 bp, Artificial Sequence
  Description of Artificial Sequence: Synthetic oligonucleotide
  Target: DMPK; (+) strand; PAM type: NRG; PAM sequence: AGG
accacgccgtccgggcccgg

SEQ ID NO: 11548 - DNA, 20 bp, Artificial Sequence
  Description of Artificial Sequence: Synthetic oligonucleotide
  Target: DMPK; (+) strand; PAM type: NRG; PAM sequence: GGG
ccacgccgtccgggcccgga

SEQ ID NO: 11549 - DNA, 20 bp, Artificial Sequence
  Description of Artificial Sequence: Synthetic oligonucleotide
  Target: DMPK; (+) strand; PAM type: NRG; PAM sequence: GAG
acgccgtccgggcccggagg

SEQ ID NO: 11550 - DNA, 20 bp, Artificial Sequence
  Description of Artificial Sequence: Synthetic oligonucleotide
  Target: DMPK; (+) strand; PAM type: NRG; PAM sequence: TGG
gtccgggcccggagggagtg

SEQ ID NO: 11551 - DNA, 20 bp, Artificial Sequence
  Description of Artificial Sequence: Synthetic oligonucleotide
  Target: DMPK; (+) strand; PAM type: NRG; PAM sequence: GGG
tccgggcccggagggagtgt

SEQ ID NO: 11552 - DNA, 20 bp, Artificial Sequence
  Description of Artificial Sequence: Synthetic oligonucleotide
  Target: DMPK; (+) strand; PAM type: NRG; PAM sequence: GGG
ccgggcccggagggagtgtg

SEQ ID NO: 11553 - DNA, 20 bp, Artificial Sequence
  Description of Artificial Sequence: Synthetic oligonucleotide
  Target: DMPK; (+) strand; PAM type: NRG; PAM sequence: GGG
cgggcccggagggagtgtgg

SEQ ID NO: 11554 - DNA, 20 bp, Artificial Sequence
  Description of Artificial Sequence: Synthetic oligonucleotide
  Target: DMPK; (+) strand; PAM type: NRG; PAM sequence: CGG
gcccggagggagtgtggggg

SEQ ID NO: 11555 - DNA, 20 bp, Artificial Sequence
  Description of Artificial Sequence: Synthetic oligonucleotide
  Target: DMPK; (+) strand; PAM type: NRG; PAM sequence: GGG
cccggagggagtgtgggggc

SEQ ID NO: 11556 - DNA, 20 bp, Artificial Sequence
  Description of Artificial Sequence: Synthetic oligonucleotide
  Target: DMPK; (+) strand; PAM type: NRG; PAM sequence: TGG
ggagggagtgtgggggcggg

SEQ ID NO: 11557 - DNA, 20 bp, Artificial Sequence
  Description of Artificial Sequence: Synthetic oligonucleotide
  Target: DMPK; (+) strand; PAM type: NRG; PAM sequence: GGG
gagggagtgtgggggcgggt

SEQ ID NO: 11558 - DNA, 20 bp, Artificial Sequence
  Description of Artificial Sequence: Synthetic oligonucleotide
  Target: DMPK; (+) strand; PAM type: NRG; PAM sequence: AAG
gagtgtgggggcgggtgggt

SEQ ID NO: 11559 - DNA, 20 bp, Artificial Sequence
  Description of Artificial Sequence: Synthetic oligonucleotide
  Target: DMPK; (+) strand; PAM type: NRG; PAM sequence: GAG
gtgtgggggcgggtgggtaa

SEQ ID NO: 11560 - DNA, 20 bp, Artificial Sequence
  Description of Artificial Sequence: Synthetic oligonucleotide
  Target: DMPK; (+) strand; PAM type: NRG; PAM sequence: CGG
gggcgggtgggtaagagtaa

SEQ ID NO: 11561 - DNA, 20 bp, Artificial Sequence
  Description of Artificial Sequence: Synthetic oligonucleotide
  Target: DMPK; (+) strand; PAM type: NRG; PAM sequence: CAG
gggtgggtaagagtaacggt

SEQ ID NO: 11562 - DNA, 20 bp, Artificial Sequence
  Description of Artificial Sequence: Synthetic oligonucleotide
  Target: DMPK; (+) strand; PAM type: NRG; PAM sequence: AAG
ggtaagagtaacggtcagtg

SEQ ID NO: 11563 - DNA, 20 bp, Artificial Sequence
  Description of Artificial Sequence: Synthetic oligonucleotide
  Target: DMPK; (+) strand; PAM type: NRG; PAM sequence: AAG
agagtaacggtcagtgaaga

SEQ ID NO: 11564 - DNA, 20 bp, Artificial Sequence
  Description of Artificial Sequence: Synthetic oligonucleotide
  Target: DMPK; (+) strand; PAM type: NRG; PAM sequence: AGG
gagtaacggtcagtgaagaa

SEQ ID NO: 11565 - DNA, 20 bp, Artificial Sequence
  Description of Artificial Sequence: Synthetic oligonucleotide
  Target: DMPK; (+) strand; PAM type: NRG; PAM sequence: GGG
agtaacggtcagtgaagaaa

SEQ ID NO: 11566 - DNA, 20 bp, Artificial Sequence
  Description of Artificial Sequence: Synthetic oligonucleotide
  Target: DMPK; (+) strand; PAM type: NRG; PAM sequence: GGG
gtaacggtcagtgaagaaag

SEQ ID NO: 11567 - DNA, 20 bp, Artificial Sequence
  Description of Artificial Sequence: Synthetic oligonucleotide
  Target: DMPK; (+) strand; PAM type: NRG; PAM sequence: GGG
taacggtcagtgaagaaagg

SEQ ID NO: 11568 - DNA, 20 bp, Artificial Sequence
  Description of Artificial Sequence: Synthetic oligonucleotide
  Target: DMPK; (+) strand; PAM type: NRG; PAM sequence: TGG
ggtcagtgaagaaagggggc

SEQ ID NO: 11569 - DNA, 20 bp, Artificial Sequence
  Description of Artificial Sequence: Synthetic oligonucleotide
  Target: DMPK; (+) strand; PAM type: NRG; PAM sequence: GGG
gtcagtgaagaaagggggct

SEQ ID NO: 11570 - DNA, 20 bp, Artificial Sequence
  Description of Artificial Sequence: Synthetic oligonucleotide
  Target: DMPK; (+) strand; PAM type: NRG; PAM sequence: GAG
cagtgaagaaagggggctgg

SEQ ID NO: 11571 - DNA, 20 bp, Artificial Sequence
  Description of Artificial Sequence: Synthetic oligonucleotide
  Target: DMPK; (+) strand; PAM type: NRG; PAM sequence: AGG
agtgaagaaagggggctggg

SEQ ID NO: 11572 - DNA, 20 bp, Artificial Sequence
  Description of Artificial Sequence: Synthetic oligonucleotide
  Target: DMPK; (+) strand; PAM type: NRG; PAM sequence: CAG
gaagaaagggggctgggagg

SEQ ID NO: 11573 - DNA, 20 bp, Artificial Sequence
  Description of Artificial Sequence: Synthetic oligonucleotide
  Target: DMPK; (+) strand; PAM type: NRG; PAM sequence: CGG
gctgggaggcagcccctacg

SEQ ID NO: 11574 - DNA, 20 bp, Artificial Sequence
  Description of Artificial Sequence: Synthetic oligonucleotide
  Target: DMPK; (+) strand; PAM type: NRG; PAM sequence: GAG
tgggaggcagcccctacgcg

SEQ ID NO: 11575 - DNA, 20 bp, Artificial Sequence
  Description of Artificial Sequence: Synthetic oligonucleotide
  Target: DMPK; (+) strand; PAM type: NRG; PAM sequence: TGG
gaggcagcccctacgcggag

SEQ ID NO: 11576 - DNA, 20 bp, Artificial Sequence
  Description of Artificial Sequence: Synthetic oligonucleotide
  Target: DMPK; (+) strand; PAM type: NRG; PAM sequence: GAG
ggcagcccctacgcggagtg

SEQ ID NO: 11577 - DNA, 20 bp, Artificial Sequence
  Description of Artificial Sequence: Synthetic oligonucleotide
  Target: DMPK; (+) strand; PAM type: NRG; PAM sequence: TGG
agcccctacgcggagtggag

SEQ ID NO: 11578 - DNA, 20 bp, Artificial Sequence
  Description of Artificial Sequence: Synthetic oligonucleotide
  Target: DMPK; (+) strand; PAM type: NRG; PAM sequence: CAG
tacgcggagtggagtggcca

SEQ ID NO: 11579 - DNA, 20 bp, Artificial Sequence
  Description of Artificial Sequence: Synthetic oligonucleotide
  Target: DMPK; (+) strand; PAM type: NRG; PAM sequence: AGG
acgcggagtggagtggccac

SEQ ID NO: 11580 - DNA, 20 bp, Artificial Sequence
  Description of Artificial Sequence: Synthetic oligonucleotide
  Target: DMPK; (+) strand; PAM type: NRG; PAM sequence: CAG
caggccctgtcctttttcct

SEQ ID NO: 11581 - DNA, 20 bp, Artificial Sequence
  Description of Artificial Sequence: Synthetic oligonucleotide
  Target: DMPK; (+) strand; PAM type: NRG; PAM sequence: TAG
tcctttttcctcagtccctc

SEQ ID NO: 11582 - DNA, 20 bp, Artificial Sequence
  Description of Artificial Sequence: Synthetic oligonucleotide
  Target: DMPK; (+) strand; PAM type: NRG; PAM sequence: CAG
agtccctctagtgccccccg

SEQ ID NO: 11583 - DNA, 20 bp, Artificial Sequence
  Description of Artificial Sequence: Synthetic oligonucleotide
  Target: DMPK; (+) strand; PAM type: NRG; PAM sequence: TGG
gtgtgattccccaacaccga

SEQ ID NO: 11584 - DNA, 20 bp, Artificial Sequence
  Description of Artificial Sequence: Synthetic oligonucleotide
  Target: DMPK; (+) strand; PAM type: NRG; PAM sequence: GGG
tgtgattccccaacaccgat

SEQ ID NO: 11585 - DNA, 20 bp, Artificial Sequence
  Description of Artificial Sequence: Synthetic oligonucleotide
  Target: DMPK; (+) strand; PAM type: NRG; PAM sequence: TGG
tccccaacaccgatgggatt

SEQ ID NO: 11586 - DNA, 20 bp, Artificial Sequence
  Description of Artificial Sequence: Synthetic oligonucleotide
  Target: DMPK; (+) strand; PAM type: NRG; PAM sequence: GGG
ccccaacaccgatgggattt

SEQ ID NO: 11587 - DNA, 20 bp, Artificial Sequence
  Description of Artificial Sequence: Synthetic oligonucleotide
  Target: DMPK; (+) strand; PAM type: NRG; PAM sequence: AAG
caacaccgatgggatttggg

SEQ ID NO: 11588 - DNA, 20 bp, Artificial Sequence
  Description of Artificial Sequence: Synthetic oligonucleotide
  Target: DMPK; (+) strand; PAM type: NRG; PAM sequence: AGG
aacaccgatgggatttggga

SEQ ID NO: 11589 - DNA, 20 bp, Artificial Sequence
  Description of Artificial Sequence: Synthetic oligonucleotide
  Target: DMPK; (+) strand; PAM type: NRG; PAM sequence: GAG
caccgatgggatttgggaag

SEQ ID NO: 11590 - DNA, 20 bp, Artificial Sequence
  Description of Artificial Sequence: Synthetic oligonucleotide
  Target: DMPK; (+) strand; PAM type: NRG; PAM sequence: CGG
atgggatttgggaaggagct

SEQ ID NO: 11591 - DNA, 20 bp, Artificial Sequence
  Description of Artificial Sequence: Synthetic oligonucleotide
  Target: DMPK; (+) strand; PAM type: NRG; PAM sequence: TGG
atttgggaaggagctcggaa

SEQ ID NO: 11592 - DNA, 20 bp, Artificial Sequence
  Description of Artificial Sequence: Synthetic oligonucleotide
  Target: DMPK; (+) strand; PAM type: NRG; PAM sequence: GAG
ttgggaaggagctcggaatg

SEQ ID NO: 11593 - DNA, 20 bp, Artificial Sequence
  Description of Artificial Sequence: Synthetic oligonucleotide
  Target: DMPK; (+) strand; PAM type: NRG; PAM sequence: TGG
ggagctcggaatggagccgc

SEQ ID NO: 11594 - DNA, 20 bp, Artificial Sequence
  Description of Artificial Sequence: Synthetic oligonucleotide
  Target: DMPK; (+) strand; PAM type: NRG; PAM sequence: AAG
gctcggaatggagccgctgg

SEQ ID NO: 11595 - DNA, 20 bp, Artificial Sequence
  Description of Artificial Sequence: Synthetic oligonucleotide
  Target: DMPK; (+) strand; PAM type: NRG; PAM sequence: GAG
tcggaatggagccgctggaa

SEQ ID NO: 11596 - DNA, 20 bp, Artificial Sequence
  Description of Artificial Sequence: Synthetic oligonucleotide
  Target: DMPK; (+) strand; PAM type: NRG; PAM sequence: AGG
cggaatggagccgctggaag

SEQ ID NO: 11597 - DNA, 20 bp, Artificial Sequence
  Description of Artificial Sequence: Synthetic oligonucleotide
  Target: DMPK; (+) strand; PAM type: NRG; PAM sequence: GAG
gaatggagccgctggaagag

SEQ ID NO: 11598 - DNA, 20 bp, Artificial Sequence
  Description of Artificial Sequence: Synthetic oligonucleotide
  Target: DMPK; (+) strand; PAM type: NRG; PAM sequence: CGG
gctggaagaggagacgcgtg

SEQ ID NO: 11599 - DNA, 20 bp, Artificial Sequence
  Description of Artificial Sequence: Synthetic oligonucleotide
  Target: DMPK; (+) strand; PAM type: NRG; PAM sequence: GGG
ctggaagaggagacgcgtgc

SEQ ID NO: 11600 - DNA, 20 bp, Artificial Sequence
  Description of Artificial Sequence: Synthetic oligonucleotide
  Target: DMPK; (+) strand; PAM type: NRG; PAM sequence: GGG
tggaagaggagacgcgtgcg

SEQ ID NO: 11601 - DNA, 20 bp, Artificial Sequence
  Description of Artificial Sequence: Synthetic oligonucleotide
  Target: DMPK; (+) strand; PAM type: NRG; PAM sequence: GAG
gaagaggagacgcgtgcggg

SEQ ID NO: 11602 - DNA, 20 bp, Artificial Sequence
  Description of Artificial Sequence: Synthetic oligonucleotide
  Target: DMPK; (+) strand; PAM type: NRG; PAM sequence: GAG
agaggagacgcgtgcgggga

SEQ ID NO: 11603 - DNA, 20 bp, Artificial Sequence
  Description of Artificial Sequence: Synthetic oligonucleotide
  Target: DMPK; (+) strand; PAM type: NRG; PAM sequence: AGG
gaggagacgcgtgcggggag

SEQ ID NO: 11604 - DNA, 20 bp, Artificial Sequence
  Description of Artificial Sequence: Synthetic oligonucleotide
  Target: DMPK; (+) strand; PAM type: NRG; PAM sequence: GGG
aggagacgcgtgcggggaga

SEQ ID NO: 11605 - DNA, 20 bp, Artificial Sequence
  Description of Artificial Sequence: Synthetic oligonucleotide
  Target: DMPK; (+) strand; PAM type: NRG; PAM sequence: CGG
acgcgtgcggggagagggcc

SEQ ID NO: 11606 - DNA, 20 bp, Artificial Sequence
  Description of Artificial Sequence: Synthetic oligonucleotide
  Target: DMPK; (+) strand; PAM type: NRG; PAM sequence: GGG
cgcgtgcggggagagggccc

SEQ ID NO: 11607 - DNA, 20 bp, Artificial Sequence
  Description of Artificial Sequence: Synthetic oligonucleotide
  Target: DMPK; (+) strand; PAM type: NRG; PAM sequence: CGG
gtgcggggagagggcccggg

SEQ ID NO: 11608 - DNA, 20 bp, Artificial Sequence
  Description of Artificial Sequence: Synthetic oligonucleotide
  Target: DMPK; (+) strand; PAM type: NRG; PAM sequence: GGG
tgcggggagagggcccgggc

SEQ ID NO: 11609 - DNA, 20 bp, Artificial Sequence
  Description of Artificial Sequence: Synthetic oligonucleotide
  Target: DMPK; (+) strand; PAM type: NRG; PAM sequence: TAG
gtgcctgtcccgtccacact

SEQ ID NO: 11610 - DNA, 20 bp, Artificial Sequence
  Description of Artificial Sequence: Synthetic oligonucleotide
  Target: DMPK; (+) strand; PAM type: NRG; PAM sequence: CGG
cacttagtccccgcgccccg

SEQ ID NO: 11611 - DNA, 20 bp, Artificial Sequence
  Description of Artificial Sequence: Synthetic oligonucleotide
  Target: DMPK; (+) strand; PAM type: NRG; PAM sequence: GGG
acttagtccccgcgccccgc

SEQ ID NO: 11612 - DNA, 20 bp, Artificial Sequence
  Description of Artificial Sequence: Synthetic oligonucleotide
  Target: DMPK; (+) strand; PAM type: NRG; PAM sequence: GAG
cccgcgccccgcgggcgcct

SEQ ID NO: 11613 - DNA, 20 bp, Artificial Sequence
  Description of Artificial Sequence: Synthetic oligonucleotide
  Target: DMPK; (+) strand; PAM type: NRG; PAM sequence: GAG
ccgcgggcgcctgagattgt

SEQ ID NO: 11614 - DNA, 20 bp, Artificial Sequence
  Description of Artificial Sequence: Synthetic oligonucleotide
  Target: DMPK; (+) strand; PAM type: NRG; PAM sequence: TGG
gggcgcctgagattgtgagc

SEQ ID NO: 11615 - DNA, 20 bp, Artificial Sequence
  Description of Artificial Sequence: Synthetic oligonucleotide
  Target: DMPK; (+) strand; PAM type: NRG; PAM sequence: CGG
ctgagattgtgagctggtcc

SEQ ID NO: 11616 - DNA, 20 bp, Artificial Sequence
  Description of Artificial Sequence: Synthetic oligonucleotide
  Target: DMPK; (+) strand; PAM type: NRG; PAM sequence: GGG
tgagattgtgagctggtccc

SEQ ID NO: 11617 - DNA, 20 bp, Artificial Sequence
  Description of Artificial Sequence: Synthetic oligonucleotide
  Target: DMPK; (+) strand; PAM type: NRG; PAM sequence: GAG
agattgtgagctggtcccgg

SEQ ID NO: 11618 - DNA, 20 bp, Artificial Sequence
  Description of Artificial Sequence: Synthetic oligonucleotide
  Target: DMPK; (+) strand; PAM type: NRG; PAM sequence: GAG
gctggtcccgggagatgtcc

SEQ ID NO: 11619 - DNA, 20 bp, Artificial Sequence
  Description of Artificial Sequence: Synthetic oligonucleotide
  Target: DMPK; (+) strand; PAM type: NRG; PAM sequence: AGG
ctggtcccgggagatgtccg

SEQ ID NO: 11620 - DNA, 20 bp, Artificial Sequence
  Description of Artificial Sequence: Synthetic oligonucleotide
  Target: DMPK; (+) strand; PAM type: NRG; PAM sequence: CGG
cgggagatgtccgaggacct

SEQ ID NO: 11621 - DNA, 20 bp, Artificial Sequence
  Description of Artificial Sequence: Synthetic oligonucleotide
  Target: DMPK; (+) strand; PAM type: NRG; PAM sequence: CGG
gtccgaggacctcggcgcgc

SEQ ID NO: 11622 - DNA, 20 bp, Artificial Sequence
  Description of Artificial Sequence: Synthetic oligonucleotide
  Target: DMPK; (+) strand; PAM type: NRG; PAM sequence: CAG
ggacctcggcgcgccggccc

SEQ ID NO: 11623 - DNA, 20 bp, Artificial Sequence
  Description of Artificial Sequence: Synthetic oligonucleotide
  Target: DMPK; (+) strand; PAM type: NRG; PAM sequence: CAG
cctcggcgcgccggccccag

SEQ ID NO: 11624 - DNA, 20 bp, Artificial Sequence
  Description of Artificial Sequence: Synthetic oligonucleotide
  Target: DMPK; (+) strand; PAM type: NRG; PAM sequence: TGG
cggcgcgccggccccagcag

SEQ ID NO: 11625 - DNA, 20 bp, Artificial Sequence
  Description of Artificial Sequence: Synthetic oligonucleotide
  Target: DMPK; (+) strand; PAM type: NRG; PAM sequence: GGG
ggcgcgccggccccagcagt

SEQ ID NO: 11626 - DNA, 20 bp, Artificial Sequence
  Description of Artificial Sequence: Synthetic oligonucleotide
  Target: DMPK; (+) strand; PAM type: NRG; PAM sequence: CGG
gccggccccagcagtgggca

SEQ ID NO: 11627 - DNA, 20 bp, Artificial Sequence
  Description of Artificial Sequence: Synthetic oligonucleotide
  Target: DMPK; (+) strand; PAM type: NRG; PAM sequence: GGG
ccggccccagcagtgggcac

SEQ ID NO: 11628 - DNA, 20 bp, Artificial Sequence
  Description of Artificial Sequence: Synthetic oligonucleotide
  Target: DMPK; (+) strand; PAM type: NRG; PAM sequence: GGG
cggccccagcagtgggcacg

SEQ ID NO: 11629 - DNA, 20 bp, Artificial Sequence
  Description of Artificial Sequence: Synthetic oligonucleotide
  Target: DMPK; (+) strand; PAM type: NRG; PAM sequence: GGG
ggccccagcagtgggcacgg

SEQ ID NO: 11630 - DNA, 20 bp, Artificial Sequence
  Description of Artificial Sequence: Synthetic oligonucleotide
  Target: DMPK; (+) strand; PAM type: NRG; PAM sequence: AAG
cccagcagtgggcacggggg

SEQ ID NO: 11631 - DNA, 20 bp, Artificial Sequence
  Description of Artificial Sequence: Synthetic oligonucleotide
  Target: DMPK; (+) strand; PAM type: NRG; PAM sequence: GAG
cagcagtgggcacgggggaa

SEQ ID NO: 11632 - DNA, 20 bp, Artificial Sequence
  Description of Artificial Sequence: Synthetic oligonucleotide
  Target: DMPK; (+) strand; PAM type: NRG; PAM sequence: AGG
agcagtgggcacgggggaag

SEQ ID NO: 11633 - DNA, 20 bp, Artificial Sequence
  Description of Artificial Sequence: Synthetic oligonucleotide
  Target: DMPK; (+) strand; PAM type: NRG; PAM sequence: GGG
gcagtgggcacgggggaaga

SEQ ID NO: 11634 - DNA, 20 bp, Artificial Sequence
  Description of Artificial Sequence: Synthetic oligonucleotide
  Target: DMPK; (+) strand; PAM type: NRG; PAM sequence: TGG
tgggcacgggggaagagggc

SEQ ID NO: 11635 - DNA, 20 bp, Artificial Sequence
  Description of Artificial Sequence: Synthetic oligonucleotide
  Target: DMPK; (+) strand; PAM type: NRG; PAM sequence: TGG
gcacgggggaagagggctgg

SEQ ID NO: 11636 - DNA, 20 bp, Artificial Sequence
  Description of Artificial Sequence: Synthetic oligonucleotide
  Target: DMPK; (+) strand; PAM type: NRG; PAM sequence: CGG
gggggaagagggctggtgga

SEQ ID NO: 11637 - DNA, 20 bp, Artificial Sequence
  Description of Artificial Sequence: Synthetic oligonucleotide
  Target: DMPK; (+) strand; PAM type: NRG; PAM sequence: GGG
ggggaagagggctggtggac

SEQ ID NO: 11638 - DNA, 20 bp, Artificial Sequence
  Description of Artificial Sequence: Synthetic oligonucleotide
  Target: DMPK; (+) strand; PAM type: NRG; PAM sequence: CGG
gctggtggacgggatgtccc

SEQ ID NO: 11639 - DNA, 20 bp, Artificial Sequence
  Description of Artificial Sequence: Synthetic oligonucleotide
  Target: DMPK; (+) strand; PAM type: NRG; PAM sequence: GGG
ctggtggacgggatgtcccc

SEQ ID NO: 11640 - DNA, 20 bp, Artificial Sequence
  Description of Artificial Sequence: Synthetic oligonucleotide
  Target: DMPK; (+) strand; PAM type: NRG; PAM sequence: GAG
ggtggacgggatgtccccgg

SEQ ID NO: 11641 - DNA, 20 bp, Artificial Sequence
  Description of Artificial Sequence: Synthetic oligonucleotide
  Target: DMPK; (+) strand; PAM type: NRG; PAM sequence: GAG
tggacgggatgtccccggga

SEQ ID NO: 11642 - DNA, 20 bp, Artificial Sequence
  Description of Artificial Sequence: Synthetic oligonucleotide
  Target: DMPK; (+) strand; PAM type: NRG; PAM sequence: TGG
cgggatgtccccgggagagc

SEQ ID NO: 11643 - DNA, 20 bp, Artificial Sequence
  Description of Artificial Sequence: Synthetic oligonucleotide
  Target: DMPK; (+) strand; PAM type: NRG; PAM sequence: GAG
gagctggacttgcgccgccc

SEQ ID NO: 11644 - DNA, 20 bp, Artificial Sequence
  Description of Artificial Sequence: Synthetic oligonucleotide
  Target: DMPK; (+) strand; PAM type: NRG; PAM sequence: AGG
agctggacttgcgccgcccg

SEQ ID NO: 11645 - DNA, 20 bp, Artificial Sequence
  Description of Artificial Sequence: Synthetic oligonucleotide
  Target: DMPK; (+) strand; PAM type: NRG; PAM sequence: CAG
ccgaggcccctcacctcttg

SEQ ID NO: 11646 - DNA, 20 bp, Artificial Sequence
  Description of Artificial Sequence: Synthetic oligonucleotide
  Target: DMPK; (+) strand; PAM type: NRG; PAM sequence: AGG
cgaggcccctcacctcttgc

SEQ ID NO: 11647 - DNA, 20 bp, Artificial Sequence
  Description of Artificial Sequence: Synthetic oligonucleotide
  Target: DMPK; (+) strand; PAM type: NRG; PAM sequence: GGG
gaggcccctcacctcttgca

SEQ ID NO: 11648 - DNA, 20 bp, Artificial Sequence
  Description of Artificial Sequence: Synthetic oligonucleotide
  Target: DMPK; (+) strand; PAM type: NRG; PAM sequence: CGG
cttgcagggcgcgccgcctc

SEQ ID NO: 11649 - DNA, 20 bp, Artificial Sequence
  Description of Artificial Sequence: Synthetic oligonucleotide
  Target: DMPK; (+) strand; PAM type: NRG; PAM sequence: CGG
gggcgcgccgcctccggccc

SEQ ID NO: 11650 - DNA, 20 bp, Artificial Sequence
  Description of Artificial Sequence: Synthetic oligonucleotide
  Target: DMPK; (+) strand; PAM type: NRG; PAM sequence: CGG
cgccgcctccggccccggtc

SEQ ID NO: 11651 - DNA, 20 bp, Artificial Sequence
  Description of Artificial Sequence: Synthetic oligonucleotide
  Target: DMPK; (+) strand; PAM type: NRG; PAM sequence: CGG
cggtccggtcgcgctgtcgc

SEQ ID NO: 11652 - DNA, 20 bp, Artificial Sequence
  Description of Artificial Sequence: Synthetic oligonucleotide
  Target: DMPK; (+) strand; PAM type: NRG; PAM sequence: CAG
gctgtcgccggttcttgaac

SEQ ID NO: 11653 - DNA, 20 bp, Artificial Sequence
  Description of Artificial Sequence: Synthetic oligonucleotide
  Target: DMPK; (+) strand; PAM type: NRG; PAM sequence: GAG
aaccagttgctgacctgcgt

SEQ ID NO: 11654 - DNA, 20 bp, Artificial Sequence
  Description of Artificial Sequence: Synthetic oligonucleotide
  Target: DMPK; (+) strand; PAM type: NRG; PAM sequence: CAG
ttgctgacctgcgtgagcga

SEQ ID NO: 11655 - DNA, 20 bp, Artificial Sequence
  Description of Artificial Sequence: Synthetic oligonucleotide
  Target: DMPK; (+) strand; PAM type: NRG; PAM sequence: AGG
tgctgacctgcgtgagcgac

SEQ ID NO: 11656 - DNA, 20 bp, Artificial Sequence
  Description of Artificial Sequence: Synthetic oligonucleotide
  Target: DMPK; (+) strand; PAM type: NRG; PAM sequence: CGG
gacctgcgtgagcgacaggc

SEQ ID NO: 11657 - DNA, 20 bp, Artificial Sequence
  Description of Artificial Sequence: Synthetic oligonucleotide
  Target: DMPK; (+) strand; PAM type: NRG; PAM sequence: GAG
tgcgtgagcgacaggccggt

SEQ ID NO: 11658 - DNA, 20 bp, Artificial Sequence
  Description of Artificial Sequence: Synthetic oligonucleotide
  Target: DMPK; (+) strand; PAM type: NRG; PAM sequence: TGG
gagcgacaggccggtgagtg

SEQ ID NO: 11659 - DNA, 20 bp, Artificial Sequence
  Description of Artificial Sequence: Synthetic oligonucleotide
  Target: DMPK; (+) strand; PAM type: NRG; PAM sequence: CAG
gacaggccggtgagtgtggc

SEQ ID NO: 11660 - DNA, 20 bp, Artificial Sequence
  Description of Artificial Sequence: Synthetic oligonucleotide
  Target: DMPK; (+) strand; PAM type: NRG; PAM sequence: AGG
acaggccggtgagtgtggcc

SEQ ID NO: 11661 - DNA, 20 bp, Artificial Sequence
  Description of Artificial Sequence: Synthetic oligonucleotide
  Target: DMPK; (+) strand; PAM type: NRG; PAM sequence: CGG
ggccggtgagtgtggccagg

SEQ ID NO: 11662 - DNA, 20 bp, Artificial Sequence
  Description of Artificial Sequence: Synthetic oligonucleotide
  Target: DMPK; (+) strand; PAM type: NRG; PAM sequence: CGG
gccaggcggcgcttctcgtc

SEQ ID NO: 11663 - DNA, 20 bp, Artificial Sequence
  Description of Artificial Sequence: Synthetic oligonucleotide
  Target: DMPK; (+) strand; PAM type: NRG; PAM sequence: TGG
gcggcgcttctcgtccggcg

SEQ ID NO: 11664 - DNA, 20 bp, Artificial Sequence
  Description of Artificial Sequence: Synthetic oligonucleotide
  Target: DMPK; (+) strand; PAM type: NRG; PAM sequence: GGG
cggcgcttctcgtccggcgt

SEQ ID NO: 11665 - DNA, 20 bp, Artificial Sequence
  Description of Artificial Sequence: Synthetic oligonucleotide
  Target: DMPK; (+) strand; PAM type: NRG; PAM sequence: GGG
ggcgcttctcgtccggcgtg

SEQ ID NO: 11666 - DNA, 20 bp, Artificial Sequence
  Description of Artificial Sequence: Synthetic oligonucleotide
  Target: DMPK; (+) strand; PAM type: NRG; PAM sequence: TAG
gcttctcgtccggcgtgggg

SEQ ID NO: 11667 - DNA, 20 bp, Artificial Sequence
  Description of Artificial Sequence: Synthetic oligonucleotide
  Target: DMPK; (+) strand; PAM type: NRG; PAM sequence: CGG
tctcgtccggcgtggggtag

SEQ ID NO: 11668 - DNA, 20 bp, Artificial Sequence
  Description of Artificial Sequence: Synthetic oligonucleotide
  Target: DMPK; (+) strand; PAM type: NRG; PAM sequence: CGG
gcgtggggtagcggttgccg

SEQ ID NO: 11669 - DNA, 20 bp, Artificial Sequence
  Description of Artificial Sequence: Synthetic oligonucleotide
  Target: DMPK; (+) strand; PAM type: NRG; PAM sequence: TAG
tggggtagcggttgccgcgg

SEQ ID NO: 11670 - DNA, 20 bp, Artificial Sequence
  Description of Artificial Sequence: Synthetic oligonucleotide
  Target: DMPK; (+) strand; PAM type: NRG; PAM sequence: CAG
ggtagcggttgccgcggtag

SEQ ID NO: 11671 - DNA, 20 bp, Artificial Sequence
  Description of Artificial Sequence: Synthetic oligonucleotide
  Target: DMPK; (+) strand; PAM type: NRG; PAM sequence: AGG
gtagcggttgccgcggtagc

SEQ ID NO: 11672 - DNA, 20 bp, Artificial Sequence
  Description of Artificial Sequence: Synthetic oligonucleotide
  Target: DMPK; (+) strand; PAM type: NRG; PAM sequence: GAG
ttgccgcggtagcaggcctt

SEQ ID NO: 11673 - DNA, 20 bp, Artificial Sequence
  Description of Artificial Sequence: Synthetic oligonucleotide
  Target: DMPK; (+) strand; PAM type: NRG; PAM sequence: CGG
agcaggccttgagcgctgcg

SEQ ID NO: 11674 - DNA, 20 bp, Artificial Sequence
  Description of Artificial Sequence: Synthetic oligonucleotide
  Target: DMPK; (+) strand; PAM type: NRG; PAM sequence: GGG
gcaggccttgagcgctgcgc

SEQ ID NO: 11675 - DNA, 20 bp, Artificial Sequence
  Description of Artificial Sequence: Synthetic oligonucleotide
  Target: DMPK; (+) strand; PAM type: NRG; PAM sequence: GAG
aggccttgagcgctgcgcgg

SEQ ID NO: 11676 - DNA, 20 bp, Artificial Sequence
  Description of Artificial Sequence: Synthetic oligonucleotide
  Target: DMPK; (+) strand; PAM type: NRG; PAM sequence: AAG
ctgcgcgggagcgctccttg

SEQ ID NO: 11677 - DNA, 20 bp, Artificial Sequence
  Description of Artificial Sequence: Synthetic oligonucleotide
  Target: DMPK; (+) strand; PAM type: NRG; PAM sequence: CAG
cgcgggagcgctccttgaag

SEQ ID NO: 11678 - DNA, 20 bp, Artificial Sequence
  Description of Artificial Sequence: Synthetic oligonucleotide
  Target: DMPK; (+) strand; PAM type: NRG; PAM sequence: TAG
gggagcgctccttgaagcag

SEQ ID NO: 11679 - DNA, 20 bp, Artificial Sequence
  Description of Artificial Sequence: Synthetic oligonucleotide
  Target: DMPK; (+) strand; PAM type: NRG; PAM sequence: CAG
agactgtctcctcgccgtcc

SEQ ID NO: 11680 - DNA, 20 bp, Artificial Sequence
  Description of Artificial Sequence: Synthetic oligonucleotide
  Target: DMPK; (+) strand; PAM type: NRG; PAM sequence: TGG
tgtctcctcgccgtcccaga

SEQ ID NO: 11681 - DNA, 20 bp, Artificial Sequence
  Description of Artificial Sequence: Synthetic oligonucleotide
  Target: DMPK; (+) strand; PAM type: NRG; PAM sequence: TGG
ctcgccgtcccagatggtct

SEQ ID NO: 11682 - DNA, 20 bp, Artificial Sequence
  Description of Artificial Sequence: Synthetic oligonucleotide
  Target: DMPK; (+) strand; PAM type: NRG; PAM sequence: GGG
tcgccgtcccagatggtctt

SEQ ID NO: 11683 - DNA, 20 bp, Artificial Sequence
  Description of Artificial Sequence: Synthetic oligonucleotide
  Target: DMPK; (+) strand; PAM type: NRG; PAM sequence: CAG
ccgtcccagatggtcttggg

SEQ ID NO: 11684 - DNA, 20 bp, Artificial Sequence
  Description of Artificial Sequence: Synthetic oligonucleotide
  Target: DMPK; (+) strand; PAM type: NRG; PAM sequence: CGG
tcccagatggtcttgggcag

SEQ ID NO: 11685 - DNA, 20 bp, Artificial Sequence
  Description of Artificial Sequence: Synthetic oligonucleotide
  Target: DMPK; (+) strand; PAM type: NRG; PAM sequence: GGG
cccagatggtcttgggcagc

SEQ ID NO: 11686 - DNA, 20 bp, Artificial Sequence
  Description of Artificial Sequence: Synthetic oligonucleotide
  Target: DMPK; (+) strand; PAM type: NRG; PAM sequence: CAG
ggcagcgggaacttcttgcg

SEQ ID NO: 11687 - DNA, 20 bp, Artificial Sequence
  Description of Artificial Sequence: Synthetic oligonucleotide
  Target: DMPK; (+) strand; PAM type: NRG; PAM sequence: AAG
cgatacttgtccactgcgcc

SEQ ID NO: 11688 - DNA, 20 bp, Artificial Sequence
  Description of Artificial Sequence: Synthetic oligonucleotide
  Target: DMPK; (+) strand; PAM type: NRG; PAM sequence: CGG
tgtccactgcgccaagcgcg

SEQ ID NO: 11689 - DNA, 20 bp, Artificial Sequence
  Description of Artificial Sequence: Synthetic oligonucleotide
  Target: DMPK; (+) strand; PAM type: NRG; PAM sequence: CGG
ctgcgccaagcgcgcggccg

SEQ ID NO: 11690 - DNA, 20 bp, Artificial Sequence
  Description of Artificial Sequence: Synthetic oligonucleotide
  Target: DMPK; (+) strand; PAM type: NRG; PAM sequence: GGG
tgcgccaagcgcgcggccgc

SEQ ID NO: 11691 - DNA, 20 bp, Artificial Sequence
  Description of Artificial Sequence: Synthetic oligonucleotide
  Target: DMPK; (+) strand; PAM type: NRG; PAM sequence: CGG
cgcgcggccgcgggcccgct

SEQ ID NO: 11692 - DNA, 20 bp, Artificial Sequence
  Description of Artificial Sequence: Synthetic oligonucleotide
  Target: DMPK; (+) strand; PAM type: NRG; PAM sequence: TGG
cgcgggcccgctcggcctca

SEQ ID NO: 11693 - DNA, 20 bp, Artificial Sequence
  Description of Artificial Sequence: Synthetic oligonucleotide
  Target: DMPK; (+) strand; PAM type: NRG; PAM sequence: TAG
gggcccgctcggcctcatgg

SEQ ID NO: 11694 - DNA, 20 bp, Artificial Sequence
  Description of Artificial Sequence: Synthetic oligonucleotide
  Target: DMPK; (+) strand; PAM type: NRG; PAM sequence: CAG
gcctcatggtagcgcgcgcg

SEQ ID NO: 11695 - DNA, 20 bp, Artificial Sequence
  Description of Artificial Sequence: Synthetic oligonucleotide
  Target: DMPK; (+) strand; PAM type: NRG; PAM sequence: AGG
cctcatggtagcgcgcgcgc

SEQ ID NO: 11696 - DNA, 20 bp, Artificial Sequence
  Description of Artificial Sequence: Synthetic oligonucleotide
  Target: DMPK; (+) strand; PAM type: NRG; PAM sequence: TAG
catggtagcgcgcgcgcagg

SEQ ID NO: 11697 - DNA, 20 bp, Artificial Sequence
  Description of Artificial Sequence: Synthetic oligonucleotide
  Target: DMPK; (+) strand; PAM type: NRG; PAM sequence: GAG
tggtagcgcgcgcgcaggta

SEQ ID NO: 11698 - DNA, 20 bp, Artificial Sequence
  Description of Artificial Sequence: Synthetic oligonucleotide
  Target: DMPK; (+) strand; PAM type: NRG; PAM sequence: AGG
ggtagcgcgcgcgcaggtag

SEQ ID NO: 11699 - DNA, 20 bp, Artificial Sequence
  Description of Artificial Sequence: Synthetic oligonucleotide
  Target: DMPK; (+) strand; PAM type: NRG; PAM sequence: CAG
gcgcgcaggtagaggtcctg

SEQ ID NO: 11700 - DNA, 20 bp, Artificial Sequence
  Description of Artificial Sequence: Synthetic oligonucleotide
  Target: DMPK; (+) strand; PAM type: NRG; PAM sequence: AGG
cgcgcaggtagaggtcctgc

SEQ ID NO: 11701 - DNA, 20 bp, Artificial Sequence
  Description of Artificial Sequence: Synthetic oligonucleotide
  Target: DMPK; (+) strand; PAM type: NRG; PAM sequence: AAG
gcaggtagaggtcctgcagg

SEQ ID NO: 11702 - DNA, 20 bp, Artificial Sequence
  Description of Artificial Sequence: Synthetic oligonucleotide
  Target: DMPK; (+) strand; PAM type: NRG; PAM sequence: AGG
caggtagaggtcctgcagga

SEQ ID NO: 11703 - DNA, 20 bp, Artificial Sequence
  Description of Artificial Sequence: Synthetic oligonucleotide
  Target: DMPK; (+) strand; PAM type: NRG; PAM sequence: TGG
agaggtcctgcaggaaggcg

SEQ ID NO: 11704 - DNA, 20 bp, Artificial Sequence
  Description of Artificial Sequence: Synthetic oligonucleotide
  Target: DMPK; (+) strand; PAM type: NRG; PAM sequence: TGG
ggtcctgcaggaaggcgtgg

SEQ ID NO: 11705 - DNA, 20 bp, Artificial Sequence
  Description of Artificial Sequence: Synthetic oligonucleotide
  Target: DMPK; (+) strand; PAM type: NRG; PAM sequence: GGG
gtcctgcaggaaggcgtggt

SEQ ID NO: 11706 - DNA, 20 bp, Artificial Sequence
  Description of Artificial Sequence: Synthetic oligonucleotide
  Target: DMPK; (+) strand; PAM type: NRG; PAM sequence: CGG
ctgcaggaaggcgtggtggg

SEQ ID NO: 11707 - DNA, 20 bp, Artificial Sequence
  Description of Artificial Sequence: Synthetic oligonucleotide
  Target: DMPK; (+) strand; PAM type: NRG; PAM sequence: CGG
caggaaggcgtggtgggcgg

SEQ ID NO: 11708 - DNA, 20 bp, Artificial Sequence
  Description of Artificial Sequence: Synthetic oligonucleotide
  Target: DMPK; (+) strand; PAM type: NRG; PAM sequence: GGG
aggaaggcgtggtgggcggc

SEQ ID NO: 11709 - DNA, 20 bp, Artificial Sequence
  Description of Artificial Sequence: Synthetic oligonucleotide
  Target: DMPK; (+) strand; PAM type: NRG; PAM sequence: GGG
ggaaggcgtggtgggcggcg

SEQ ID NO: 11710 - DNA, 20 bp, Artificial Sequence
  Description of Artificial Sequence: Synthetic oligonucleotide
  Target: DMPK; (+) strand; PAM type: NRG; PAM sequence: AAG
aggcgtggtgggcggcgggg

SEQ ID NO: 11711 - DNA, 20 bp, Artificial Sequence
  Description of Artificial Sequence: Synthetic oligonucleotide
  Target: DMPK; (+) strand; PAM type: NRG; PAM sequence: AGG
ggcgtggtgggcggcgggga

SEQ ID NO: 11712 - DNA, 20 bp, Artificial Sequence
  Description of Artificial Sequence: Synthetic oligonucleotide
  Target: DMPK; (+) strand; PAM type: NRG; PAM sequence: GGG
gcgtggtgggcggcggggaa

SEQ ID NO: 11713 - DNA, 20 bp, Artificial Sequence
  Description of Artificial Sequence: Synthetic oligonucleotide
  Target: DMPK; (+) strand; PAM type: NRG; PAM sequence: GGG
cgtggtgggcggcggggaag

SEQ ID NO: 11714 - DNA, 20 bp, Artificial Sequence
  Description of Artificial Sequence: Synthetic oligonucleotide
  Target: DMPK; (+) strand; PAM type: NRG; PAM sequence: CGG
ggtgggcggcggggaagggg

SEQ ID NO: 11715 - DNA, 20 bp, Artificial Sequence
  Description of Artificial Sequence: Synthetic oligonucleotide
  Target: DMPK; (+) strand; PAM type: NRG; PAM sequence: GAG
gcggggaaggggcggctctc

SEQ ID NO: 11716 - DNA, 20 bp, Artificial Sequence
  Description of Artificial Sequence: Synthetic oligonucleotide
  Target: DMPK; (+) strand; PAM type: NRG; PAM sequence: TAG
gggaaggggcggctctcgag

SEQ ID NO: 11717 - DNA, 20 bp, Artificial Sequence
  Description of Artificial Sequence: Synthetic oligonucleotide
  Target: DMPK; (+) strand; PAM type: NRG; PAM sequence: CGG
aggggcggctctcgagtagc

SEQ ID NO: 11718 - DNA, 20 bp, Artificial Sequence
  Description of Artificial Sequence: Synthetic oligonucleotide
  Target: DMPK; (+) strand; PAM type: NRG; PAM sequence: TAG
ggcggctctcgagtagccgg

SEQ ID NO: 11719 - DNA, 20 bp, Artificial Sequence
  Description of Artificial Sequence: Synthetic oligonucleotide
  Target: DMPK; (+) strand; PAM type: NRG; PAM sequence: GAG
cggctctcgagtagccggta

SEQ ID NO: 11720 - DNA, 20 bp, Artificial Sequence
  Description of Artificial Sequence: Synthetic oligonucleotide
  Target: DMPK; (+) strand; PAM type: NRG; PAM sequence: CGG
ctcgagtagccggtagagct

SEQ ID NO: 11721 - DNA, 20 bp, Artificial Sequence
  Description of Artificial Sequence: Synthetic oligonucleotide
  Target: DMPK; (+) strand; PAM type: NRG; PAM sequence: TGG
gctcggcgtactcgccccgc

SEQ ID NO: 11722 - DNA, 20 bp, Artificial Sequence
  Description of Artificial Sequence: Synthetic oligonucleotide
  Target: DMPK; (+) strand; PAM type: NRG; PAM sequence: AAG
cggcgtactcgccccgctgg

SEQ ID NO: 11723 - DNA, 20 bp, Artificial Sequence
  Description of Artificial Sequence: Synthetic oligonucleotide
  Target: DMPK; (+) strand; PAM type: NRG; PAM sequence: AGG
ggcgtactcgccccgctgga

SEQ ID NO: 11724 - DNA, 20 bp, Artificial Sequence
  Description of Artificial Sequence: Synthetic oligonucleotide
  Target: DMPK; (+) strand; PAM type: NRG; PAM sequence: CAG
tcgccccgctggaaggccac

SEQ ID NO: 11725 - DNA, 20 bp, Artificial Sequence
  Description of Artificial Sequence: Synthetic oligonucleotide
  Target: DMPK; (+) strand; PAM type: NRG; PAM sequence: AGG
cgccccgctggaaggccacc

SEQ ID NO: 11726 - DNA, 20 bp, Artificial Sequence
  Description of Artificial Sequence: Synthetic oligonucleotide
  Target: DMPK; (+) strand; PAM type: NRG; PAM sequence: GGG
gccccgctggaaggccacca

SEQ ID NO: 11727 - DNA, 20 bp, Artificial Sequence
  Description of Artificial Sequence: Synthetic oligonucleotide
  Target: DMPK; (+) strand; PAM type: NRG; PAM sequence: CGG
agggcccgcgcgcgcaacac

SEQ ID NO: 11728 - DNA, 20 bp, Artificial Sequence
  Description of Artificial Sequence: Synthetic oligonucleotide
  Target: DMPK; (+) strand; PAM type: NRG; PAM sequence: GGG
gggcccgcgcgcgcaacacc

SEQ ID NO: 11729 - DNA, 20 bp, Artificial Sequence
  Description of Artificial Sequence: Synthetic oligonucleotide
  Target: DMPK; (+) strand; PAM type: NRG; PAM sequence: TAG
aacaccgggtcgctgccacg

SEQ ID NO: 11730 - DNA, 20 bp, Artificial Sequence
  Description of Artificial Sequence: Synthetic oligonucleotide
  Target: DMPK; (+) strand; PAM type: NRG; PAM sequence: AGG
acaccgggtcgctgccacgt

SEQ ID NO: 11731 - DNA, 20 bp, Artificial Sequence
  Description of Artificial Sequence: Synthetic oligonucleotide
  Target: DMPK; (+) strand; PAM type: NRG; PAM sequence: CGG
gtcgctgccacgtaggcgct

SEQ ID NO: 11732 - DNA, 20 bp, Artificial Sequence
  Description of Artificial Sequence: Synthetic oligonucleotide
  Target: DMPK; (+) strand; PAM type: NRG; PAM sequence: CGG
ctgccacgtaggcgctcggc

SEQ ID NO: 11733 - DNA, 20 bp, Artificial Sequence
  Description of Artificial Sequence: Synthetic oligonucleotide
  Target: DMPK; (+) strand; PAM type: NRG; PAM sequence: GGG
tgccacgtaggcgctcggcc

SEQ ID NO: 11734 - DNA, 20 bp, Artificial Sequence
  Description of Artificial Sequence: Synthetic oligonucleotide
  Target: DMPK; (+) strand; PAM type: NRG; PAM sequence: GGG
gccacgtaggcgctcggccg

SEQ ID NO: 11735 - DNA, 20 bp, Artificial Sequence
  Description of Artificial Sequence: Synthetic oligonucleotide
  Target: DMPK; (+) strand; PAM type: NRG; PAM sequence: GGG
ccacgtaggcgctcggccgg

SEQ ID NO: 11736 - DNA, 20 bp, Artificial Sequence
  Description of Artificial Sequence: Synthetic oligonucleotide
  Target: DMPK; (+) strand; PAM type: NRG; PAM sequence: CAG
cgtaggcgctcggccggggg

SEQ ID NO: 11737 - DNA, 20 bp, Artificial Sequence
  Description of Artificial Sequence: Synthetic oligonucleotide
  Target: DMPK; (+) strand; PAM type: NRG; PAM sequence: CAG
tcggccgggggcagtgcgcc

SEQ ID NO: 11738 - DNA, 20 bp, Artificial Sequence
  Description of Artificial Sequence: Synthetic oligonucleotide
  Target: DMPK; (+) strand; PAM type: NRG; PAM sequence: AGG
cggccgggggcagtgcgccc

SEQ ID NO: 11739 - DNA, 20 bp, Artificial Sequence
  Description of Artificial Sequence: Synthetic oligonucleotide
  Target: DMPK; (+) strand; PAM type: NRG; PAM sequence: AAG
ccgggggcagtgcgcccagg

SEQ ID NO: 11740 - DNA, 20 bp, Artificial Sequence
  Description of Artificial Sequence: Synthetic oligonucleotide
  Target: DMPK; (+) strand; PAM type: NRG; PAM sequence: CGG
ggggcagtgcgcccaggaag

SEQ ID NO: 11741 - DNA, 20 bp, Artificial Sequence
  Description of Artificial Sequence: Synthetic oligonucleotide
  Target: DMPK; (+) strand; PAM type: NRG; PAM sequence: AAG
gtgcgcccaggaagcggctc

SEQ ID NO: 11742 - DNA, 20 bp, Artificial Sequence
  Description of Artificial Sequence: Synthetic oligonucleotide
  Target: DMPK; (+) strand; PAM type: NRG; PAM sequence: CGG
cgcccaggaagcggctcaag

SEQ ID NO: 11743 - DNA, 20 bp, Artificial Sequence
  Description of Artificial Sequence: Synthetic oligonucleotide
  Target: DMPK; (+) strand; PAM type: NRG; PAM sequence: CGG
caggaagcggctcaagcggc

SEQ ID NO: 11744 - DNA, 20 bp, Artificial Sequence
  Description of Artificial Sequence: Synthetic oligonucleotide
  Target: DMPK; (+) strand; PAM type: NRG; PAM sequence: TGG
agcggctcaagcggccggcg

SEQ ID NO: 11745 - DNA, 20 bp, Artificial Sequence
  Description of Artificial Sequence: Synthetic oligonucleotide
  Target: DMPK; (+) strand; PAM type: NRG; PAM sequence: TGG
agcggccggcgtggcccgcc

SEQ ID NO: 11746 - DNA, 20 bp, Artificial Sequence
  Description of Artificial Sequence: Synthetic oligonucleotide
  Target: DMPK; (+) strand; PAM type: NRG; PAM sequence: GAG
cggccggcgtggcccgcctg

SEQ ID NO: 11747 - DNA, 20 bp, Artificial Sequence
  Description of Artificial Sequence: Synthetic oligonucleotide
  Target: DMPK; (+) strand; PAM type: NRG; PAM sequence: CAG
ccggcgtggcccgcctggag

SEQ ID NO: 11748 - DNA, 20 bp, Artificial Sequence
  Description of Artificial Sequence: Synthetic oligonucleotide
  Target: DMPK; (+) strand; PAM type: NRG; PAM sequence: CAG
ccgcctggagcagcgcctcg

SEQ ID NO: 11749 - DNA, 20 bp, Artificial Sequence
  Description of Artificial Sequence: Synthetic oligonucleotide
  Target: DMPK; (+) strand; PAM type: NRG; PAM sequence: CGG
gcagacgcacgccacctgct

SEQ ID NO: 11750 - DNA, 20 bp, Artificial Sequence
  Description of Artificial Sequence: Synthetic oligonucleotide
  Target: DMPK; (+) strand; PAM type: NRG; PAM sequence: GGG
cagacgcacgccacctgctc

SEQ ID NO: 11751 - DNA, 20 bp, Artificial Sequence
  Description of Artificial Sequence: Synthetic oligonucleotide
  Target: DMPK; (+) strand; PAM type: NRG; PAM sequence: GAG
cgcacgccacctgctcgggc

SEQ ID NO: 11752 - DNA, 20 bp, Artificial Sequence
  Description of Artificial Sequence: Synthetic oligonucleotide
  Target: DMPK; (+) strand; PAM type: NRG; PAM sequence: AAG
acgccacctgctcgggcgag

SEQ ID NO: 11753 - DNA, 20 bp, Artificial Sequence
  Description of Artificial Sequence: Synthetic oligonucleotide
  Target: DMPK; (+) strand; PAM type: NRG; PAM sequence: CGG
ccacctgctcgggcgagaag

SEQ ID NO: 11754 - DNA, 20 bp, Artificial Sequence
  Description of Artificial Sequence: Synthetic oligonucleotide
  Target: DMPK; (+) strand; PAM type: NRG; PAM sequence: GAG
acctgctcgggcgagaagcg

SEQ ID NO: 11755 - DNA, 20 bp, Artificial Sequence
  Description of Artificial Sequence: Synthetic oligonucleotide
  Target: DMPK; (+) strand; PAM type: NRG; PAM sequence: AGG
cctgctcgggcgagaagcgg

SEQ ID NO: 11756 - DNA, 20 bp, Artificial Sequence
  Description of Artificial Sequence: Synthetic oligonucleotide
  Target: DMPK; (+) strand; PAM type: NRG; PAM sequence: TGG
gggcgagaagcggaggcccg

SEQ ID NO: 11757 - DNA, 20 bp, Artificial Sequence
  Description of Artificial Sequence: Synthetic oligonucleotide
  Target: DMPK; (+) strand; PAM type: NRG; PAM sequence: GGG
ggcgagaagcggaggcccgt

SEQ ID NO: 11758 - DNA, 20 bp, Artificial Sequence
  Description of Artificial Sequence: Synthetic oligonucleotide
  Target: DMPK; (+) strand; PAM type: NRG; PAM sequence: CGG
gagaagcggaggcccgtggg

SEQ ID NO: 11759 - DNA, 20 bp, Artificial Sequence
  Description of Artificial Sequence: Synthetic oligonucleotide
  Target: DMPK; (+) strand; PAM type: NRG; PAM sequence: CGG
gcggaggcccgtgggcggtt

SEQ ID NO: 11760 - DNA, 20 bp, Artificial Sequence
  Description of Artificial Sequence: Synthetic oligonucleotide
  Target: DMPK; (+) strand; PAM type: NRG; PAM sequence: AAG
gaggcccgtgggcggttcgg

SEQ ID NO: 11761 - DNA, 20 bp, Artificial Sequence
  Description of Artificial Sequence: Synthetic oligonucleotide
  Target: DMPK; (+) strand; PAM type: NRG; PAM sequence: CGG
gcccgtgggcggttcggaag

SEQ ID NO: 11762 - DNA, 20 bp, Artificial Sequence
  Description of Artificial Sequence: Synthetic oligonucleotide
  Target: DMPK; (+) strand; PAM type: NRG; PAM sequence: CGG
gggcggttcggaagcggcct

SEQ ID NO: 11763 - DNA, 20 bp, Artificial Sequence
  Description of Artificial Sequence: Synthetic oligonucleotide
  Target: DMPK; (+) strand; PAM type: NRG; PAM sequence: GGG
ggcggttcggaagcggcctc

SEQ ID NO: 11764 - DNA, 20 bp, Artificial Sequence
  Description of Artificial Sequence: Synthetic oligonucleotide
  Target: DMPK; (+) strand; PAM type: NRG; PAM sequence: GGG
gcggttcggaagcggcctcg

SEQ ID NO: 11765 - DNA, 20 bp, Artificial Sequence
  Description of Artificial Sequence: Synthetic oligonucleotide
  Target: DMPK; (+) strand; PAM type: NRG; PAM sequence: GGG
cggttcggaagcggcctcgg

SEQ ID NO: 11766 - DNA, 20 bp, Artificial Sequence
  Description of Artificial Sequence: Synthetic oligonucleotide
  Target: DMPK; (+) strand; PAM type: NRG; PAM sequence: GGG
ggttcggaagcggcctcggg

SEQ ID NO: 11767 - DNA, 20 bp, Artificial Sequence
  Description of Artificial Sequence: Synthetic oligonucleotide
  Target: DMPK; (+) strand; PAM type: NRG; PAM sequence: CGG
agcggcctcggggggcgacc

SEQ ID NO: 11768 - DNA, 20 bp, Artificial Sequence
  Description of Artificial Sequence: Synthetic oligonucleotide
  Target: DMPK; (+) strand; PAM type: NRG; PAM sequence: GGG
gcggcctcggggggcgaccc

SEQ ID NO: 11769 - DNA, 20 bp, Artificial Sequence
  Description of Artificial Sequence: Synthetic oligonucleotide
  Target: DMPK; (+) strand; PAM type: NRG; PAM sequence: GGG
cggcctcggggggcgacccg

SEQ ID NO: 11770 - DNA, 20 bp, Artificial Sequence
  Description of Artificial Sequence: Synthetic oligonucleotide
  Target: DMPK; (+) strand; PAM type: NRG; PAM sequence: CGG
gggggcgacccggggacgcc

SEQ ID NO: 11771 - DNA, 20 bp, Artificial Sequence
  Description of Artificial Sequence: Synthetic oligonucleotide
  Target: DMPK; (+) strand; PAM type: NRG; PAM sequence: GGG
ggggcgacccggggacgccc

SEQ ID NO: 11772 - DNA, 20 bp, Artificial Sequence
  Description of Artificial Sequence: Synthetic oligonucleotide
  Target: DMPK; (+) strand; PAM type: NRG; PAM sequence: GGG
gggcgacccggggacgcccg

SEQ ID NO: 11773 - DNA, 20 bp, Artificial Sequence
  Description of Artificial Sequence: Synthetic oligonucleotide
  Target: DMPK; (+) strand; PAM type: NRG; PAM sequence: CGG
ccggggacgcccggggatcc

SEQ ID NO: 11774 - DNA, 20 bp, Artificial Sequence
  Description of Artificial Sequence: Synthetic oligonucleotide
  Target: DMPK; (+) strand; PAM type: NRG; PAM sequence: GGG
cggggacgcccggggatccc

SEQ ID NO: 11775 - DNA, 20 bp, Artificial Sequence
  Description of Artificial Sequence: Synthetic oligonucleotide
  Target: DMPK; (+) strand; PAM type: NRG; PAM sequence: CAG
gcccggggatcccgggccct

SEQ ID NO: 11776 - DNA, 20 bp, Artificial Sequence
  Description of Artificial Sequence: Synthetic oligonucleotide
  Target: DMPK; (+) strand; PAM type: NRG; PAM sequence: CAG
tcccgggccctcagctcccg

SEQ ID NO: 11777 - DNA, 20 bp, Artificial Sequence
  Description of Artificial Sequence: Synthetic oligonucleotide
  Target: DMPK; (+) strand; PAM type: NRG; PAM sequence: CGG
cgcagccgctgcgcccgccc

SEQ ID NO: 11778 - DNA, 20 bp, Artificial Sequence
  Description of Artificial Sequence: Synthetic oligonucleotide
  Target: DMPK; (+) strand; PAM type: NRG; PAM sequence: CGG
cgctgcgcccgccccggccc

SEQ ID NO: 11779 - DNA, 20 bp, Artificial Sequence
  Description of Artificial Sequence: Synthetic oligonucleotide
  Target: DMPK; (+) strand; PAM type: NRG; PAM sequence: CGG
cgccgccgccgcctcaccct

SEQ ID NO: 11780 - DNA, 20 bp, Artificial Sequence
  Description of Artificial Sequence: Synthetic oligonucleotide
  Target: DMPK; (+) strand; PAM type: NRG; PAM sequence: AAG
ctcaccctcggccgcctgca

SEQ ID NO: 11781 - DNA, 20 bp, Artificial Sequence
  Description of Artificial Sequence: Synthetic oligonucleotide
  Target: DMPK; (+) strand; PAM type: NRG; PAM sequence: AAG
cggccgcctgcaaagtctgc

SEQ ID NO: 11782 - DNA, 20 bp, Artificial Sequence
  Description of Artificial Sequence: Synthetic oligonucleotide
  Target: DMPK; (+) strand; PAM type: NRG; PAM sequence: GAG
gccgcctgcaaagtctgcaa

SEQ ID NO: 11783 - DNA, 20 bp, Artificial Sequence
  Description of Artificial Sequence: Synthetic oligonucleotide
  Target: DMPK; (+) strand; PAM type: NRG; PAM sequence: TGG
cctgcaaagtctgcaagagc

SEQ ID NO: 11784 - DNA, 20 bp, Artificial Sequence
  Description of Artificial Sequence: Synthetic oligonucleotide
  Target: DMPK; (+) strand; PAM type: NRG; PAM sequence: CGG
cgcttcctcctcctcctctt

SEQ ID NO: 11785 - DNA, 20 bp, Artificial Sequence
  Description of Artificial Sequence: Synthetic oligonucleotide
  Target: DMPK; (+) strand; PAM type: NRG; PAM sequence: CAG
cgccgccaccgcctcccccc

SEQ ID NO: 11786 - DNA, 20 bp, Artificial Sequence
  Description of Artificial Sequence: Synthetic oligonucleotide
  Target: DMPK; (+) strand; PAM type: NRG; PAM sequence: CGG
accgcctcccccccagccgc

SEQ ID NO: 11787 - DNA, 20 bp, Artificial Sequence
  Description of Artificial Sequence: Synthetic oligonucleotide
  Target: DMPK; (+) strand; PAM type: NRG; PAM sequence: CGG
ccagccgccggccccgcgct

SEQ ID NO: 11788 - DNA, 20 bp, Artificial Sequence
  Description of Artificial Sequence: Synthetic oligonucleotide
  Target: DMPK; (+) strand; PAM type: NRG; PAM sequence: CAG
cggccccgcgctcggctccg

SEQ ID NO: 11789 - DNA, 20 bp, Artificial Sequence
  Description of Artificial Sequence: Synthetic oligonucleotide
  Target: DMPK; (+) strand; PAM type: NRG; PAM sequence: AGG
ggccccgcgctcggctccgc

SEQ ID NO: 11790 - DNA, 20 bp, Artificial Sequence
  Description of Artificial Sequence: Synthetic oligonucleotide
  Target: DMPK; (+) strand; PAM type: NRG; PAM sequence: AAG
ccgcgctcggctccgcaggc

SEQ ID NO: 11791 - DNA, 20 bp, Artificial Sequence
  Description of Artificial Sequence: Synthetic oligonucleotide
  Target: DMPK; (+) strand; PAM type: NRG; PAM sequence: AGG
cgcgctcggctccgcaggca

SEQ ID NO: 11792 - DNA, 20 bp, Artificial Sequence
  Description of Artificial Sequence: Synthetic oligonucleotide
  Target: DMPK; (+) strand; PAM type: NRG; PAM sequence: TAG
gctcggctccgcaggcaagg

SEQ ID NO: 11793 - DNA, 20 bp, Artificial Sequence
  Description of Artificial Sequence: Synthetic oligonucleotide
  Target: DMPK; (+) strand; PAM type: NRG; PAM sequence: TGG
gtagccatgttttgcaactt

SEQ ID NO: 11794 - DNA, 20 bp, Artificial Sequence
  Description of Artificial Sequence: Synthetic oligonucleotide
  Target: DMPK; (+) strand; PAM type: NRG; PAM sequence: GGG
tagccatgttttgcaacttt

SEQ ID NO: 11795 - DNA, 20 bp, Artificial Sequence
  Description of Artificial Sequence: Synthetic oligonucleotide
  Target: DMPK; (+) strand; PAM type: NRG; PAM sequence: AAG
ccatgttttgcaactttggg

SEQ ID NO: 11796 - DNA, 20 bp, Artificial Sequence
  Description of Artificial Sequence: Synthetic oligonucleotide
  Target: DMPK; (+) strand; PAM type: NRG; PAM sequence: CGG
ccctccctctcttcctccct

SEQ ID NO: 11797 - DNA, 20 bp, Artificial Sequence
  Description of Artificial Sequence: Synthetic oligonucleotide
  Target: DMPK; (+) strand; PAM type: NRG; PAM sequence: GGG
cctccctctcttcctccctc

SEQ ID NO: 11798 - DNA, 20 bp, Artificial Sequence
  Description of Artificial Sequence: Synthetic oligonucleotide
  Target: DMPK; (+) strand; PAM type: NRG; PAM sequence: CAG
ttcctccctcgggctttccc

SEQ ID NO: 11799 - DNA, 20 bp, Artificial Sequence
  Description of Artificial Sequence: Synthetic oligonucleotide
  Target: DMPK; (+) strand; PAM type: NRG; PAM sequence: TGG
gctcttctcgatcttctttc

SEQ ID NO: 11800 - DNA, 20 bp, Artificial Sequence
  Description of Artificial Sequence: Synthetic oligonucleotide
  Target: DMPK; (+) strand; PAM type: NRG; PAM sequence: CGG
gccgaccctgcgccccacgc

SEQ ID NO: 11801 - DNA, 20 bp, Artificial Sequence
  Description of Artificial Sequence: Synthetic oligonucleotide
  Target: DMPK; (+) strand; PAM type: NRG; PAM sequence: GGG
ccgaccctgcgccccacgcc

SEQ ID NO: 11802 - DNA, 20 bp, Artificial Sequence
  Description of Artificial Sequence: Synthetic oligonucleotide
  Target: DMPK; (+) strand; PAM type: NRG; PAM sequence: AAG
accctgcgccccacgccggg

SEQ ID NO: 11803 - DNA, 20 bp, Artificial Sequence
  Description of Artificial Sequence: Synthetic oligonucleotide
  Target: DMPK; (+) strand; PAM type: NRG; PAM sequence: AGG
ccctgcgccccacgccggga

SEQ ID NO: 11804 - DNA, 20 bp, Artificial Sequence
  Description of Artificial Sequence: Synthetic oligonucleotide
  Target: DMPK; (+) strand; PAM type: NRG; PAM sequence: GAG
gcgccccacgccgggaaggc

SEQ ID NO: 11805 - DNA, 20 bp, Artificial Sequence
  Description of Artificial Sequence: Synthetic oligonucleotide
  Target: DMPK; (+) strand; PAM type: NRG; PAM sequence: CAG
cacgccgggaaggcgagatc

SEQ ID NO: 11806 - DNA, 20 bp, Artificial Sequence
  Description of Artificial Sequence: Synthetic oligonucleotide
  Target: DMPK; (+) strand; PAM type: NRG; PAM sequence: CGG
gcgagatccagctctccact

SEQ ID NO: 11807 - DNA, 20 bp, Artificial Sequence
  Description of Artificial Sequence: Synthetic oligonucleotide
  Target: DMPK; (+) strand; PAM type: NRG; PAM sequence: GGG
cgagatccagctctccactc

SEQ ID NO: 11808 - DNA, 20 bp, Artificial Sequence
  Description of Artificial Sequence: Synthetic oligonucleotide
  Target: DMPK; (+) strand; PAM type: NRG; PAM sequence: TGG
ctttgttttccctccgcctc

SEQ ID NO: 11809 - DNA, 20 bp, Artificial Sequence
  Description of Artificial Sequence: Synthetic oligonucleotide
  Target: DMPK; (+) strand; PAM type: NRG; PAM sequence: CAG
ccgcgctttctgcctccccc

SEQ ID NO: 11810 - DNA, 20 bp, Artificial Sequence
  Description of Artificial Sequence: Synthetic oligonucleotide
  Target: DMPK; (+) strand; PAM type: NRG; PAM sequence: TGG
ctccccccagcgtgtgcttc

SEQ ID NO: 11811 - DNA, 20 bp, Artificial Sequence
  Description of Artificial Sequence: Synthetic oligonucleotide
  Target: DMPK; (+) strand; PAM type: NRG; PAM sequence: CAG
cccagcgtgtgcttctggct

SEQ ID NO: 11812 - DNA, 20 bp, Artificial Sequence
  Description of Artificial Sequence: Synthetic oligonucleotide
  Target: DMPK; (+) strand; PAM type: NRG; PAM sequence: AGG
ccagcgtgtgcttctggctc

SEQ ID NO: 11813 - DNA, 20 bp, Artificial Sequence
  Description of Artificial Sequence: Synthetic oligonucleotide
  Target: DMPK; (+) strand; PAM type: NRG; PAM sequence: GGG
cagcgtgtgcttctggctca

SEQ ID NO: 11814 - DNA, 20 bp, Artificial Sequence
  Description of Artificial Sequence: Synthetic oligonucleotide
  Target: DMPK; (+) strand; PAM type: NRG; PAM sequence: CAG
gtgcttctggctcagggcct

SEQ ID NO: 11815 - DNA, 20 bp, Artificial Sequence
  Description of Artificial Sequence: Synthetic oligonucleotide
  Target: DMPK; (+) strand; PAM type: NRG; PAM sequence: CGG
cagggcctcagtttccccat

SEQ ID NO: 11816 - DNA, 20 bp, Artificial Sequence
  Description of Artificial Sequence: Synthetic oligonucleotide
  Target: DMPK; (+) strand; PAM type: NRG; PAM sequence: GGG
agggcctcagtttccccatc

SEQ ID NO: 11817 - DNA, 20 bp, Artificial Sequence
  Description of Artificial Sequence: Synthetic oligonucleotide
  Target: DMPK; (+) strand; PAM type: NRG; PAM sequence: CAG
gtttccccatcgggacaacg

SEQ ID NO: 11818 - DNA, 20 bp, Artificial Sequence
  Description of Artificial Sequence: Synthetic oligonucleotide
  Target: DMPK; (+) strand; PAM type: NRG; PAM sequence: AAG
tccccatcgggacaacgcag

SEQ ID NO: 11819 - DNA, 20 bp, Artificial Sequence
  Description of Artificial Sequence: Synthetic oligonucleotide
  Target: DMPK; (+) strand; PAM type: NRG; PAM sequence: AGG
ccccatcgggacaacgcaga

SEQ ID NO: 11820 - DNA, 20 bp, Artificial Sequence
  Description of Artificial Sequence: Synthetic oligonucleotide
  Target: DMPK; (+) strand; PAM type: NRG; PAM sequence: CGG
cgggacaacgcagaaggtaa

SEQ ID NO: 11821 - DNA, 20 bp, Artificial Sequence
  Description of Artificial Sequence: Synthetic oligonucleotide
  Target: DMPK; (+) strand; PAM type: NRG; PAM sequence: GGG
gggacaacgcagaaggtaac

SEQ ID NO: 11822 - DNA, 20 bp, Artificial Sequence
  Description of Artificial Sequence: Synthetic oligonucleotide
  Target: DMPK; (+) strand; PAM type: NRG; PAM sequence: CAG
gcagaaggtaacgggccgtc

SEQ ID NO: 11823 - DNA, 20 bp, Artificial Sequence
  Description of Artificial Sequence: Synthetic oligonucleotide
  Target: DMPK; (+) strand; PAM type: NRG; PAM sequence: AGG
cagaaggtaacgggccgtcc

SEQ ID NO: 11824 - DNA, 20 bp, Artificial Sequence
  Description of Artificial Sequence: Synthetic oligonucleotide
  Target: DMPK; (+) strand; PAM type: NRG; PAM sequence: GAG
gaaggtaacgggccgtccag

SEQ ID NO: 11825 - DNA, 20 bp, Artificial Sequence
  Description of Artificial Sequence: Synthetic oligonucleotide
  Target: DMPK; (+) strand; PAM type: NRG; PAM sequence: AGG
aaggtaacgggccgtccagg

SEQ ID NO: 11826 - DNA, 20 bp, Artificial Sequence
  Description of Artificial Sequence: Synthetic oligonucleotide
  Target: DMPK; (+) strand; PAM type: NRG; PAM sequence: AAG
acgggccgtccaggaggact

SEQ ID NO: 11827 - DNA, 20 bp, Artificial Sequence
  Description of Artificial Sequence: Synthetic oligonucleotide
  Target: DMPK; (+) strand; PAM type: NRG; PAM sequence: AGG
cgggccgtccaggaggacta

SEQ ID NO: 11828 - DNA, 20 bp, Artificial Sequence
  Description of Artificial Sequence: Synthetic oligonucleotide
  Target: DMPK; (+) strand; PAM type: NRG; PAM sequence: GGG
gggccgtccaggaggactaa

SEQ ID NO: 11829 - DNA, 20 bp, Artificial Sequence
  Description of Artificial Sequence: Synthetic oligonucleotide
  Target: DMPK; (+) strand; PAM type: NRG; PAM sequence: AAG
ccaggaggactaagggcgcg

SEQ ID NO: 11830 - DNA, 20 bp, Artificial Sequence
  Description of Artificial Sequence: Synthetic oligonucleotide
  Target: DMPK; (+) strand; PAM type: NRG; PAM sequence: GAG
gggcgcgaagcctccgcccc

SEQ ID NO: 11831 - DNA, 20 bp, Artificial Sequence
  Description of Artificial Sequence: Synthetic oligonucleotide
  Target: DMPK; (+) strand; PAM type: NRG; PAM sequence: GAG
gaagcctccgccccgagact

SEQ ID NO: 11832 - DNA, 20 bp, Artificial Sequence
  Description of Artificial Sequence: Synthetic oligonucleotide
  Target: DMPK; (+) strand; PAM type: NRG; PAM sequence: CAG
cttctgcacgcctccgtctc

SEQ ID NO: 11833 - DNA, 20 bp, Artificial Sequence
  Description of Artificial Sequence: Synthetic oligonucleotide
  Target: DMPK; (+) strand; PAM type: NRG; PAM sequence: AGG
ttctgcacgcctccgtctcc

SEQ ID NO: 11834 - DNA, 20 bp, Artificial Sequence
  Description of Artificial Sequence: Synthetic oligonucleotide
  Target: DMPK; (+) strand; PAM type: NRG; PAM sequence: GGG
tctgcacgcctccgtctcca

SEQ ID NO: 11835 - DNA, 20 bp, Artificial Sequence
  Description of Artificial Sequence: Synthetic oligonucleotide
  Target: DMPK; (+) strand; PAM type: NRG; PAM sequence: CAG
tccgtctccagggtcctctg

SEQ ID NO: 11836 - DNA, 20 bp, Artificial Sequence
  Description of Artificial Sequence: Synthetic oligonucleotide
  Target: DMPK; (+) strand; PAM type: NRG; PAM sequence: AGG
ccgtctccagggtcctctgc

SEQ ID NO: 11837 - DNA, 20 bp, Artificial Sequence
  Description of Artificial Sequence: Synthetic oligonucleotide
  Target: DMPK; (+) strand; PAM type: NRG; PAM sequence: CGG
ggcccccacattccccatct

SEQ ID NO: 11838 - DNA, 20 bp, Artificial Sequence
  Description of Artificial Sequence: Synthetic oligonucleotide
  Target: DMPK; (+) strand; PAM type: NRG; PAM sequence: CGG
tcggcctgcgctccgcccct

SEQ ID NO: 11839 - DNA, 20 bp, Artificial Sequence
  Description of Artificial Sequence: Synthetic oligonucleotide
  Target: DMPK; (+) strand; PAM type: NRG; PAM sequence: CGG
gctccgcccctcggaattcc

SEQ ID NO: 11840 - DNA, 20 bp, Artificial Sequence
  Description of Artificial Sequence: Synthetic oligonucleotide
  Target: DMPK; (+) strand; PAM type: NRG; PAM sequence: CAG
cctcggaattcccggctccg

SEQ ID NO: 11841 - DNA, 20 bp, Artificial Sequence
  Description of Artificial Sequence: Synthetic oligonucleotide
  Target: DMPK; (+) strand; PAM type: NRG; PAM sequence: AGG
ctcggaattcccggctccgc

SEQ ID NO: 11842 - DNA, 20 bp, Artificial Sequence
  Description of Artificial Sequence: Synthetic oligonucleotide
  Target: DMPK; (+) strand; PAM type: NRG; PAM sequence: GGG
tcggaattcccggctccgca

SEQ ID NO: 11843 - DNA, 20 bp, Artificial Sequence
  Description of Artificial Sequence: Synthetic oligonucleotide
  Target: DMPK; (+) strand; PAM type: NRG; PAM sequence: GGG
cggaattcccggctccgcag

SEQ ID NO: 11844 - DNA, 20 bp, Artificial Sequence
  Description of Artificial Sequence: Synthetic oligonucleotide
  Target: DMPK; (+) strand; PAM type: NRG; PAM sequence: GGG
ggaattcccggctccgcagg

SEQ ID NO: 11845 - DNA, 20 bp, Artificial Sequence
  Description of Artificial Sequence: Synthetic oligonucleotide
  Target: DMPK; (+) strand; PAM type: NRG; PAM sequence: GGG
gaattcccggctccgcaggg

SEQ ID NO: 11846 - DNA, 20 bp, Artificial Sequence
  Description of Artificial Sequence: Synthetic oligonucleotide
  Target: DMPK; (+) strand; PAM type: NRG; PAM sequence: GGG
aattcccggctccgcagggg

SEQ ID NO: 11847 - DNA, 20 bp, Artificial Sequence
  Description of Artificial Sequence: Synthetic oligonucleotide
  Target: DMPK; (+) strand; PAM type: NRG; PAM sequence: CGG
tcccggctccgcaggggggg

SEQ ID NO: 11848 - DNA, 20 bp, Artificial Sequence
  Description of Artificial Sequence: Synthetic oligonucleotide
  Target: DMPK; (+) strand; PAM type: NRG; PAM sequence: GGG
cccggctccgcagggggggc

SEQ ID NO: 11849 - DNA, 20 bp, Artificial Sequence
  Description of Artificial Sequence: Synthetic oligonucleotide
  Target: DMPK; (+) strand; PAM type: NRG; PAM sequence: TGG
ctccgcagggggggcgggtc

SEQ ID NO: 11850 - DNA, 20 bp, Artificial Sequence
  Description of Artificial Sequence: Synthetic oligonucleotide
  Target: DMPK; (+) strand; PAM type: NRG; PAM sequence: CGG
gcagggggggcgggtctggc

SEQ ID NO: 11851 - DNA, 20 bp, Artificial Sequence
  Description of Artificial Sequence: Synthetic oligonucleotide
  Target: DMPK; (+) strand; PAM type: NRG; PAM sequence: GGG
cagggggggcgggtctggcc

SEQ ID NO: 11852 - DNA, 20 bp, Artificial Sequence
  Description of Artificial Sequence: Synthetic oligonucleotide
  Target: DMPK; (+) strand; PAM type: NRG; PAM sequence: GAG
gggggggcgggtctggccgg

SEQ ID NO: 11853 - DNA, 20 bp, Artificial Sequence
  Description of Artificial Sequence: Synthetic oligonucleotide
  Target: DMPK; (+) strand; PAM type: NRG; PAM sequence: AGG
ggggggcgggtctggccggg

SEQ ID NO: 11854 - DNA, 20 bp, Artificial Sequence
  Description of Artificial Sequence: Synthetic oligonucleotide
  Target: DMPK; (+) strand; PAM type: NRG; PAM sequence: GAG
ggggcgggtctggccgggag

SEQ ID NO: 11855 - DNA, 20 bp, Artificial Sequence
  Description of Artificial Sequence: Synthetic oligonucleotide
  Target: DMPK; (+) strand; PAM type: NRG; PAM sequence: AGG
gggcgggtctggccgggagg

SEQ ID NO: 11856 - DNA, 20 bp, Artificial Sequence
  Description of Artificial Sequence: Synthetic oligonucleotide
  Target: DMPK; (+) strand; PAM type: NRG; PAM sequence: GGG
ggcgggtctggccgggagga

SEQ ID NO: 11857 - DNA, 20 bp, Artificial Sequence
  Description of Artificial Sequence: Synthetic oligonucleotide
  Target: DMPK; (+) strand; PAM type: NRG; PAM sequence: GGG
gcgggtctggccgggaggag

SEQ ID NO: 11858 - DNA, 20 bp, Artificial Sequence
  Description of Artificial Sequence: Synthetic oligonucleotide
  Target: DMPK; (+) strand; PAM type: NRG; PAM sequence: CGG
ggtctggccgggaggagggg

SEQ ID NO: 11859 - DNA, 20 bp, Artificial Sequence
  Description of Artificial Sequence: Synthetic oligonucleotide
  Target: DMPK; (+) strand; PAM type: NRG; PAM sequence: GGG
gtctggccgggaggaggggc

SEQ ID NO: 11860 - DNA, 20 bp, Artificial Sequence
  Description of Artificial Sequence: Synthetic oligonucleotide
  Target: DMPK; (+) strand; PAM type: NRG; PAM sequence: GGG
tctggccgggaggaggggcg

SEQ ID NO: 11861 - DNA, 20 bp, Artificial Sequence
  Description of Artificial Sequence: Synthetic oligonucleotide
  Target: DMPK; (+) strand; PAM type: NRG; PAM sequence: CGG
ccgggaggaggggcggggaa

SEQ ID NO: 11862 - DNA, 20 bp, Artificial Sequence
  Description of Artificial Sequence: Synthetic oligonucleotide
  Target: DMPK; (+) strand; PAM type: NRG; PAM sequence: GGG
cgggaggaggggcggggaac

SEQ ID NO: 11863 - DNA, 20 bp, Artificial Sequence
  Description of Artificial Sequence: Synthetic oligonucleotide
  Target: DMPK; (+) strand; PAM type: NRG; PAM sequence: TAG
aggaggggcggggaacgggc

SEQ ID NO: 11864 - DNA, 20 bp, Artificial Sequence
  Description of Artificial Sequence: Synthetic oligonucleotide
  Target: DMPK; (+) strand; PAM type: NRG; PAM sequence: AAG
ggggcggggaacgggctaga

SEQ ID NO: 11865 - DNA, 20 bp, Artificial Sequence
  Description of Artificial Sequence: Synthetic oligonucleotide
  Target: DMPK; (+) strand; PAM type: NRG; PAM sequence: CAG
ggaacgggctagaaagtttg

SEQ ID NO: 11866 - DNA, 20 bp, Artificial Sequence
  Description of Artificial Sequence: Synthetic oligonucleotide
  Target: DMPK; (+) strand; PAM type: NRG; PAM sequence: GAG
agtttgcagcaacttttctc

SEQ ID NO: 11867 - DNA, 20 bp, Artificial Sequence
  Description of Artificial Sequence: Synthetic oligonucleotide
  Target: DMPK; (+) strand; PAM type: NRG; PAM sequence: CAG
cttttctcgagcttgcgtcc

SEQ ID NO: 11868 - DNA, 20 bp, Artificial Sequence
  Description of Artificial Sequence: Synthetic oligonucleotide
  Target: DMPK; (+) strand; PAM type: NRG; PAM sequence: AGG
ttttctcgagcttgcgtccc

SEQ ID NO: 11869 - DNA, 20 bp, Artificial Sequence
  Description of Artificial Sequence: Synthetic oligonucleotide
  Target: DMPK; (+) strand; PAM type: NRG; PAM sequence: GAG
ttctcgagcttgcgtcccag

SEQ ID NO: 11870 - DNA, 20 bp, Artificial Sequence
  Description of Artificial Sequence: Synthetic oligonucleotide
  Target: DMPK; (+) strand; PAM type: NRG; PAM sequence: CGG
tcgagcttgcgtcccaggag

SEQ ID NO: 11871 - DNA, 20 bp, Artificial Sequence
  Description of Artificial Sequence: Synthetic oligonucleotide
  Target: DMPK; (+) strand; PAM type: NRG; PAM sequence: TGG
gtcccaggagcggatgcgcg

SEQ ID NO: 11872 - DNA, 20 bp, Artificial Sequence
  Description of Artificial Sequence: Synthetic oligonucleotide
  Target: DMPK; (+) strand; PAM type: NRG; PAM sequence: CAG
gcggatgcgcgtggcgtgcg

SEQ ID NO: 11873 - DNA, 20 bp, Artificial Sequence
  Description of Artificial Sequence: Synthetic oligonucleotide
  Target: DMPK; (+) strand; PAM type: NRG; PAM sequence: AGG
cggatgcgcgtggcgtgcgc

SEQ ID NO: 11874 - DNA, 20 bp, Artificial Sequence
  Description of Artificial Sequence: Synthetic oligonucleotide
  Target: DMPK; (+) strand; PAM type: NRG; PAM sequence: CAG
gcgcgtggcgtgcgcaggcg

SEQ ID NO: 11875 - DNA, 20 bp, Artificial Sequence
  Description of Artificial Sequence: Synthetic oligonucleotide
  Target: DMPK; (+) strand; PAM type: NRG; PAM sequence: TGG
cgtggcgtgcgcaggcgcag

SEQ ID NO: 11876 - DNA, 20 bp, Artificial Sequence
  Description of Artificial Sequence: Synthetic oligonucleotide
  Target: DMPK; (+) strand; PAM type: NRG; PAM sequence: AAG
ggcgtgcgcaggcgcagtgg

SEQ ID NO: 11877 - DNA, 20 bp, Artificial Sequence
  Description of Artificial Sequence: Synthetic oligonucleotide
  Target: DMPK; (+) strand; PAM type: NRG; PAM sequence: AGG
gcgtgcgcaggcgcagtgga

SEQ ID NO: 11878 - DNA, 20 bp, Artificial Sequence
  Description of Artificial Sequence: Synthetic oligonucleotide
  Target: DMPK; (+) strand; PAM type: NRG; PAM sequence: GAG
gtgcgcaggcgcagtggaag

SEQ ID NO: 11879 - DNA, 20 bp, Artificial Sequence
  Description of Artificial Sequence: Synthetic oligonucleotide
  Target: DMPK; (+) strand; PAM type: NRG; PAM sequence: AGG
tgcgcaggcgcagtggaagg

SEQ ID NO: 11880 - DNA, 20 bp, Artificial Sequence
  Description of Artificial Sequence: Synthetic oligonucleotide
  Target: DMPK; (+) strand; PAM type: NRG; PAM sequence: TGG
caggcgcagtggaaggagga

SEQ ID NO: 11881 - DNA, 20 bp, Artificial Sequence
  Description of Artificial Sequence: Synthetic oligonucleotide
  Target: DMPK; (+) strand; PAM type: NRG; PAM sequence: CAG
aggatggccgcgcgcgctgc

SEQ ID NO: 11882 - DNA, 20 bp, Artificial Sequence
  Description of Artificial Sequence: Synthetic oligonucleotide
  Target: DMPK; (+) strand; PAM type: NRG; PAM sequence: CAG
ggccgcgcgcgctgccagcc

SEQ ID NO: 11883 - DNA, 20 bp, Artificial Sequence
  Description of Artificial Sequence: Synthetic oligonucleotide
  Target: DMPK; (+) strand; PAM type: NRG; PAM sequence: CGG
agccccctcttctcgacgct

SEQ ID NO: 11884 - DNA, 20 bp, Artificial Sequence
  Description of Artificial Sequence: Synthetic oligonucleotide
  Target: DMPK; (+) strand; PAM type: NRG; PAM sequence: TGG
cccctcttctcgacgctcgg

SEQ ID NO: 11885 - DNA, 20 bp, Artificial Sequence
  Description of Artificial Sequence: Synthetic oligonucleotide
  Target: DMPK; (+) strand; PAM type: NRG; PAM sequence: CAG
cttctcgacgctcggtggca

SEQ ID NO: 11886 - DNA, 20 bp, Artificial Sequence
  Description of Artificial Sequence: Synthetic oligonucleotide
  Target: DMPK; (+) strand; PAM type: NRG; PAM sequence: TGG
tcgacgctcggtggcacagc

SEQ ID NO: 11887 - DNA, 20 bp, Artificial Sequence
  Description of Artificial Sequence: Synthetic oligonucleotide
  Target: DMPK; (+) strand; PAM type: NRG; PAM sequence: GGG
cgacgctcggtggcacagct

SEQ ID NO: 11888 - DNA, 20 bp, Artificial Sequence
  Description of Artificial Sequence: Synthetic oligonucleotide
  Target: DMPK; (+) strand; PAM type: NRG; PAM sequence: CAG
tcggtggcacagctgggcca

SEQ ID NO: 11889 - DNA, 20 bp, Artificial Sequence
  Description of Artificial Sequence: Synthetic oligonucleotide
  Target: DMPK; (+) strand; PAM type: NRG; PAM sequence: TGG
tggcacagctgggccacagc

SEQ ID NO: 11890 - DNA, 20 bp, Artificial Sequence
  Description of Artificial Sequence: Synthetic oligonucleotide
  Target: DMPK; (+) strand; PAM type: NRG; PAM sequence: GGG
ggcacagctgggccacagct

SEQ ID NO: 11891 - DNA, 20 bp, Artificial Sequence
  Description of Artificial Sequence: Synthetic oligonucleotide
  Target: DMPK; (+) strand; PAM type: NRG; PAM sequence: CGG
acagctgggccacagctggg

SEQ ID NO: 11892 - DNA, 20 bp, Artificial Sequence
  Description of Artificial Sequence: Synthetic oligonucleotide
  Target: DMPK; (+) strand; PAM type: NRG; PAM sequence: GGG
cagctgggccacagctgggc

SEQ ID NO: 11893 - DNA, 20 bp, Artificial Sequence
  Description of Artificial Sequence: Synthetic oligonucleotide
  Target: DMPK; (+) strand; PAM type: NRG; PAM sequence: GGG
agctgggccacagctgggcg

SEQ ID NO: 11894 - DNA, 20 bp, Artificial Sequence
  Description of Artificial Sequence: Synthetic oligonucleotide
  Target: DMPK; (+) strand; PAM type: NRG; PAM sequence: GGG
gctgggccacagctgggcgg

SEQ ID NO: 11895 - DNA, 20 bp, Artificial Sequence
  Description of Artificial Sequence: Synthetic oligonucleotide
  Target: DMPK; (+) strand; PAM type: NRG; PAM sequence: CGG
gggccacagctgggcggggg

SEQ ID NO: 11896 - DNA, 20 bp, Artificial Sequence
  Description of Artificial Sequence: Synthetic oligonucleotide
  Target: DMPK; (+) strand; PAM type: NRG; PAM sequence: CGG
ctgggcgggggcggtgcctc

SEQ ID NO: 11897 - DNA, 20 bp, Artificial Sequence
  Description of Artificial Sequence: Synthetic oligonucleotide
  Target: DMPK; (+) strand; PAM type: NRG; PAM sequence: GGG
tgggcgggggcggtgcctcc

SEQ ID NO: 11898 - DNA, 20 bp, Artificial Sequence
  Description of Artificial Sequence: Synthetic oligonucleotide
  Target: DMPK; (+) strand; PAM type: NRG; PAM sequence: TGG
gcgggggcggtgcctccggg

SEQ ID NO: 11899 - DNA, 20 bp, Artificial Sequence
  Description of Artificial Sequence: Synthetic oligonucleotide
  Target: DMPK; (+) strand; PAM type: NRG; PAM sequence: TGG
tggcccgctcgccctcctat

SEQ ID NO: 11900 - DNA, 20 bp, Artificial Sequence
  Description of Artificial Sequence: Synthetic oligonucleotide
  Target: DMPK; (+) strand; PAM type: NRG; PAM sequence: CGG
ccgctcgccctcctattggc

SEQ ID NO: 11901 - DNA, 20 bp, Artificial Sequence
  Description of Artificial Sequence: Synthetic oligonucleotide
  Target: DMPK; (+) strand; PAM type: NRG; PAM sequence: AAG
ctcctattggccggacgcca

SEQ ID NO: 11902 - DNA, 20 bp, Artificial Sequence
  Description of Artificial Sequence: Synthetic oligonucleotide
  Target: DMPK; (+) strand; PAM type: NRG; PAM sequence: TGG
gacgccaaagccccgccccg

SEQ ID NO: 11903 - DNA, 20 bp, Artificial Sequence
  Description of Artificial Sequence: Synthetic oligonucleotide
  Target: DMPK; (+) strand; PAM type: NRG; PAM sequence: CGG
ttcctcccccaaccctgatt

SEQ ID NO: 11904 - DNA, 20 bp, Artificial Sequence
  Description of Artificial Sequence: Synthetic oligonucleotide
  Target: DMPK; (+) strand; PAM type: NRG; PAM sequence: TAG
tcggccgcttcgcatcccgc

SEQ ID NO: 11905 - DNA, 20 bp, Artificial Sequence
  Description of Artificial Sequence: Synthetic oligonucleotide
  Target: DMPK; (+) strand; PAM type: NRG; PAM sequence: CAG
cgcatcccgctagctcctcc

SEQ ID NO: 11906 - DNA, 20 bp, Artificial Sequence
  Description of Artificial Sequence: Synthetic oligonucleotide
  Target: DMPK; (+) strand; PAM type: NRG; PAM sequence: CGG
gctagctcctcccagacctt

SEQ ID NO: 11907 - DNA, 20 bp, Artificial Sequence
  Description of Artificial Sequence: Synthetic oligonucleotide
  Target: DMPK; (+) strand; PAM type: NRG; PAM sequence: CGG
cggccgcctccacacgcctc

SEQ ID NO: 11908 - DNA, 20 bp, Artificial Sequence
  Description of Artificial Sequence: Synthetic oligonucleotide
  Target: DMPK; (+) strand; PAM type: NRG; PAM sequence: TGG
gcctccacacgcctccggat

SEQ ID NO: 11909 - DNA, 20 bp, Artificial Sequence
  Description of Artificial Sequence: Synthetic oligonucleotide
  Target: DMPK; (+) strand; PAM type: NRG; PAM sequence: CGG
gcctccggattggcccgctg

SEQ ID NO: 11910 - DNA, 20 bp, Artificial Sequence
  Description of Artificial Sequence: Synthetic oligonucleotide
  Target: DMPK; (+) strand; PAM type: NRG; PAM sequence: GAG
ctccggattggcccgctgcg

SEQ ID NO: 11911 - DNA, 20 bp, Artificial Sequence
  Description of Artificial Sequence: Synthetic oligonucleotide
  Target: DMPK; (+) strand; PAM type: NRG; PAM sequence: CGG
ttggcccgctgcggagcctc

SEQ ID NO: 11912 - DNA, 20 bp, Artificial Sequence
  Description of Artificial Sequence: Synthetic oligonucleotide
  Target: DMPK; (+) strand; PAM type: NRG; PAM sequence: CGG
ccggcccacaacgcaaaccg

SEQ ID NO: 11913 - DNA, 20 bp, Artificial Sequence
  Description of Artificial Sequence: Synthetic oligonucleotide
  Target: DMPK; (+) strand; PAM type: NRG; PAM sequence: TGG
aacgcaaaccgcggacactg

SEQ ID NO: 11914 - DNA, 20 bp, Artificial Sequence
  Description of Artificial Sequence: Synthetic oligonucleotide
  Target: DMPK; (+) strand; PAM type: NRG; PAM sequence: GAG
cgcaaaccgcggacactgtg

SEQ ID NO: 11915 - DNA, 20 bp, Artificial Sequence
  Description of Artificial Sequence: Synthetic oligonucleotide
  Target: DMPK; (+) strand; PAM type: NRG; PAM sequence: CAG
accgcggacactgtggagtc

SEQ ID NO: 11916 - DNA, 20 bp, Artificial Sequence
  Description of Artificial Sequence: Synthetic oligonucleotide
  Target: DMPK; (+) strand; PAM type: NRG; PAM sequence: GAG
cgcggacactgtggagtcca

SEQ ID NO: 11917 - DNA, 20 bp, Artificial Sequence
  Description of Artificial Sequence: Synthetic oligonucleotide
  Target: DMPK; (+) strand; PAM type: NRG; PAM sequence: TGG
cactgtggagtccagagctt

SEQ ID NO: 11918 - DNA, 20 bp, Artificial Sequence
  Description of Artificial Sequence: Synthetic oligonucleotide
  Target: DMPK; (+) strand; PAM type: NRG; PAM sequence: GGG
actgtggagtccagagcttt

SEQ ID NO: 11919 - DNA, 20 bp, Artificial Sequence
  Description of Artificial Sequence: Synthetic oligonucleotide
  Target: DMPK; (+) strand; PAM type: NRG; PAM sequence: CAG
gtggagtccagagctttggg

SEQ ID NO: 11920 - DNA, 20 bp, Artificial Sequence
  Description of Artificial Sequence: Synthetic oligonucleotide
  Target: DMPK; (+) strand; PAM type: NRG; PAM sequence: TGG
agtccagagctttgggcaga

SEQ ID NO: 11921 - DNA, 20 bp, Artificial Sequence
  Description of Artificial Sequence: Synthetic oligonucleotide
  Target: DMPK; (+) strand; PAM type: NRG; PAM sequence: GAG
tccagagctttgggcagatg

SEQ ID NO: 11922 - DNA, 20 bp, Artificial Sequence
  Description of Artificial Sequence: Synthetic oligonucleotide
  Target: DMPK; (+) strand; PAM type: NRG; PAM sequence: AGG
ccagagctttgggcagatgg

SEQ ID NO: 11923 - DNA, 20 bp, Artificial Sequence
  Description of Artificial Sequence: Synthetic oligonucleotide
  Target: DMPK; (+) strand; PAM type: NRG; PAM sequence: GGG
cagagctttgggcagatgga

SEQ ID NO: 11924 - DNA, 20 bp, Artificial Sequence
  Description of Artificial Sequence: Synthetic oligonucleotide
  Target: DMPK; (+) strand; PAM type: NRG; PAM sequence: GAG
atggagggccttttattcgc

SEQ ID NO: 11925 - DNA, 20 bp, Artificial Sequence
  Description of Artificial Sequence: Synthetic oligonucleotide
  Target: DMPK; (+) strand; PAM type: NRG; PAM sequence: AGG
tggagggccttttattcgcg

SEQ ID NO: 11926 - DNA, 20 bp, Artificial Sequence
  Description of Artificial Sequence: Synthetic oligonucleotide
  Target: DMPK; (+) strand; PAM type: NRG; PAM sequence: GGG
ggagggccttttattcgcga

SEQ ID NO: 11927 - DNA, 20 bp, Artificial Sequence
  Description of Artificial Sequence: Synthetic oligonucleotide
  Target: DMPK; (+) strand; PAM type: NRG; PAM sequence: CGG
ggccttttattcgcgagggt

SEQ ID NO: 11928 - DNA, 20 bp, Artificial Sequence
  Description of Artificial Sequence: Synthetic oligonucleotide
  Target: DMPK; (+) strand; PAM type: NRG; PAM sequence: GGG
gccttttattcgcgagggtc

SEQ ID NO: 11929 - DNA, 20 bp, Artificial Sequence
  Description of Artificial Sequence: Synthetic oligonucleotide
  Target: DMPK; (+) strand; PAM type: NRG; PAM sequence: GGG
ccttttattcgcgagggtcg

SEQ ID NO: 11930 - DNA, 20 bp, Artificial Sequence
  Description of Artificial Sequence: Synthetic oligonucleotide
  Target: DMPK; (+) strand; PAM type: NRG; PAM sequence: GGG
cttttattcgcgagggtcgg

SEQ ID NO: 11931 - DNA, 20 bp, Artificial Sequence
  Description of Artificial Sequence: Synthetic oligonucleotide
  Target: DMPK; (+) strand; PAM type: NRG; PAM sequence: TGG
ttattcgcgagggtcggggg

SEQ ID NO: 11932 - DNA, 20 bp, Artificial Sequence
  Description of Artificial Sequence: Synthetic oligonucleotide
  Target: DMPK; (+) strand; PAM type: NRG; PAM sequence: GGG
tattcgcgagggtcgggggt

SEQ ID NO: 11933 - DNA, 20 bp, Artificial Sequence
  Description of Artificial Sequence: Synthetic oligonucleotide
  Target: DMPK; (+) strand; PAM type: NRG; PAM sequence: GGG
attcgcgagggtcgggggtg

SEQ ID NO: 11934 - DNA, 20 bp, Artificial Sequence
  Description of Artificial Sequence: Synthetic oligonucleotide
  Target: DMPK; (+) strand; PAM type: NRG; PAM sequence: GGG
ttcgcgagggtcgggggtgg

SEQ ID NO: 11935 - DNA, 20 bp, Artificial Sequence
  Description of Artificial Sequence: Synthetic oligonucleotide
  Target: DMPK; (+) strand; PAM type: NRG; PAM sequence: TAG
agggtcgggggtgggggtcc

SEQ ID NO: 11936 - DNA, 20 bp, Artificial Sequence
  Description of Artificial Sequence: Synthetic oligonucleotide
  Target: DMPK; (+) strand; PAM type: NRG; PAM sequence: AGG
gggtcgggggtgggggtcct

SEQ ID NO: 11937 - DNA, 20 bp, Artificial Sequence
  Description of Artificial Sequence: Synthetic oligonucleotide
  Target: DMPK; (+) strand; PAM type: NRG; PAM sequence: TGG
tcgggggtgggggtcctagg

SEQ ID NO: 11938 - DNA, 20 bp, Artificial Sequence
  Description of Artificial Sequence: Synthetic oligonucleotide
  Target: DMPK; (+) strand; PAM type: NRG; PAM sequence: GGG
cgggggtgggggtcctaggt

SEQ ID NO: 11939 - DNA, 20 bp, Artificial Sequence
  Description of Artificial Sequence: Synthetic oligonucleotide
  Target: DMPK; (+) strand; PAM type: NRG; PAM sequence: GGG
gggggtgggggtcctaggtg

SEQ ID NO: 11940 - DNA, 20 bp, Artificial Sequence
  Description of Artificial Sequence: Synthetic oligonucleotide
  Target: DMPK; (+) strand; PAM type: NRG; PAM sequence: CAG
gtgggggtcctaggtgggga

SEQ ID NO: 11941 - DNA, 20 bp, Artificial Sequence
  Description of Artificial Sequence: Synthetic oligonucleotide
  Target: DMPK; (+) strand; PAM type: NRG; PAM sequence: GAG
ggggacagacaataaatacc

SEQ ID NO: 11942 - DNA, 20 bp, Artificial Sequence
  Description of Artificial Sequence: Synthetic oligonucleotide
  Target: DMPK; (+) strand; PAM type: NRG; PAM sequence: AGG
gggacagacaataaataccg

SEQ ID NO: 11943 - DNA, 20 bp, Artificial Sequence
  Description of Artificial Sequence: Synthetic oligonucleotide
  Target: DMPK; (+) strand; PAM type: NRG; PAM sequence: CGG
caataaataccgaggaatgt

SEQ ID NO: 11944 - DNA, 20 bp, Artificial Sequence
  Description of Artificial Sequence: Synthetic oligonucleotide
  Target: DMPK; (+) strand; PAM type: NRG; PAM sequence: GGG
aataaataccgaggaatgtc

SEQ ID NO: 11945 - DNA, 20 bp, Artificial Sequence
  Description of Artificial Sequence: Synthetic oligonucleotide
  Target: DMPK; (+) strand; PAM type: NRG; PAM sequence: GGG
ataaataccgaggaatgtcg

SEQ ID NO: 11946 - DNA, 20 bp, Artificial Sequence
  Description of Artificial Sequence: Synthetic oligonucleotide
  Target: DMPK; (+) strand; PAM type: NRG; PAM sequence: CAG
accgaggaatgtcggggtct

SEQ ID NO: 11947 - DNA, 20 bp, Artificial Sequence
  Description of Artificial Sequence: Synthetic oligonucleotide
  Target: DMPK; (+) strand; PAM type: NRG; PAM sequence: TGG
gtctcagtgcatccaaaacg

SEQ ID NO: 11948 - DNA, 20 bp, Artificial Sequence
  Description of Artificial Sequence: Synthetic oligonucleotide
  Target: DMPK; (+) strand; PAM type: NRG; PAM sequence: TGG
agtgcatccaaaacgtggat

SEQ ID NO: 11949 - DNA, 20 bp, Artificial Sequence
  Description of Artificial Sequence: Synthetic oligonucleotide
  Target: DMPK; (+) strand; PAM type: NRG; PAM sequence: GGG
gtgcatccaaaacgtggatt

SEQ ID NO: 11950 - DNA, 20 bp, Artificial Sequence
  Description of Artificial Sequence: Synthetic oligonucleotide
  Target: DMPK; (+) strand; PAM type: NRG; PAM sequence: GGG
tgcatccaaaacgtggattg

SEQ ID NO: 11951 - DNA, 20 bp, Artificial Sequence
  Description of Artificial Sequence: Synthetic oligonucleotide
  Target: DMPK; (+) strand; PAM type: NRG; PAM sequence: TGG
aaaacgtggattggggttgt

SEQ ID NO: 11952 - DNA, 20 bp, Artificial Sequence
  Description of Artificial Sequence: Synthetic oligonucleotide
  Target: DMPK; (+) strand; PAM type: NRG; PAM sequence: GGG
aaacgtggattggggttgtt

SEQ ID NO: 11953 - DNA, 20 bp, Artificial Sequence
  Description of Artificial Sequence: Synthetic oligonucleotide
  Target: DMPK; (+) strand; PAM type: NRG; PAM sequence: GGG
aacgtggattggggttgttg

SEQ ID NO: 11954 - DNA, 20 bp, Artificial Sequence
  Description of Artificial Sequence: Synthetic oligonucleotide
  Target: DMPK; (+) strand; PAM type: NRG; PAM sequence: GGG
acgtggattggggttgttgg

SEQ ID NO: 11955 - DNA, 20 bp, Artificial Sequence
  Description of Artificial Sequence: Synthetic oligonucleotide
  Target: DMPK; (+) strand; PAM type: NRG; PAM sequence: TAG
tggggttgttgggggtcctg

SEQ ID NO: 11956 - DNA, 20 bp, Artificial Sequence
  Description of Artificial Sequence: Synthetic oligonucleotide
  Target: DMPK; (+) strand; PAM type: NRG; PAM sequence: CAG
ttgggggtcctgtagcctgt

SEQ ID NO: 11957 - DNA, 20 bp, Artificial Sequence
  Description of Artificial Sequence: Synthetic oligonucleotide
  Target: DMPK; (+) strand; PAM type: NRG; PAM sequence: GAG
gggtcctgtagcctgtcagc

SEQ ID NO: 11958 - DNA, 20 bp, Artificial Sequence
  Description of Artificial Sequence: Synthetic oligonucleotide
  Target: DMPK; (+) strand; PAM type: NRG; PAM sequence: CGG
cctgtagcctgtcagcgagt

SEQ ID NO: 11959 - DNA, 20 bp, Artificial Sequence
  Description of Artificial Sequence: Synthetic oligonucleotide
  Target: DMPK; (+) strand; PAM type: NRG; PAM sequence: GAG
tgtagcctgtcagcgagtcg

SEQ ID NO: 11960 - DNA, 20 bp, Artificial Sequence
  Description of Artificial Sequence: Synthetic oligonucleotide
  Target: DMPK; (+) strand; PAM type: NRG; PAM sequence: AGG
gtagcctgtcagcgagtcgg

SEQ ID NO: 11961 - DNA, 20 bp, Artificial Sequence
  Description of Artificial Sequence: Synthetic oligonucleotide
  Target: DMPK; (+) strand; PAM type: NRG; PAM sequence: GAG
ctgtcagcgagtcggaggac

SEQ ID NO: 11962 - DNA, 20 bp, Artificial Sequence
  Description of Artificial Sequence: Synthetic oligonucleotide
  Target: DMPK; (+) strand; PAM type: NRG; PAM sequence: AGG
tgtcagcgagtcggaggacg

SEQ ID NO: 11963 - DNA, 20 bp, Artificial Sequence
  Description of Artificial Sequence: Synthetic oligonucleotide
  Target: DMPK; (+) strand; PAM type: NRG; PAM sequence: AAG
aataaatatccaaaccgccg

SEQ ID NO: 11964 - DNA, 20 bp, Artificial Sequence
  Description of Artificial Sequence: Synthetic oligonucleotide
  Target: DMPK; (+) strand; PAM type: NRG; PAM sequence: CGG
aaatatccaaaccgccgaag

SEQ ID NO: 11965 - DNA, 20 bp, Artificial Sequence
  Description of Artificial Sequence: Synthetic oligonucleotide
  Target: DMPK; (+) strand; PAM type: NRG; PAM sequence: GGG
aatatccaaaccgccgaagc

SEQ ID NO: 11966 - DNA, 20 bp, Artificial Sequence
  Description of Artificial Sequence: Synthetic oligonucleotide
  Target: DMPK; (+) strand; PAM type: NRG; PAM sequence: CGG
atccaaaccgccgaagcggg

SEQ ID NO: 11967 - DNA, 20 bp, Artificial Sequence
  Description of Artificial Sequence: Synthetic oligonucleotide
  Target: DMPK; (+) strand; PAM type: NRG; PAM sequence: GAG
ccaaaccgccgaagcgggcg

SEQ ID NO: 11968 - DNA, 20 bp, Artificial Sequence
  Description of Artificial Sequence: Synthetic oligonucleotide
  Target: DMPK; (+) strand; PAM type: NRG; PAM sequence: CGG
accgccgaagcgggcggagc

SEQ ID NO: 11969 - DNA, 20 bp, Artificial Sequence
  Description of Artificial Sequence: Synthetic oligonucleotide
  Target: DMPK; (+) strand; PAM type: NRG; PAM sequence: TGG
ccgaagcgggcggagccggc

SEQ ID NO: 11970 - DNA, 20 bp, Artificial Sequence
  Description of Artificial Sequence: Synthetic oligonucleotide
  Target: DMPK; (+) strand; PAM type: NRG; PAM sequence: GGG
cgaagcgggcggagccggct

SEQ ID NO: 11971 - DNA, 20 bp, Artificial Sequence
  Description of Artificial Sequence: Synthetic oligonucleotide
  Target: DMPK; (+) strand; PAM type: NRG; PAM sequence: GGG
gaagcgggcggagccggctg

SEQ ID NO: 11972 - DNA, 20 bp, Artificial Sequence
  Description of Artificial Sequence: Synthetic oligonucleotide
  Target: DMPK; (+) strand; PAM type: NRG; PAM sequence: GAG
gcggagccggctggggctcc

SEQ ID NO: 11973 - DNA, 20 bp, Artificial Sequence
  Description of Artificial Sequence: Synthetic oligonucleotide
  Target: DMPK; (+) strand; PAM type: NRG; PAM sequence: GAG
ggagccggctggggctccga

SEQ ID NO: 11974 - DNA, 20 bp, Artificial Sequence
  Description of Artificial Sequence: Synthetic oligonucleotide
  Target: DMPK; (+) strand; PAM type: NRG; PAM sequence: CAG
gccggctggggctccgagag

SEQ ID NO: 11975 - DNA, 20 bp, Artificial Sequence
  Description of Artificial Sequence: Synthetic oligonucleotide
  Target: DMPK; (+) strand; PAM type: NRG; PAM sequence: AAG
tggggctccgagagcagcgc

SEQ ID NO: 11976 - DNA, 20 bp, Artificial Sequence
  Description of Artificial Sequence: Synthetic oligonucleotide
  Target: DMPK; (+) strand; PAM type: NRG; PAM sequence: GAG
gctccgagagcagcgcaagt

SEQ ID NO: 11977 - DNA, 20 bp, Artificial Sequence
  Description of Artificial Sequence: Synthetic oligonucleotide
  Target: DMPK; (+) strand; PAM type: NRG; PAM sequence: AGG
ctccgagagcagcgcaagtg

SEQ ID NO: 11978 - DNA, 20 bp, Artificial Sequence
  Description of Artificial Sequence: Synthetic oligonucleotide
  Target: DMPK; (+) strand; PAM type: NRG; PAM sequence: GAG
ccgagagcagcgcaagtgag

SEQ ID NO: 11979 - DNA, 20 bp, Artificial Sequence
  Description of Artificial Sequence: Synthetic oligonucleotide
  Target: DMPK; (+) strand; PAM type: NRG; PAM sequence: AGG
cgagagcagcgcaagtgagg

SEQ ID NO: 11980 - DNA, 20 bp, Artificial Sequence
  Description of Artificial Sequence: Synthetic oligonucleotide
  Target: DMPK; (+) strand; PAM type: NRG; PAM sequence: GGG
gagagcagcgcaagtgagga

SEQ ID NO: 11981 - DNA, 20 bp, Artificial Sequence
  Description of Artificial Sequence: Synthetic oligonucleotide
  Target: DMPK; (+) strand; PAM type: NRG; PAM sequence: GGG
agagcagcgcaagtgaggag

SEQ ID NO: 11982 - DNA, 20 bp, Artificial Sequence
  Description of Artificial Sequence: Synthetic oligonucleotide
  Target: DMPK; (+) strand; PAM type: NRG; PAM sequence: GGG
gagcagcgcaagtgaggagg

SEQ ID NO: 11983 - DNA, 20 bp, Artificial Sequence
  Description of Artificial Sequence: Synthetic oligonucleotide
  Target: DMPK; (+) strand; PAM type: NRG; PAM sequence: GGG
agcagcgcaagtgaggaggg

SEQ ID NO: 11984 - DNA, 20 bp, Artificial Sequence
  Description of Artificial Sequence: Synthetic oligonucleotide
  Target: DMPK; (+) strand; PAM type: NRG; PAM sequence: CGG
cgcaagtgaggaggggggcg

SEQ ID NO: 11985 - DNA, 20 bp, Artificial Sequence
  Description of Artificial Sequence: Synthetic oligonucleotide
  Target: DMPK; (+) strand; PAM type: NRG; PAM sequence: GGG
gcaagtgaggaggggggcgc

SEQ ID NO: 11986 - DNA, 20 bp, Artificial Sequence
  Description of Artificial Sequence: Synthetic oligonucleotide
  Target: DMPK; (+) strand; PAM type: NRG; PAM sequence: AAG
ggggcgcgggatccccgaaa

SEQ ID NO: 11987 - DNA, 20 bp, Artificial Sequence
  Description of Artificial Sequence: Synthetic oligonucleotide
  Target: DMPK; (+) strand; PAM type: NRG; PAM sequence: CGG
gcgcgggatccccgaaaaag

SEQ ID NO: 11988 - DNA, 20 bp, Artificial Sequence
  Description of Artificial Sequence: Synthetic oligonucleotide
  Target: DMPK; (+) strand; PAM type: NRG; PAM sequence: GGG
cgcgggatccccgaaaaagc

SEQ ID NO: 11989 - DNA, 20 bp, Artificial Sequence
  Description of Artificial Sequence: Synthetic oligonucleotide
  Target: DMPK; (+) strand; PAM type: NRG; PAM sequence: TGG
gatccccgaaaaagcgggtt

SEQ ID NO: 11990 - DNA, 20 bp, Artificial Sequence
  Description of Artificial Sequence: Synthetic oligonucleotide
  Target: DMPK; (+) strand; PAM type: NRG; PAM sequence: AAG
cgaaaaagcgggtttggcaa

SEQ ID NO: 11991 - DNA, 20 bp, Artificial Sequence
  Description of Artificial Sequence: Synthetic oligonucleotide
  Target: DMPK; (+) strand; PAM type: NRG; PAM sequence: GAG
ttggcaaaagcaaatttccc

SEQ ID NO: 11992 - DNA, 20 bp, Artificial Sequence
  Description of Artificial Sequence: Synthetic oligonucleotide
  Target: DMPK; (+) strand; PAM type: NRG; PAM sequence: AAG
caaaagcaaatttcccgagt

SEQ ID NO: 11993 - DNA, 20 bp, Artificial Sequence
  Description of Artificial Sequence: Synthetic oligonucleotide
  Target: DMPK; (+) strand; PAM type: NRG; PAM sequence: CAG
aagcaaatttcccgagtaag

SEQ ID NO: 11994 - DNA, 20 bp, Artificial Sequence
  Description of Artificial Sequence: Synthetic oligonucleotide
  Target: DMPK; (+) strand; PAM type: NRG; PAM sequence: AGG
agcaaatttcccgagtaagc

SEQ ID NO: 11995 - DNA, 20 bp, Artificial Sequence
  Description of Artificial Sequence: Synthetic oligonucleotide
  Target: DMPK; (+) strand; PAM type: NRG; PAM sequence: CAG
aaatttcccgagtaagcagg

SEQ ID NO: 11996 - DNA, 20 bp, Artificial Sequence
  Description of Artificial Sequence: Synthetic oligonucleotide
  Target: DMPK; (+) strand; PAM type: NRG; PAM sequence: GAG
atttcccgagtaagcaggca

SEQ ID NO: 11997 - DNA, 20 bp, Artificial Sequence
  Description of Artificial Sequence: Synthetic oligonucleotide
  Target: DMPK; (+) strand; PAM type: NRG; PAM sequence: CAG
taagcaggcagagatcgcgc

SEQ ID NO: 11998 - DNA, 20 bp, Artificial Sequence
  Description of Artificial Sequence: Synthetic oligonucleotide
  Target: DMPK; (+) strand; PAM type: NRG; PAM sequence: CAG
agatcgcgccagacgctccc

SEQ ID NO: 11999 - DNA, 20 bp, Artificial Sequence
  Description of Artificial Sequence: Synthetic oligonucleotide
  Target: DMPK; (+) strand; PAM type: NRG; PAM sequence: GAG
atcgcgccagacgctcccca

SEQ ID NO: 12000 - DNA, 20 bp, Artificial Sequence
  Description of Artificial Sequence: Synthetic oligonucleotide
  Target: DMPK; (+) strand; PAM type: NRG; PAM sequence: CAG
gcgccagacgctccccagag

SEQ ID NO: 12001 - DNA, 20 bp, Artificial Sequence
  Description of Artificial Sequence: Synthetic oligonucleotide
  Target: DMPK; (+) strand; PAM type: NRG; PAM sequence: AGG
cgccagacgctccccagagc

SEQ ID NO: 12002 - DNA, 20 bp, Artificial Sequence
  Description of Artificial Sequence: Synthetic oligonucleotide
  Target: DMPK; (+) strand; PAM type: NRG; PAM sequence: GGG
gccagacgctccccagagca

SEQ ID NO: 12003 - DNA, 20 bp, Artificial Sequence
  Description of Artificial Sequence: Synthetic oligonucleotide
  Target: DMPK; (+) strand; PAM type: NRG; PAM sequence: AAG
cagagcagggcgtcatgcac

SEQ ID NO: 12004 - DNA, 20 bp, Artificial Sequence
  Description of Artificial Sequence: Synthetic oligonucleotide
  Target: DMPK; (+) strand; PAM type: NRG; PAM sequence: AAG
gcagggcgtcatgcacaaga

SEQ ID NO: 12005 - DNA, 20 bp, Artificial Sequence
  Description of Artificial Sequence: Synthetic oligonucleotide
  Target: DMPK; (+) strand; PAM type: NRG; PAM sequence: TAG
tgcactttgcgaaccaacga

SEQ ID NO: 12006 - DNA, 20 bp, Artificial Sequence
  Description of Artificial Sequence: Synthetic oligonucleotide
  Target: DMPK; (+) strand; PAM type: NRG; PAM sequence: AGG
gcactttgcgaaccaacgat

SEQ ID NO: 12007 - DNA, 20 bp, Artificial Sequence
  Description of Artificial Sequence: Synthetic oligonucleotide
  Target: DMPK; (+) strand; PAM type: NRG; PAM sequence: TGG
ctttgcgaaccaacgatagg

SEQ ID NO: 12008 - DNA, 20 bp, Artificial Sequence
  Description of Artificial Sequence: Synthetic oligonucleotide
  Target: DMPK; (+) strand; PAM type: NRG; PAM sequence: GGG
tttgcgaaccaacgataggt

SEQ ID NO: 12009 - DNA, 20 bp, Artificial Sequence
  Description of Artificial Sequence: Synthetic oligonucleotide
  Target: DMPK; (+) strand; PAM type: NRG; PAM sequence: GGG
ttgcgaaccaacgataggtg

SEQ ID NO: 12010 - DNA, 20 bp, Artificial Sequence
  Description of Artificial Sequence: Synthetic oligonucleotide
  Target: DMPK; (+) strand; PAM type: NRG; PAM sequence: GGG
tgcgaaccaacgataggtgg

SEQ ID NO: 12011 - DNA, 20 bp, Artificial Sequence
  Description of Artificial Sequence: Synthetic oligonucleotide
  Target: DMPK; (+) strand; PAM type: NRG; PAM sequence: TGG
caacgataggtgggggtgcg

SEQ ID NO: 12012 - DNA, 20 bp, Artificial Sequence
  Description of Artificial Sequence: Synthetic oligonucleotide
  Target: DMPK; (+) strand; PAM type: NRG; PAM sequence: GAG
acgataggtgggggtgcgtg

SEQ ID NO: 12013 - DNA, 20 bp, Artificial Sequence
  Description of Artificial Sequence: Synthetic oligonucleotide
  Target: DMPK; (+) strand; PAM type: NRG; PAM sequence: AGG
cgataggtgggggtgcgtgg

SEQ ID NO: 12014 - DNA, 20 bp, Artificial Sequence
  Description of Artificial Sequence: Synthetic oligonucleotide
  Target: DMPK; (+) strand; PAM type: NRG; PAM sequence: TGG
aggtgggggtgcgtggagga

SEQ ID NO: 12015 - DNA, 20 bp, Artificial Sequence
  Description of Artificial Sequence: Synthetic oligonucleotide
  Target: DMPK; (+) strand; PAM type: NRG; PAM sequence: CGG
ggtgcgtggaggatggaaca

SEQ ID NO: 12016 - DNA, 20 bp, Artificial Sequence
  Description of Artificial Sequence: Synthetic oligonucleotide
  Target: DMPK; (+) strand; PAM type: NRG; PAM sequence: CGG
cgtggaggatggaacacgga

SEQ ID NO: 12017 - DNA, 20 bp, Artificial Sequence
  Description of Artificial Sequence: Synthetic oligonucleotide
  Target: DMPK; (+) strand; PAM type: NRG; PAM sequence: CGG
aggatggaacacggacggcc

SEQ ID NO: 12018 - DNA, 20 bp, Artificial Sequence
  Description of Artificial Sequence: Synthetic oligonucleotide
  Target: DMPK; (+) strand; PAM type: NRG; PAM sequence: CAG
ggcccggcttgctgccttcc

SEQ ID NO: 12019 - DNA, 20 bp, Artificial Sequence
  Description of Artificial Sequence: Synthetic oligonucleotide
  Target: DMPK; (+) strand; PAM type: NRG; PAM sequence: AGG
gcccggcttgctgccttccc

SEQ ID NO: 12020 - DNA, 20 bp, Artificial Sequence
  Description of Artificial Sequence: Synthetic oligonucleotide
  Target: DMPK; (+) strand; PAM type: NRG; PAM sequence: CAG
ttgctgccttcccaggcctg

SEQ ID NO: 12021 - DNA, 20 bp, Artificial Sequence
  Description of Artificial Sequence: Synthetic oligonucleotide
  Target: DMPK; (+) strand; PAM type: NRG; PAM sequence: CAG
tgcagtttgcccatccacgt

SEQ ID NO: 12022 - DNA, 20 bp, Artificial Sequence
  Description of Artificial Sequence: Synthetic oligonucleotide
  Target: DMPK; (+) strand; PAM type: NRG; PAM sequence: AGG
gcagtttgcccatccacgtc

SEQ ID NO: 12023 - DNA, 20 bp, Artificial Sequence
  Description of Artificial Sequence: Synthetic oligonucleotide
  Target: DMPK; (+) strand; PAM type: NRG; PAM sequence: GGG
cagtttgcccatccacgtca

SEQ ID NO: 12024 - DNA, 20 bp, Artificial Sequence
  Description of Artificial Sequence: Synthetic oligonucleotide
  Target: DMPK; (+) strand; PAM type: NRG; PAM sequence: CAG
gcccatccacgtcagggcct

SEQ ID NO: 12025 - DNA, 20 bp, Artificial Sequence
  Description of Artificial Sequence: Synthetic oligonucleotide
  Target: DMPK; (+) strand; PAM type: NRG; PAM sequence: TGG
tccacgtcagggcctcagcc

SEQ ID NO: 12026 - DNA, 20 bp, Artificial Sequence
  Description of Artificial Sequence: Synthetic oligonucleotide
  Target: DMPK; (+) strand; PAM type: NRG; PAM sequence: AAG
cagggcctcagcctggccga

SEQ ID NO: 12027 - DNA, 20 bp, Artificial Sequence
  Description of Artificial Sequence: Synthetic oligonucleotide
  Target: DMPK; (+) strand; PAM type: NRG; PAM sequence: AAG
gcctcagcctggccgaaaga

SEQ ID NO: 12028 - DNA, 20 bp, Artificial Sequence
  Description of Artificial Sequence: Synthetic oligonucleotide
  Target: DMPK; (+) strand; PAM type: NRG; PAM sequence: TGG
gcctggccgaaagaaagaaa

SEQ ID NO: 12029 - DNA, 20 bp, Artificial Sequence
  Description of Artificial Sequence: Synthetic oligonucleotide
  Target: DMPK; (+) strand; PAM type: NRG; PAM sequence: CAG
gaaatggtctgtgatccccc

SEQ ID NO: 12030 - DNA, 20 bp, Artificial Sequence
  Description of Artificial Sequence: Synthetic oligonucleotide
  Target: DMPK; (+) strand; PAM type: NRG; PAM sequence: CAG
atggtctgtgatccccccag

SEQ ID NO: 12031 - DNA, 20 bp, Artificial Sequence
  Description of Artificial Sequence: Synthetic oligonucleotide
  Target: DMPK; (+) strand; PAM type: NRG; PAM sequence: CAG
gtctgtgatccccccagcag

SEQ ID NO: 12032 - DNA, 20 bp, Artificial Sequence
  Description of Artificial Sequence: Synthetic oligonucleotide
  Target: DMPK; (+) strand; PAM type: NRG; PAM sequence: CAG
tgtgatccccccagcagcag

SEQ ID NO: 12033 - DNA, 20 bp, Artificial Sequence
  Description of Artificial Sequence: Synthetic oligonucleotide
  Target: DMPK; (+) strand; PAM type: NRG; PAM sequence: CAG
gatccccccagcagcagcag

SEQ ID NO: 12034 - DNA, 20 bp, Artificial Sequence
  Description of Artificial Sequence: Synthetic oligonucleotide
  Target: DMPK; (+) strand; PAM type: NRG; PAM sequence: CAG
ccccccagcagcagcagcag

SEQ ID NO: 12035 - DNA, 20 bp, Artificial Sequence
  Description of Artificial Sequence: Synthetic oligonucleotide
  Target: DMPK; (+) strand; PAM type: NRG; PAM sequence: CAG
cccagcagcagcagcagcag

SEQ ID NO: 12036 - DNA, 20 bp, Artificial Sequence
  Description of Artificial Sequence: Synthetic oligonucleotide
  Target: DMPK; (+) strand; PAM type: NRG; PAM sequence: CAG
agcagcagcagcagcagcag

SEQ ID NO: 12037 - DNA, 20 bp, Artificial Sequence
  Description of Artificial Sequence: Synthetic oligonucleotide
  Target: DMPK; (+) strand; PAM type: NRG; PAM sequence: CAG
agcagcagcagcagcagcag

SEQ ID NO: 12038 - DNA, 20 bp, Artificial Sequence
  Description of Artificial Sequence: Synthetic oligonucleotide
  Target: DMPK; (+) strand; PAM type: NRG; PAM sequence: CAG
agcagcagcagcagcagcag

SEQ ID NO: 12039 - DNA, 20 bp, Artificial Sequence
  Description of Artificial Sequence: Synthetic oligonucleotide
  Target: DMPK; (+) strand; PAM type: NRG; PAM sequence: CAG
agcagcagcagcagcagcag

SEQ ID NO: 12040 - DNA, 20 bp, Artificial Sequence
  Description of Artificial Sequence: Synthetic oligonucleotide
  Target: DMPK; (+) strand; PAM type: NRG; PAM sequence: CAG
agcagcagcagcagcagcag

SEQ ID NO: 12041 - DNA, 20 bp, Artificial Sequence
  Description of Artificial Sequence: Synthetic oligonucleotide
  Target: DMPK; (+) strand; PAM type: NRG; PAM sequence: CAG
agcagcagcagcagcagcag

SEQ ID NO: 12042 - DNA, 20 bp, Artificial Sequence
  Description of Artificial Sequence: Synthetic oligonucleotide
  Target: DMPK; (+) strand; PAM type: NRG; PAM sequence: CAG
agcagcagcagcagcagcag

SEQ ID NO: 12043 - DNA, 20 bp, Artificial Sequence
  Description of Artificial Sequence: Synthetic oligonucleotide
  Target: DMPK; (+) strand; PAM type: NRG; PAM sequence: CAG
agcagcagcagcagcagcag

SEQ ID NO: 12044 - DNA, 20 bp, Artificial Sequence
  Description of Artificial Sequence: Synthetic oligonucleotide
  Target: DMPK; (+) strand; PAM type: NRG; PAM sequence: CAG
agcagcagcagcagcagcag

SEQ ID NO: 12045 - DNA, 20 bp, Artificial Sequence
  Description of Artificial Sequence: Synthetic oligonucleotide
  Target: DMPK; (+) strand; PAM type: NRG; PAM sequence: CAG
agcagcagcagcagcagcag

SEQ ID NO: 12046 - DNA, 20 bp, Artificial Sequence
  Description of Artificial Sequence: Synthetic oligonucleotide
  Target: DMPK; (+) strand; PAM type: NRG; PAM sequence: CAG
agcagcagcagcagcagcag

SEQ ID NO: 12047 - DNA, 20 bp, Artificial Sequence
  Description of Artificial Sequence: Synthetic oligonucleotide
  Target: DMPK; (+) strand; PAM type: NRG; PAM sequence: CAG
agcagcagcagcagcagcag

SEQ ID NO: 12048 - DNA, 20 bp, Artificial Sequence
  Description of Artificial Sequence: Synthetic oligonucleotide
  Target: DMPK; (+) strand; PAM type: NRG; PAM sequence: CAG
agcagcagcagcagcagcag

SEQ ID NO: 12049 - DNA, 20 bp, Artificial Sequence
  Description of Artificial Sequence: Synthetic oligonucleotide
  Target: DMPK; (+) strand; PAM type: NRG; PAM sequence: CGG
agcagcagcagcagcattcc

SEQ ID NO: 12050 - DNA, 20 bp, Artificial Sequence
  Description of Artificial Sequence: Synthetic oligonucleotide
  Target: DMPK; (+) strand; PAM type: NRG; PAM sequence: AAG
gcagcagcattcccggctac

SEQ ID NO: 12051 - DNA, 20 bp, Artificial Sequence
  Description of Artificial Sequence: Synthetic oligonucleotide
  Target: DMPK; (+) strand; PAM type: NRG; PAM sequence: AGG
cagcagcattcccggctaca

SEQ ID NO: 12052 - DNA, 20 bp, Artificial Sequence
  Description of Artificial Sequence: Synthetic oligonucleotide
  Target: DMPK; (+) strand; PAM type: NRG; PAM sequence: GAG
cccggctacaaggacccttc

SEQ ID NO: 12053 - DNA, 20 bp, Artificial Sequence
  Description of Artificial Sequence: Synthetic oligonucleotide
  Target: DMPK; (+) strand; PAM type: NRG; PAM sequence: CGG
acccttcgagccccgttcgc

SEQ ID NO: 12054 - DNA, 20 bp, Artificial Sequence
  Description of Artificial Sequence: Synthetic oligonucleotide
  Target: DMPK; (+) strand; PAM type: NRG; PAM sequence: CGG
cgagccccgttcgccggccg

SEQ ID NO: 12055 - DNA, 20 bp, Artificial Sequence
  Description of Artificial Sequence: Synthetic oligonucleotide
  Target: DMPK; (+) strand; PAM type: NRG; PAM sequence: CGG
ccgttcgccggccgcggacc

SEQ ID NO: 12056 - DNA, 20 bp, Artificial Sequence
  Description of Artificial Sequence: Synthetic oligonucleotide
  Target: DMPK; (+) strand; PAM type: NRG; PAM sequence: CGG
ggacccggcccctccctccc

SEQ ID NO: 12057 - DNA, 20 bp, Artificial Sequence
  Description of Artificial Sequence: Synthetic oligonucleotide
  Target: DMPK; (+) strand; PAM type: NRG; PAM sequence: TAG
gcccctccctccccggccgc

SEQ ID NO: 12058 - DNA, 20 bp, Artificial Sequence
  Description of Artificial Sequence: Synthetic oligonucleotide
  Target: DMPK; (+) strand; PAM type: NRG; PAM sequence: AGG
cccctccctccccggccgct

SEQ ID NO: 12059 - DNA, 20 bp, Artificial Sequence
  Description of Artificial Sequence: Synthetic oligonucleotide
  Target: DMPK; (+) strand; PAM type: NRG; PAM sequence: GGG
ccctccctccccggccgcta

SEQ ID NO: 12060 - DNA, 20 bp, Artificial Sequence
  Description of Artificial Sequence: Synthetic oligonucleotide
  Target: DMPK; (+) strand; PAM type: NRG; PAM sequence: GGG
cctccctccccggccgctag

SEQ ID NO: 12061 - DNA, 20 bp, Artificial Sequence
  Description of Artificial Sequence: Synthetic oligonucleotide
  Target: DMPK; (+) strand; PAM type: NRG; PAM sequence: GGG
ctccctccccggccgctagg

SEQ ID NO: 12062 - DNA, 20 bp, Artificial Sequence
  Description of Artificial Sequence: Synthetic oligonucleotide
  Target: DMPK; (+) strand; PAM type: NRG; PAM sequence: CGG
cctccccggccgctaggggg

SEQ ID NO: 12063 - DNA, 20 bp, Artificial Sequence
  Description of Artificial Sequence: Synthetic oligonucleotide
  Target: DMPK; (+) strand; PAM type: NRG; PAM sequence: GGG
ctccccggccgctagggggc

SEQ ID NO: 12064 - DNA, 20 bp, Artificial Sequence
  Description of Artificial Sequence: Synthetic oligonucleotide
  Target: DMPK; (+) strand; PAM type: NRG; PAM sequence: CGG
cggccgctagggggcgggcc

SEQ ID NO: 12065 - DNA, 20 bp, Artificial Sequence
  Description of Artificial Sequence: Synthetic oligonucleotide
  Target: DMPK; (+) strand; PAM type: NRG; PAM sequence: CAG
tagggggcgggcccggatca

SEQ ID NO: 12066 - DNA, 20 bp, Artificial Sequence
  Description of Artificial Sequence: Synthetic oligonucleotide
  Target: DMPK; (+) strand; PAM type: NRG; PAM sequence: AGG
agggggcgggcccggatcac

SEQ ID NO: 12067 - DNA, 20 bp, Artificial Sequence
  Description of Artificial Sequence: Synthetic oligonucleotide
  Target: DMPK; (+) strand; PAM type: NRG; PAM sequence: TGG
gcgggcccggatcacaggac

SEQ ID NO: 12068 - DNA, 20 bp, Artificial Sequence
  Description of Artificial Sequence: Synthetic oligonucleotide
  Target: DMPK; (+) strand; PAM type: NRG; PAM sequence: GAG
gggcccggatcacaggactg

SEQ ID NO: 12069 - DNA, 20 bp, Artificial Sequence
  Description of Artificial Sequence: Synthetic oligonucleotide
  Target: DMPK; (+) strand; PAM type: NRG; PAM sequence: TGG
ccggatcacaggactggagc

SEQ ID NO: 12070 - DNA, 20 bp, Artificial Sequence
  Description of Artificial Sequence: Synthetic oligonucleotide
  Target: DMPK; (+) strand; PAM type: NRG; PAM sequence: GGG
cggatcacaggactggagct

SEQ ID NO: 12071 - DNA, 20 bp, Artificial Sequence
  Description of Artificial Sequence: Synthetic oligonucleotide
  Target: DMPK; (+) strand; PAM type: NRG; PAM sequence: CGG
atcacaggactggagctggg

SEQ ID NO: 12072 - DNA, 20 bp, Artificial Sequence
  Description of Artificial Sequence: Synthetic oligonucleotide
  Target: DMPK; (+) strand; PAM type: NRG; PAM sequence: GAG
cacaggactggagctgggcg

SEQ ID NO: 12073 - DNA, 20 bp, Artificial Sequence
  Description of Artificial Sequence: Synthetic oligonucleotide
  Target: DMPK; (+) strand; PAM type: NRG; PAM sequence: CGG
gctgggcggagacccacgct

SEQ ID NO: 12074 - DNA, 20 bp, Artificial Sequence
  Description of Artificial Sequence: Synthetic oligonucleotide
  Target: DMPK; (+) strand; PAM type: NRG; PAM sequence: GAG
tgggcggagacccacgctcg

SEQ ID NO: 12075 - DNA, 20 bp, Artificial Sequence
  Description of Artificial Sequence: Synthetic oligonucleotide
  Target: DMPK; (+) strand; PAM type: NRG; PAM sequence: CGG
gcggagacccacgctcggag

SEQ ID NO: 12076 - DNA, 20 bp, Artificial Sequence
  Description of Artificial Sequence: Synthetic oligonucleotide
  Target: DMPK; (+) strand; PAM type: NRG; PAM sequence: TGG
cgctcggagcggttgtgaac

SEQ ID NO: 12077 - DNA, 20 bp, Artificial Sequence
  Description of Artificial Sequence: Synthetic oligonucleotide
  Target: DMPK; (+) strand; PAM type: NRG; PAM sequence: CAG
tcggagcggttgtgaactgg

SEQ ID NO: 12078 - DNA, 20 bp, Artificial Sequence
  Description of Artificial Sequence: Synthetic oligonucleotide
  Target: DMPK; (+) strand; PAM type: NRG; PAM sequence: AGG
cggagcggttgtgaactggc

SEQ ID NO: 12079 - DNA, 20 bp, Artificial Sequence
  Description of Artificial Sequence: Synthetic oligonucleotide
  Target: DMPK; (+) strand; PAM type: NRG; PAM sequence: CGG
agcggttgtgaactggcagg

SEQ ID NO: 12080 - DNA, 20 bp, Artificial Sequence
  Description of Artificial Sequence: Synthetic oligonucleotide
  Target: DMPK; (+) strand; PAM type: NRG; PAM sequence: TGG
ggttgtgaactggcaggcgg

SEQ ID NO: 12081 - DNA, 20 bp, Artificial Sequence
  Description of Artificial Sequence: Synthetic oligonucleotide
  Target: DMPK; (+) strand; PAM type: NRG; PAM sequence: GGG
gttgtgaactggcaggcggt

SEQ ID NO: 12082 - DNA, 20 bp, Artificial Sequence
  Description of Artificial Sequence: Synthetic oligonucleotide
  Target: DMPK; (+) strand; PAM type: NRG; PAM sequence: CGG
gaactggcaggcggtgggcg

SEQ ID NO: 12083 - DNA, 20 bp, Artificial Sequence
  Description of Artificial Sequence: Synthetic oligonucleotide
  Target: DMPK; (+) strand; PAM type: NRG; PAM sequence: CGG
gcggcttctgtgccgtgccc

SEQ ID NO: 12084 - DNA, 20 bp, Artificial Sequence
  Description of Artificial Sequence: Synthetic oligonucleotide
  Target: DMPK; (+) strand; PAM type: NRG; PAM sequence: GGG
cggcttctgtgccgtgcccc

SEQ ID NO: 12085 - DNA, 20 bp, Artificial Sequence
  Description of Artificial Sequence: Synthetic oligonucleotide
  Target: DMPK; (+) strand; PAM type: NRG; PAM sequence: CAG
tgtgccgtgccccgggcact

SEQ ID NO: 12086 - DNA, 20 bp, Artificial Sequence
  Description of Artificial Sequence: Synthetic oligonucleotide
  Target: DMPK; (+) strand; PAM type: NRG; PAM sequence: CGG
ccgggcactcagtcttccaa

SEQ ID NO: 12087 - DNA, 20 bp, Artificial Sequence
  Description of Artificial Sequence: Synthetic oligonucleotide
  Target: DMPK; (+) strand; PAM type: NRG; PAM sequence: GGG
cgggcactcagtcttccaac

SEQ ID NO: 12088 - DNA, 20 bp, Artificial Sequence
  Description of Artificial Sequence: Synthetic oligonucleotide
  Target: DMPK; (+) strand; PAM type: NRG; PAM sequence: GGG
gggcactcagtcttccaacg

SEQ ID NO: 12089 - DNA, 20 bp, Artificial Sequence
  Description of Artificial Sequence: Synthetic oligonucleotide
  Target: DMPK; (+) strand; PAM type: NRG; PAM sequence: CGG
tcagtcttccaacggggccc

SEQ ID NO: 12090 - DNA, 20 bp, Artificial Sequence
  Description of Artificial Sequence: Synthetic oligonucleotide
  Target: DMPK; (+) strand; PAM type: NRG; PAM sequence: GAG
agtcttccaacggggccccg

SEQ ID NO: 12091 - DNA, 20 bp, Artificial Sequence
  Description of Artificial Sequence: Synthetic oligonucleotide
  Target: DMPK; (+) strand; PAM type: NRG; PAM sequence: AAG
ccaacggggccccggagtcg

SEQ ID NO: 12092 - DNA, 20 bp, Artificial Sequence
  Description of Artificial Sequence: Synthetic oligonucleotide
  Target: DMPK; (+) strand; PAM type: NRG; PAM sequence: CAG
cggggccccggagtcgaaga

SEQ ID NO: 12093 - DNA, 20 bp, Artificial Sequence
  Description of Artificial Sequence: Synthetic oligonucleotide
  Target: DMPK; (+) strand; PAM type: NRG; PAM sequence: TAG
cccggagtcgaagacagttc

SEQ ID NO: 12094 - DNA, 20 bp, Artificial Sequence
  Description of Artificial Sequence: Synthetic oligonucleotide
  Target: DMPK; (+) strand; PAM type: NRG; PAM sequence: AGG
ccggagtcgaagacagttct

SEQ ID NO: 12095 - DNA, 20 bp, Artificial Sequence
  Description of Artificial Sequence: Synthetic oligonucleotide
  Target: DMPK; (+) strand; PAM type: NRG; PAM sequence: GGG
cggagtcgaagacagttcta

SEQ ID NO: 12096 - DNA, 20 bp, Artificial Sequence
  Description of Artificial Sequence: Synthetic oligonucleotide
  Target: DMPK; (+) strand; PAM type: NRG; PAM sequence: CAG
tcgaagacagttctagggtt

SEQ ID NO: 12097 - DNA, 20 bp, Artificial Sequence
  Description of Artificial Sequence: Synthetic oligonucleotide
  Target: DMPK; (+) strand; PAM type: NRG; PAM sequence: AGG
cgaagacagttctagggttc

SEQ ID NO: 12098 - DNA, 20 bp, Artificial Sequence
  Description of Artificial Sequence: Synthetic oligonucleotide
  Target: DMPK; (+) strand; PAM type: NRG; PAM sequence: GGG
gaagacagttctagggttca

SEQ ID NO: 12099 - DNA, 20 bp, Artificial Sequence
  Description of Artificial Sequence: Synthetic oligonucleotide
  Target: DMPK; (+) strand; PAM type: NRG; PAM sequence: GAG
agacagttctagggttcagg

SEQ ID NO: 12100 - DNA, 20 bp, Artificial Sequence
  Description of Artificial Sequence: Synthetic oligonucleotide
  Target: DMPK; (+) strand; PAM type: NRG; PAM sequence: CGG
gttctagggttcagggagcg

SEQ ID NO: 12101 - DNA, 20 bp, Artificial Sequence
  Description of Artificial Sequence: Synthetic oligonucleotide
  Target: DMPK; (+) strand; PAM type: NRG; PAM sequence: GGG
ttctagggttcagggagcgc

SEQ ID NO: 12102 - DNA, 20 bp, Artificial Sequence
  Description of Artificial Sequence: Synthetic oligonucleotide
  Target: DMPK; (+) strand; PAM type: NRG; PAM sequence: CGG
tagggttcagggagcgcggg

SEQ ID NO: 12103 - DNA, 20 bp, Artificial Sequence
  Description of Artificial Sequence: Synthetic oligonucleotide
  Target: DMPK; (+) strand; PAM type: NRG; PAM sequence: TGG
cagggagcgcgggcggctcc

SEQ ID NO: 12104 - DNA, 20 bp, Artificial Sequence
  Description of Artificial Sequence: Synthetic oligonucleotide
  Target: DMPK; (+) strand; PAM type: NRG; PAM sequence: GGG
agggagcgcgggcggctcct

SEQ ID NO: 12105 - DNA, 20 bp, Artificial Sequence
  Description of Artificial Sequence: Synthetic oligonucleotide
  Target: DMPK; (+) strand; PAM type: NRG; PAM sequence: CGG
gagcgcgggcggctcctggg

SEQ ID NO: 12106 - DNA, 20 bp, Artificial Sequence
  Description of Artificial Sequence: Synthetic oligonucleotide
  Target: DMPK; (+) strand; PAM type: NRG; PAM sequence: CAG
gggcggctcctgggcggcgc

SEQ ID NO: 12107 - DNA, 20 bp, Artificial Sequence
  Description of Artificial Sequence: Synthetic oligonucleotide
  Target: DMPK; (+) strand; PAM type: NRG; PAM sequence: CGG
tcctgggcggcgccagactg

SEQ ID NO: 12108 - DNA, 20 bp, Artificial Sequence
  Description of Artificial Sequence: Synthetic oligonucleotide
  Target: DMPK; (+) strand; PAM type: NRG; PAM sequence: GAG
gggcggcgccagactgcggt

SEQ ID NO: 12109 - DNA, 20 bp, Artificial Sequence
  Description of Artificial Sequence: Synthetic oligonucleotide
  Target: DMPK; (+) strand; PAM type: NRG; PAM sequence: TGG
ggcgccagactgcggtgagt

SEQ ID NO: 12110 - DNA, 20 bp, Artificial Sequence
  Description of Artificial Sequence: Synthetic oligonucleotide
  Target: DMPK; (+) strand; PAM type: NRG; PAM sequence: CGG
ccagactgcggtgagttggc

SEQ ID NO: 12111 - DNA, 20 bp, Artificial Sequence
  Description of Artificial Sequence: Synthetic oligonucleotide
  Target: DMPK; (+) strand; PAM type: NRG; PAM sequence: TGG
ctgcggtgagttggccggcg

SEQ ID NO: 12112 - DNA, 20 bp, Artificial Sequence
  Description of Artificial Sequence: Synthetic oligonucleotide
  Target: DMPK; (+) strand; PAM type: NRG; PAM sequence: GGG
tgcggtgagttggccggcgt

SEQ ID NO: 12113 - DNA, 20 bp, Artificial Sequence
  Description of Artificial Sequence: Synthetic oligonucleotide
  Target: DMPK; (+) strand; PAM type: NRG; PAM sequence: CAG
cgtgggccaccaacccaatg

SEQ ID NO: 12114 - DNA, 20 bp, Artificial Sequence
  Description of Artificial Sequence: Synthetic oligonucleotide
  Target: DMPK; (+) strand; PAM type: NRG; PAM sequence: CAG
gccaccaacccaatgcagcc

SEQ ID NO: 12115 - DNA, 20 bp, Artificial Sequence
  Description of Artificial Sequence: Synthetic oligonucleotide
  Target: DMPK; (+) strand; PAM type: NRG; PAM sequence: AGG
ccaccaacccaatgcagccc

SEQ ID NO: 12116 - DNA, 20 bp, Artificial Sequence
  Description of Artificial Sequence: Synthetic oligonucleotide
  Target: DMPK; (+) strand; PAM type: NRG; PAM sequence: GGG
caccaacccaatgcagccca

SEQ ID NO: 12117 - DNA, 20 bp, Artificial Sequence
  Description of Artificial Sequence: Synthetic oligonucleotide
  Target: DMPK; (+) strand; PAM type: NRG; PAM sequence: CGG
caacccaatgcagcccaggg

SEQ ID NO: 12118 - DNA, 20 bp, Artificial Sequence
  Description of Artificial Sequence: Synthetic oligonucleotide
  Target: DMPK; (+) strand; PAM type: NRG; PAM sequence: CGG
cccaatgcagcccagggcgg

SEQ ID NO: 12119 - DNA, 20 bp, Artificial Sequence
  Description of Artificial Sequence: Synthetic oligonucleotide
  Target: DMPK; (+) strand; PAM type: NRG; PAM sequence: GAG
gcagcccagggcggcggcac

SEQ ID NO: 12120 - DNA, 20 bp, Artificial Sequence
  Description of Artificial Sequence: Synthetic oligonucleotide
  Target: DMPK; (+) strand; PAM type: NRG; PAM sequence: CAG
cccagggcggcggcacgaga

SEQ ID NO: 12121 - DNA, 20 bp, Artificial Sequence
  Description of Artificial Sequence: Synthetic oligonucleotide
  Target: DMPK; (+) strand; PAM type: NRG; PAM sequence: CGG
ggcggcacgagacagaacaa

SEQ ID NO: 12122 - DNA, 20 bp, Artificial Sequence
  Description of Artificial Sequence: Synthetic oligonucleotide
  Target: DMPK; (+) strand; PAM type: NRG; PAM sequence: CAG
cgagacagaacaacggcgaa

SEQ ID NO: 12123 - DNA, 20 bp, Artificial Sequence
  Description of Artificial Sequence: Synthetic oligonucleotide
  Target: DMPK; (+) strand; PAM type: NRG; PAM sequence: AGG
gagacagaacaacggcgaac

SEQ ID NO: 12124 - DNA, 20 bp, Artificial Sequence
  Description of Artificial Sequence: Synthetic oligonucleotide
  Target: DMPK; (+) strand; PAM type: NRG; PAM sequence: GAG
gacagaacaacggcgaacag

SEQ ID NO: 12125 - DNA, 20 bp, Artificial Sequence
  Description of Artificial Sequence: Synthetic oligonucleotide
  Target: DMPK; (+) strand; PAM type: NRG; PAM sequence: CAG
agaacaacggcgaacaggag

SEQ ID NO: 12126 - DNA, 20 bp, Artificial Sequence
  Description of Artificial Sequence: Synthetic oligonucleotide
  Target: DMPK; (+) strand; PAM type: NRG; PAM sequence: AGG
gaacaacggcgaacaggagc

SEQ ID NO: 12127 - DNA, 20 bp, Artificial Sequence
  Description of Artificial Sequence: Synthetic oligonucleotide
  Target: DMPK; (+) strand; PAM type: NRG; PAM sequence: GGG
aacaacggcgaacaggagca

SEQ ID NO: 12128 - DNA, 20 bp, Artificial Sequence
  Description of Artificial Sequence: Synthetic oligonucleotide
  Target: DMPK; (+) strand; PAM type: NRG; PAM sequence: AAG
acggcgaacaggagcaggga

SEQ ID NO: 12129 - DNA, 20 bp, Artificial Sequence
  Description of Artificial Sequence: Synthetic oligonucleotide
  Target: DMPK; (+) strand; PAM type: NRG; PAM sequence: TAG
agcagggaaagcgcctccga

SEQ ID NO: 12130 - DNA, 20 bp, Artificial Sequence
  Description of Artificial Sequence: Synthetic oligonucleotide
  Target: DMPK; (+) strand; PAM type: NRG; PAM sequence: AGG
gcagggaaagcgcctccgat

SEQ ID NO: 12131 - DNA, 20 bp, Artificial Sequence
  Description of Artificial Sequence: Synthetic oligonucleotide
  Target: DMPK; (+) strand; PAM type: NRG; PAM sequence: CAG
ggaaagcgcctccgataggc

SEQ ID NO: 12132 - DNA, 20 bp, Artificial Sequence
  Description of Artificial Sequence: Synthetic oligonucleotide
  Target: DMPK; (+) strand; PAM type: NRG; PAM sequence: AGG
gaaagcgcctccgataggcc

SEQ ID NO: 12133 - DNA, 20 bp, Artificial Sequence
  Description of Artificial Sequence: Synthetic oligonucleotide
  Target: DMPK; (+) strand; PAM type: NRG; PAM sequence: TAG
cgcctccgataggccaggcc

SEQ ID NO: 12134 - DNA, 20 bp, Artificial Sequence
  Description of Artificial Sequence: Synthetic oligonucleotide
  Target: DMPK; (+) strand; PAM type: NRG; PAM sequence: AGG
gcctccgataggccaggcct

SEQ ID NO: 12135 - DNA, 20 bp, Artificial Sequence
  Description of Artificial Sequence: Synthetic oligonucleotide
  Target: DMPK; (+) strand; PAM type: NRG; PAM sequence: GGG
cctccgataggccaggccta

SEQ ID NO: 12136 - DNA, 20 bp, Artificial Sequence
  Description of Artificial Sequence: Synthetic oligonucleotide
  Target: DMPK; (+) strand; PAM type: NRG; PAM sequence: CGG
aggccaggcctagggacctg

SEQ ID NO: 12137 - DNA, 20 bp, Artificial Sequence
  Description of Artificial Sequence: Synthetic oligonucleotide
  Target: DMPK; (+) strand; PAM type: NRG; PAM sequence: GGG
ggccaggcctagggacctgc

SEQ ID NO: 12138 - DNA, 20 bp, Artificial Sequence
  Description of Artificial Sequence: Synthetic oligonucleotide
  Target: DMPK; (+) strand; PAM type: NRG; PAM sequence: GGG
gccaggcctagggacctgcg

SEQ ID NO: 12139 - DNA, 20 bp, Artificial Sequence
  Description of Artificial Sequence: Synthetic oligonucleotide
  Target: DMPK; (+) strand; PAM type: NRG; PAM sequence: GAG
caggcctagggacctgcggg

SEQ ID NO: 12140 - DNA, 20 bp, Artificial Sequence
  Description of Artificial Sequence: Synthetic oligonucleotide
  Target: DMPK; (+) strand; PAM type: NRG; PAM sequence: GAG
ggcctagggacctgcgggga

SEQ ID NO: 12141 - DNA, 20 bp, Artificial Sequence
  Description of Artificial Sequence: Synthetic oligonucleotide
  Target: DMPK; (+) strand; PAM type: NRG; PAM sequence: AGG
gcctagggacctgcggggag

SEQ ID NO: 12142 - DNA, 20 bp, Artificial Sequence
  Description of Artificial Sequence: Synthetic oligonucleotide
  Target: DMPK; (+) strand; PAM type: NRG; PAM sequence: GGG
cctagggacctgcggggaga

SEQ ID NO: 12143 - DNA, 20 bp, Artificial Sequence
  Description of Artificial Sequence: Synthetic oligonucleotide
  Target: DMPK; (+) strand; PAM type: NRG; PAM sequence: GAG
gggacctgcggggagagggc

SEQ ID NO: 12144 - DNA, 20 bp, Artificial Sequence
  Description of Artificial Sequence: Synthetic oligonucleotide
  Target: DMPK; (+) strand; PAM type: NRG; PAM sequence: AGG
ggacctgcggggagagggcg

SEQ ID NO: 12145 - DNA, 20 bp, Artificial Sequence
  Description of Artificial Sequence: Synthetic oligonucleotide
  Target: DMPK; (+) strand; PAM type: NRG; PAM sequence: CGG
gagagggcgaggtcaacacc

SEQ ID NO: 12146 - DNA, 20 bp, Artificial Sequence
  Description of Artificial Sequence: Synthetic oligonucleotide
  Target: DMPK; (+) strand; PAM type: NRG; PAM sequence: TGG
ggcgaggtcaacacccggca

SEQ ID NO: 12147 - DNA, 20 bp, Artificial Sequence
  Description of Artificial Sequence: Synthetic oligonucleotide
  Target: DMPK; (+) strand; PAM type: NRG; PAM sequence: GGG
gcgaggtcaacacccggcat

SEQ ID NO: 12148 - DNA, 20 bp, Artificial Sequence
  Description of Artificial Sequence: Synthetic oligonucleotide
  Target: DMPK; (+) strand; PAM type: NRG; PAM sequence: TGG
acccggcatgggcctctgat

SEQ ID NO: 12149 - DNA, 20 bp, Artificial Sequence
  Description of Artificial Sequence: Synthetic oligonucleotide
  Target: DMPK; (+) strand; PAM type: NRG; PAM sequence: TGG
atgggcctctgattggctcc

SEQ ID NO: 12150 - DNA, 20 bp, Artificial Sequence
  Description of Artificial Sequence: Synthetic oligonucleotide
  Target: DMPK; (+) strand; PAM type: NRG; PAM sequence: GGG
tgggcctctgattggctcct

SEQ ID NO: 12151 - DNA, 20 bp, Artificial Sequence
  Description of Artificial Sequence: Synthetic oligonucleotide
  Target: DMPK; (+) strand; PAM type: NRG; PAM sequence: TAG
actcgccccgcctacgccca

SEQ ID NO: 12152 - DNA, 20 bp, Artificial Sequence
  Description of Artificial Sequence: Synthetic oligonucleotide
  Target: DMPK; (+) strand; PAM type: NRG; PAM sequence: AGG
ctcgccccgcctacgcccat

SEQ ID NO: 12153 - DNA, 20 bp, Artificial Sequence
  Description of Artificial Sequence: Synthetic oligonucleotide
  Target: DMPK; (+) strand; PAM type: NRG; PAM sequence: TGG
gccccgcctacgcccatagg

SEQ ID NO: 12154 - DNA, 20 bp, Artificial Sequence
  Description of Artificial Sequence: Synthetic oligonucleotide
  Target: DMPK; (+) strand; PAM type: NRG; PAM sequence: GGG
ccccgcctacgcccataggt

SEQ ID NO: 12155 - DNA, 20 bp, Artificial Sequence
  Description of Artificial Sequence: Synthetic oligonucleotide
  Target: DMPK; (+) strand; PAM type: NRG; PAM sequence: CAG
gcgccccgcccccgccccaa

SEQ ID NO: 12156 - DNA, 20 bp, Artificial Sequence
  Description of Artificial Sequence: Synthetic oligonucleotide
  Target: DMPK; (+) strand; PAM type: NRG; PAM sequence: CAG
gcccccgccccaacagccta

SEQ ID NO: 12157 - DNA, 20 bp, Artificial Sequence
  Description of Artificial Sequence: Synthetic oligonucleotide
  Target: DMPK; (+) strand; PAM type: NRG; PAM sequence: TAG
caacagcctacagctgttgt

SEQ ID NO: 12158 - DNA, 20 bp, Artificial Sequence
  Description of Artificial Sequence: Synthetic oligonucleotide
  Target: DMPK; (+) strand; PAM type: NRG; PAM sequence: TGG
atcccgtccgaactcgtcat

SEQ ID NO: 12159 - DNA, 20 bp, Artificial Sequence
  Description of Artificial Sequence: Synthetic oligonucleotide
  Target: DMPK; (+) strand; PAM type: NRG; PAM sequence: TAG
actcgtcattggctgcttcc

SEQ ID NO: 12160 - DNA, 20 bp, Artificial Sequence
  Description of Artificial Sequence: Synthetic oligonucleotide
  Target: DMPK; (+) strand; PAM type: NRG; PAM sequence: CGG
cgtcattggctgcttcctag

SEQ ID NO: 12161 - DNA, 20 bp, Artificial Sequence
  Description of Artificial Sequence: Synthetic oligonucleotide
  Target: DMPK; (+) strand; PAM type: NRG; PAM sequence: TGG
tcctagcggcctgtgttgat

SEQ ID NO: 12162 - DNA, 20 bp, Artificial Sequence
  Description of Artificial Sequence: Synthetic oligonucleotide
  Target: DMPK; (+) strand; PAM type: NRG; PAM sequence: AAG
ctgtgttgattggctgcccg

SEQ ID NO: 12163 - DNA, 20 bp, Artificial Sequence
  Description of Artificial Sequence: Synthetic oligonucleotide
  Target: DMPK; (+) strand; PAM type: NRG; PAM sequence: TGG
gaagatccgccctcctgccg

SEQ ID NO: 12164 - DNA, 20 bp, Artificial Sequence
  Description of Artificial Sequence: Synthetic oligonucleotide
  Target: DMPK; (+) strand; PAM type: NRG; PAM sequence: GGG
aagatccgccctcctgccgt

SEQ ID NO: 12165 - DNA, 20 bp, Artificial Sequence
  Description of Artificial Sequence: Synthetic oligonucleotide
  Target: DMPK; (+) strand; PAM type: NRG; PAM sequence: CAG
ccgccctcctgccgtgggcc

SEQ ID NO: 12166 - DNA, 20 bp, Artificial Sequence
  Description of Artificial Sequence: Synthetic oligonucleotide
  Target: DMPK; (+) strand; PAM type: NRG; PAM sequence: CAG
ggcccagccccgcaaatgcg

SEQ ID NO: 12167 - DNA, 20 bp, Artificial Sequence
  Description of Artificial Sequence: Synthetic oligonucleotide
  Target: DMPK; (+) strand; PAM type: NRG; PAM sequence: AAG
agccccgcaaatgcgcagct

SEQ ID NO: 12168 - DNA, 20 bp, Artificial Sequence
  Description of Artificial Sequence: Synthetic oligonucleotide
  Target: DMPK; (+) strand; PAM type: NRG; PAM sequence: CGG
cccgcaaatgcgcagctaag

SEQ ID NO: 12169 - DNA, 20 bp, Artificial Sequence
  Description of Artificial Sequence: Synthetic oligonucleotide
  Target: DMPK; (+) strand; PAM type: NRG; PAM sequence: GGG
ccgcaaatgcgcagctaagc

SEQ ID NO: 12170 - DNA, 20 bp, Artificial Sequence
  Description of Artificial Sequence: Synthetic oligonucleotide
  Target: DMPK; (+) strand; PAM type: NRG; PAM sequence: TGG
caaatgcgcagctaagcggg

SEQ ID NO: 12171 - DNA, 20 bp, Artificial Sequence
  Description of Artificial Sequence: Synthetic oligonucleotide
  Target: DMPK; (+) strand; PAM type: NRG; PAM sequence: AAG
tgcgcagctaagcgggtggc

SEQ ID NO: 12172 - DNA, 20 bp, Artificial Sequence
  Description of Artificial Sequence: Synthetic oligonucleotide
  Target: DMPK; (+) strand; PAM type: NRG; PAM sequence: AGG
gcgcagctaagcgggtggca

SEQ ID NO: 12173 - DNA, 20 bp, Artificial Sequence
  Description of Artificial Sequence: Synthetic oligonucleotide
  Target: DMPK; (+) strand; PAM type: NRG; PAM sequence: GGG
cgcagctaagcgggtggcaa

SEQ ID NO: 12174 - DNA, 20 bp, Artificial Sequence
  Description of Artificial Sequence: Synthetic oligonucleotide
  Target: DMPK; (+) strand; PAM type: NRG; PAM sequence: GGG
gcagctaagcgggtggcaag

SEQ ID NO: 12175 - DNA, 20 bp, Artificial Sequence
  Description of Artificial Sequence: Synthetic oligonucleotide
  Target: DMPK; (+) strand; PAM type: NRG; PAM sequence: CGG
gctaagcgggtggcaagggg

SEQ ID NO: 12176 - DNA, 20 bp, Artificial Sequence
  Description of Artificial Sequence: Synthetic oligonucleotide
  Target: DMPK; (+) strand; PAM type: NRG; PAM sequence: GGG
ctaagcgggtggcaaggggc

SEQ ID NO: 12177 - DNA, 20 bp, Artificial Sequence
  Description of Artificial Sequence: Synthetic oligonucleotide
  Target: DMPK; (+) strand; PAM type: NRG; PAM sequence: TGG
agcgggtggcaaggggcggg

SEQ ID NO: 12178 - DNA, 20 bp, Artificial Sequence
  Description of Artificial Sequence: Synthetic oligonucleotide
  Target: DMPK; (+) strand; PAM type: NRG; PAM sequence: GAG
cgggtggcaaggggcgggtg

SEQ ID NO: 12179 - DNA, 20 bp, Artificial Sequence
  Description of Artificial Sequence: Synthetic oligonucleotide
  Target: DMPK; (+) strand; PAM type: NRG; PAM sequence: CGG
ggcaaggggcgggtggagcg

SEQ ID NO: 12180 - DNA, 20 bp, Artificial Sequence
  Description of Artificial Sequence: Synthetic oligonucleotide
  Target: DMPK; (+) strand; PAM type: NRG; PAM sequence: GGG
gcaaggggcgggtggagcgc

SEQ ID NO: 12181 - DNA, 20 bp, Artificial Sequence
  Description of Artificial Sequence: Synthetic oligonucleotide
  Target: DMPK; (+) strand; PAM type: NRG; PAM sequence: GGG
caaggggcgggtggagcgcg

SEQ ID NO: 12182 - DNA, 20 bp, Artificial Sequence
  Description of Artificial Sequence: Synthetic oligonucleotide
  Target: DMPK; (+) strand; PAM type: NRG; PAM sequence: CGG
gggtggagcgcggggcgcga

SEQ ID NO: 12183 - DNA, 20 bp, Artificial Sequence
  Description of Artificial Sequence: Synthetic oligonucleotide
  Target: DMPK; (+) strand; PAM type: NRG; PAM sequence: CGG
tggagcgcggggcgcgacgg

SEQ ID NO: 12184 - DNA, 20 bp, Artificial Sequence
  Description of Artificial Sequence: Synthetic oligonucleotide
  Target: DMPK; (+) strand; PAM type: NRG; PAM sequence: GAG
gagcgcggggcgcgacggcg

SEQ ID NO: 12185 - DNA, 20 bp, Artificial Sequence
  Description of Artificial Sequence: Synthetic oligonucleotide
  Target: DMPK; (+) strand; PAM type: NRG; PAM sequence: AGG
agcgcggggcgcgacggcgg

SEQ ID NO: 12186 - DNA, 20 bp, Artificial Sequence
  Description of Artificial Sequence: Synthetic oligonucleotide
  Target: DMPK; (+) strand; PAM type: NRG; PAM sequence: GGG
gcgcggggcgcgacggcgga

SEQ ID NO: 12187 - DNA, 20 bp, Artificial Sequence
  Description of Artificial Sequence: Synthetic oligonucleotide
  Target: DMPK; (+) strand; PAM type: NRG; PAM sequence: GGG
cgcggggcgcgacggcggag

SEQ ID NO: 12188 - DNA, 20 bp, Artificial Sequence
  Description of Artificial Sequence: Synthetic oligonucleotide
  Target: DMPK; (+) strand; PAM type: NRG; PAM sequence: GGG
gcggggcgcgacggcggagg

SEQ ID NO: 12189 - DNA, 20 bp, Artificial Sequence
  Description of Artificial Sequence: Synthetic oligonucleotide
  Target: DMPK; (+) strand; PAM type: NRG; PAM sequence: GGG
cggggcgcgacggcggaggg

SEQ ID NO: 12190 - DNA, 20 bp, Artificial Sequence
  Description of Artificial Sequence: Synthetic oligonucleotide
  Target: DMPK; (+) strand; PAM type: NRG; PAM sequence: TGG
cgcgacggcggaggggggcg

SEQ ID NO: 12191 - DNA, 20 bp, Artificial Sequence
  Description of Artificial Sequence: Synthetic oligonucleotide
  Target: DMPK; (+) strand; PAM type: NRG; PAM sequence: GGG
gcgacggcggaggggggcgt

SEQ ID NO: 12192 - DNA, 20 bp, Artificial Sequence
  Description of Artificial Sequence: Synthetic oligonucleotide
  Target: DMPK; (+) strand; PAM type: NRG; PAM sequence: CAG
acggcggaggggggcgtggg

SEQ ID NO: 12193 - DNA, 20 bp, Artificial Sequence
  Description of Artificial Sequence: Synthetic oligonucleotide
  Target: DMPK; (+) strand; PAM type: NRG; PAM sequence: CGG
cggaggggggcgtgggcagc

SEQ ID NO: 12194 - DNA, 20 bp, Artificial Sequence
  Description of Artificial Sequence: Synthetic oligonucleotide
  Target: DMPK; (+) strand; PAM type: NRG; PAM sequence: TGG
gtgggcagccggacgtaccc

SEQ ID NO: 12195 - DNA, 20 bp, Artificial Sequence
  Description of Artificial Sequence: Synthetic oligonucleotide
  Target: DMPK; (+) strand; PAM type: NRG; PAM sequence: CAG
ggcagccggacgtaccctgg

SEQ ID NO: 12196 - DNA, 20 bp, Artificial Sequence
  Description of Artificial Sequence: Synthetic oligonucleotide
  Target: DMPK; (+) strand; PAM type: NRG; PAM sequence: AGG
gcagccggacgtaccctggc

SEQ ID NO: 12197 - DNA, 20 bp, Artificial Sequence
  Description of Artificial Sequence: Synthetic oligonucleotide
  Target: DMPK; (+) strand; PAM type: NRG; PAM sequence: GGG
cagccggacgtaccctggca

SEQ ID NO: 12198 - DNA, 20 bp, Artificial Sequence
  Description of Artificial Sequence: Synthetic oligonucleotide
  Target: DMPK; (+) strand; PAM type: NRG; PAM sequence: GAG
gccggacgtaccctggcagg

SEQ ID NO: 12199 - DNA, 20 bp, Artificial Sequence
  Description of Artificial Sequence: Synthetic oligonucleotide
  Target: DMPK; (+) strand; PAM type: NRG; PAM sequence: CAG
ggacgtaccctggcagggag

SEQ ID NO: 12200 - DNA, 20 bp, Artificial Sequence
  Description of Artificial Sequence: Synthetic oligonucleotide
  Target: DMPK; (+) strand; PAM type: NRG; PAM sequence: CAG
cgtaccctggcagggagcag

SEQ ID NO: 12201 - DNA, 20 bp, Artificial Sequence
  Description of Artificial Sequence: Synthetic oligonucleotide
  Target: DMPK; (+) strand; PAM type: NRG; PAM sequence: AGG
gtaccctggcagggagcagc

SEQ ID NO: 12202 - DNA, 20 bp, Artificial Sequence
  Description of Artificial Sequence: Synthetic oligonucleotide
  Target: DMPK; (+) strand; PAM type: NRG; PAM sequence: TGG
ccctggcagggagcagcagg

SEQ ID NO: 12203 - DNA, 20 bp, Artificial Sequence
  Description of Artificial Sequence: Synthetic oligonucleotide
  Target: DMPK; (+) strand; PAM type: NRG; PAM sequence: CGG
tggcagggagcagcaggtgg

SEQ ID NO: 12204 - DNA, 20 bp, Artificial Sequence
  Description of Artificial Sequence: Synthetic oligonucleotide
  Target: DMPK; (+) strand; PAM type: NRG; PAM sequence: CGG
cagggagcagcaggtggcgg

SEQ ID NO: 12205 - DNA, 20 bp, Artificial Sequence
  Description of Artificial Sequence: Synthetic oligonucleotide
  Target: DMPK; (+) strand; PAM type: NRG; PAM sequence: TGG
cagcaggtggcggcggtgca

SEQ ID NO: 12206 - DNA, 20 bp, Artificial Sequence
  Description of Artificial Sequence: Synthetic oligonucleotide
  Target: DMPK; (+) strand; PAM type: NRG; PAM sequence: GGG
agcaggtggcggcggtgcat

SEQ ID NO: 12207 - DNA, 20 bp, Artificial Sequence
  Description of Artificial Sequence: Synthetic oligonucleotide
  Target: DMPK; (+) strand; PAM type: NRG; PAM sequence: GGG
gcaggtggcggcggtgcatg

SEQ ID NO: 12208 - DNA, 20 bp, Artificial Sequence
  Description of Artificial Sequence: Synthetic oligonucleotide
  Target: DMPK; (+) strand; PAM type: NRG; PAM sequence: TGG
tggcggcggtgcatggggcc

SEQ ID NO: 12209 - DNA, 20 bp, Artificial Sequence
  Description of Artificial Sequence: Synthetic oligonucleotide
  Target: DMPK; (+) strand; PAM type: NRG; PAM sequence: CAG
tgcatggggcctggccccac

SEQ ID NO: 12210 - DNA, 20 bp, Artificial Sequence
  Description of Artificial Sequence: Synthetic oligonucleotide
  Target: DMPK; (+) strand; PAM type: NRG; PAM sequence: CGG
atggggcctggccccaccag

SEQ ID NO: 12211 - DNA, 20 bp, Artificial Sequence
  Description of Artificial Sequence: Synthetic oligonucleotide
  Target: DMPK; (+) strand; PAM type: NRG; PAM sequence: GGG
tggggcctggccccaccagc

SEQ ID NO: 12212 - DNA, 20 bp, Artificial Sequence
  Description of Artificial Sequence: Synthetic oligonucleotide
  Target: DMPK; (+) strand; PAM type: NRG; PAM sequence: TGG
ctggccccaccagcgggcac

SEQ ID NO: 12213 - DNA, 20 bp, Artificial Sequence
  Description of Artificial Sequence: Synthetic oligonucleotide
  Target: DMPK; (+) strand; PAM type: NRG; PAM sequence: CAG
caccagcgggcactggccca

SEQ ID NO: 12214 - DNA, 20 bp, Artificial Sequence
  Description of Artificial Sequence: Synthetic oligonucleotide
  Target: DMPK; (+) strand; PAM type: NRG; PAM sequence: CGG
cgggcactggcccacagcca

SEQ ID NO: 12215 - DNA, 20 bp, Artificial Sequence
  Description of Artificial Sequence: Synthetic oligonucleotide
  Target: DMPK; (+) strand; PAM type: NRG; PAM sequence: CGG
cactggcccacagccacggc

SEQ ID NO: 12216 - DNA, 20 bp, Artificial Sequence
  Description of Artificial Sequence: Synthetic oligonucleotide
  Target: DMPK; (+) strand; PAM type: NRG; PAM sequence: GGG
actggcccacagccacggcc

SEQ ID NO: 12217 - DNA, 20 bp, Artificial Sequence
  Description of Artificial Sequence: Synthetic oligonucleotide
  Target: DMPK; (+) strand; PAM type: NRG; PAM sequence: GGG
ctggcccacagccacggccg

SEQ ID NO: 12218 - DNA, 20 bp, Artificial Sequence
  Description of Artificial Sequence: Synthetic oligonucleotide
  Target: DMPK; (+) strand; PAM type: NRG; PAM sequence: GGG
tggcccacagccacggccgg

SEQ ID NO: 12219 - DNA, 20 bp, Artificial Sequence
  Description of Artificial Sequence: Synthetic oligonucleotide
  Target: DMPK; (+) strand; PAM type: NRG; PAM sequence: GGG
ggcccacagccacggccggg

SEQ ID NO: 12220 - DNA, 20 bp, Artificial Sequence
  Description of Artificial Sequence: Synthetic oligonucleotide
  Target: DMPK; (+) strand; PAM type: NRG; PAM sequence: TAG
gccacggccggggggccatc

SEQ ID NO: 12221 - DNA, 20 bp, Artificial Sequence
  Description of Artificial Sequence: Synthetic oligonucleotide
  Target: DMPK; (+) strand; PAM type: NRG; PAM sequence: TGG
cggccggggggccatctagc

SEQ ID NO: 12222 - DNA, 20 bp, Artificial Sequence
  Description of Artificial Sequence: Synthetic oligonucleotide
  Target: DMPK; (+) strand; PAM type: NRG; PAM sequence: GAG
gccggggggccatctagctg

SEQ ID NO: 12223 - DNA, 20 bp, Artificial Sequence
  Description of Artificial Sequence: Synthetic oligonucleotide
  Target: DMPK; (+) strand; PAM type: NRG; PAM sequence: GAG
cggggggccatctagctgga

SEQ ID NO: 12224 - DNA, 20 bp, Artificial Sequence
  Description of Artificial Sequence: Synthetic oligonucleotide
  Target: DMPK; (+) strand; PAM type: NRG; PAM sequence: GAG
gggggccatctagctggaga

SEQ ID NO: 12225 - DNA, 20 bp, Artificial Sequence
  Description of Artificial Sequence: Synthetic oligonucleotide
  Target: DMPK; (+) strand; PAM type: NRG; PAM sequence: AAG
ggccatctagctggagagag

SEQ ID NO: 12226 - DNA, 20 bp, Artificial Sequence
  Description of Artificial Sequence: Synthetic oligonucleotide
  Target: DMPK; (+) strand; PAM type: NRG; PAM sequence: AGG
gccatctagctggagagaga

SEQ ID NO: 12227 - DNA, 20 bp, Artificial Sequence
  Description of Artificial Sequence: Synthetic oligonucleotide
  Target: DMPK; (+) strand; PAM type: NRG; PAM sequence: GGG
ccatctagctggagagagaa

SEQ ID NO: 12228 - DNA, 20 bp, Artificial Sequence
  Description of Artificial Sequence: Synthetic oligonucleotide
  Target: DMPK; (+) strand; PAM type: NRG; PAM sequence: CAG
ctagctggagagagaaggga

SEQ ID NO: 12229 - DNA, 20 bp, Artificial Sequence
  Description of Artificial Sequence: Synthetic oligonucleotide
  Target: DMPK; (+) strand; PAM type: NRG; PAM sequence: AGG
tagctggagagagaagggac

SEQ ID NO: 12230 - DNA, 20 bp, Artificial Sequence
  Description of Artificial Sequence: Synthetic oligonucleotide
  Target: DMPK; (+) strand; PAM type: NRG; PAM sequence: CGG
gaagggacaggtgacccgat

SEQ ID NO: 12231 - DNA, 20 bp, Artificial Sequence
  Description of Artificial Sequence: Synthetic oligonucleotide
  Target: DMPK; (+) strand; PAM type: NRG; PAM sequence: GAG
agggacaggtgacccgatcg

SEQ ID NO: 12232 - DNA, 20 bp, Artificial Sequence
  Description of Artificial Sequence: Synthetic oligonucleotide
  Target: DMPK; (+) strand; PAM type: NRG; PAM sequence: CAG
caggtgacccgatcggagcc

SEQ ID NO: 12233 - DNA, 20 bp, Artificial Sequence
  Description of Artificial Sequence: Synthetic oligonucleotide
  Target: DMPK; (+) strand; PAM type: NRG; PAM sequence: CAG
gacccgatcggagcccagcc

SEQ ID NO: 12234 - DNA, 20 bp, Artificial Sequence
  Description of Artificial Sequence: Synthetic oligonucleotide
  Target: DMPK; (+) strand; PAM type: NRG; PAM sequence: CAG
tcggagcccagcccagccct

SEQ ID NO: 12235 - DNA, 20 bp, Artificial Sequence
  Description of Artificial Sequence: Synthetic oligonucleotide
  Target: DMPK; (+) strand; PAM type: NRG; PAM sequence: CGG
gagcccagcccagccctcag

SEQ ID NO: 12236 - DNA, 20 bp, Artificial Sequence
  Description of Artificial Sequence: Synthetic oligonucleotide
  Target: DMPK; (+) strand; PAM type: NRG; PAM sequence: TGG
cccagcccagccctcagcgg

SEQ ID NO: 12237 - DNA, 20 bp, Artificial Sequence
  Description of Artificial Sequence: Synthetic oligonucleotide
  Target: DMPK; (+) strand; PAM type: NRG; PAM sequence: GGG
ccagcccagccctcagcggt

SEQ ID NO: 12238 - DNA, 20 bp, Artificial Sequence
  Description of Artificial Sequence: Synthetic oligonucleotide
  Target: DMPK; (+) strand; PAM type: NRG; PAM sequence: GGG
cagcccagccctcagcggtg

SEQ ID NO: 12239 - DNA, 20 bp, Artificial Sequence
  Description of Artificial Sequence: Synthetic oligonucleotide
  Target: DMPK; (+) strand; PAM type: NRG; PAM sequence: GAG
ccagccctcagcggtggggc

SEQ ID NO: 12240 - DNA, 20 bp, Artificial Sequence
  Description of Artificial Sequence: Synthetic oligonucleotide
  Target: DMPK; (+) strand; PAM type: NRG; PAM sequence: GAG
agccctcagcggtggggcga

SEQ ID NO: 12241 - DNA, 20 bp, Artificial Sequence
  Description of Artificial Sequence: Synthetic oligonucleotide
  Target: DMPK; (+) strand; PAM type: NRG; PAM sequence: CAG
ctcagcggtggggcgagaga

SEQ ID NO: 12242 - DNA, 20 bp, Artificial Sequence
  Description of Artificial Sequence: Synthetic oligonucleotide
  Target: DMPK; (+) strand; PAM type: NRG; PAM sequence: GAG
gcggtggggcgagagacagc

SEQ ID NO: 12243 - DNA, 20 bp, Artificial Sequence
  Description of Artificial Sequence: Synthetic oligonucleotide
  Target: DMPK; (+) strand; PAM type: NRG; PAM sequence: AGG
cggtggggcgagagacagcg

SEQ ID NO: 12244 - DNA, 20 bp, Artificial Sequence
  Description of Artificial Sequence: Synthetic oligonucleotide
  Target: DMPK; (+) strand; PAM type: NRG; PAM sequence: GGG
ggtggggcgagagacagcga

SEQ ID NO: 12245 - DNA, 20 bp, Artificial Sequence
  Description of Artificial Sequence: Synthetic oligonucleotide
  Target: DMPK; (+) strand; PAM type: NRG; PAM sequence: GGG
gtggggcgagagacagcgag

SEQ ID NO: 12246 - DNA, 20 bp, Artificial Sequence
  Description of Artificial Sequence: Synthetic oligonucleotide
  Target: DMPK; (+) strand; PAM type: NRG; PAM sequence: GAG
gagagacagcgaggggaatc

SEQ ID NO: 12247 - DNA, 20 bp, Artificial Sequence
  Description of Artificial Sequence: Synthetic oligonucleotide
  Target: DMPK; (+) strand; PAM type: NRG; PAM sequence: AGG
agagacagcgaggggaatcg

SEQ ID NO: 12248 - DNA, 20 bp, Artificial Sequence
  Description of Artificial Sequence: Synthetic oligonucleotide
  Target: DMPK; (+) strand; PAM type: NRG; PAM sequence: TGG
acagcgaggggaatcgaggt

SEQ ID NO: 12249 - DNA, 20 bp, Artificial Sequence
  Description of Artificial Sequence: Synthetic oligonucleotide
  Target: DMPK; (+) strand; PAM type: NRG; PAM sequence: GGG
cagcgaggggaatcgaggtt

SEQ ID NO: 12250 - DNA, 20 bp, Artificial Sequence
  Description of Artificial Sequence: Synthetic oligonucleotide
  Target: DMPK; (+) strand; PAM type: NRG; PAM sequence: GGG
agcgaggggaatcgaggttg

SEQ ID NO: 12251 - DNA, 20 bp, Artificial Sequence
  Description of Artificial Sequence: Synthetic oligonucleotide
  Target: DMPK; (+) strand; PAM type: NRG; PAM sequence: GAG
cgaggggaatcgaggttggg

SEQ ID NO: 12252 - DNA, 20 bp, Artificial Sequence
  Description of Artificial Sequence: Synthetic oligonucleotide
  Target: DMPK; (+) strand; PAM type: NRG; PAM sequence: AGG
gaggggaatcgaggttgggg

SEQ ID NO: 12253 - DNA, 20 bp, Artificial Sequence
  Description of Artificial Sequence: Synthetic oligonucleotide
  Target: DMPK; (+) strand; PAM type: NRG; PAM sequence: TAG
tcgaggttggggaggttatc

SEQ ID NO: 12254 - DNA, 20 bp, Artificial Sequence
  Description of Artificial Sequence: Synthetic oligonucleotide
  Target: DMPK; (+) strand; PAM type: NRG; PAM sequence: AGG
cgaggttggggaggttatct

SEQ ID NO: 12255 - DNA, 20 bp, Artificial Sequence
  Description of Artificial Sequence: Synthetic oligonucleotide
  Target: DMPK; (+) strand; PAM type: NRG; PAM sequence: GGG
gaggttggggaggttatcta

SEQ ID NO: 12256 - DNA, 20 bp, Artificial Sequence
  Description of Artificial Sequence: Synthetic oligonucleotide
  Target: DMPK; (+) strand; PAM type: NRG; PAM sequence: GAG
ggttggggaggttatctagg

SEQ ID NO: 12257 - DNA, 20 bp, Artificial Sequence
  Description of Artificial Sequence: Synthetic oligonucleotide
  Target: DMPK; (+) strand; PAM type: NRG; PAM sequence: CGG
gaggttatctagggagatcc

SEQ ID NO: 12258 - DNA, 20 bp, Artificial Sequence
  Description of Artificial Sequence: Synthetic oligonucleotide
  Target: DMPK; (+) strand; PAM type: NRG; PAM sequence: GAG
ggttatctagggagatcccg

SEQ ID NO: 12259 - DNA, 20 bp, Artificial Sequence
  Description of Artificial Sequence: Synthetic oligonucleotide
  Target: DMPK; (+) strand; PAM type: NRG; PAM sequence: AGG
gttatctagggagatcccgg

SEQ ID NO: 12260 - DNA, 20 bp, Artificial Sequence
  Description of Artificial Sequence: Synthetic oligonucleotide
  Target: DMPK; (+) strand; PAM type: NRG; PAM sequence: GGG
ttatctagggagatcccgga

SEQ ID NO: 12261 - DNA, 20 bp, Artificial Sequence
  Description of Artificial Sequence: Synthetic oligonucleotide
  Target: DMPK; (+) strand; PAM type: NRG; PAM sequence: TGG
gggagatcccggagggaatc

SEQ ID NO: 12262 - DNA, 20 bp, Artificial Sequence
  Description of Artificial Sequence: Synthetic oligonucleotide
  Target: DMPK; (+) strand; PAM type: NRG; PAM sequence: GAG
gatcccggagggaatctggt

SEQ ID NO: 12263 - DNA, 20 bp, Artificial Sequence
  Description of Artificial Sequence: Synthetic oligonucleotide
  Target: DMPK; (+) strand; PAM type: NRG; PAM sequence: AGG
atcccggagggaatctggtg

SEQ ID NO: 12264 - DNA, 20 bp, Artificial Sequence
  Description of Artificial Sequence: Synthetic oligonucleotide
  Target: DMPK; (+) strand; PAM type: NRG; PAM sequence: CGG
ggaatctggtgaggcctgaa

SEQ ID NO: 12265 - DNA, 20 bp, Artificial Sequence
  Description of Artificial Sequence: Synthetic oligonucleotide
  Target: DMPK; (+) strand; PAM type: NRG; PAM sequence: GAG
aatctggtgaggcctgaacg

SEQ ID NO: 12266 - DNA, 20 bp, Artificial Sequence
  Description of Artificial Sequence: Synthetic oligonucleotide
  Target: DMPK; (+) strand; PAM type: NRG; PAM sequence: AGG
atctggtgaggcctgaacgg

SEQ ID NO: 12267 - DNA, 20 bp, Artificial Sequence
  Description of Artificial Sequence: Synthetic oligonucleotide
  Target: DMPK; (+) strand; PAM type: NRG; PAM sequence: GGG
tctggtgaggcctgaacgga

SEQ ID NO: 12268 - DNA, 20 bp, Artificial Sequence
  Description of Artificial Sequence: Synthetic oligonucleotide
  Target: DMPK; (+) strand; PAM type: NRG; PAM sequence: GAG
tggtgaggcctgaacggagg

SEQ ID NO: 12269 - DNA, 20 bp, Artificial Sequence
  Description of Artificial Sequence: Synthetic oligonucleotide
  Target: DMPK; (+) strand; PAM type: NRG; PAM sequence: TGG
ggcctgaacggagggagatc

SEQ ID NO: 12270 - DNA, 20 bp, Artificial Sequence
  Description of Artificial Sequence: Synthetic oligonucleotide
  Target: DMPK; (+) strand; PAM type: NRG; PAM sequence: GGG
gcctgaacggagggagatct

SEQ ID NO: 12271 - DNA, 20 bp, Artificial Sequence
  Description of Artificial Sequence: Synthetic oligonucleotide
  Target: DMPK; (+) strand; PAM type: NRG; PAM sequence: GGG
cctgaacggagggagatctg

SEQ ID NO: 12272 - DNA, 20 bp, Artificial Sequence
  Description of Artificial Sequence: Synthetic oligonucleotide
  Target: DMPK; (+) strand; PAM type: NRG; PAM sequence: AAG
gggagatctggggctgaata

SEQ ID NO: 12273 - DNA, 20 bp, Artificial Sequence
  Description of Artificial Sequence: Synthetic oligonucleotide
  Target: DMPK; (+) strand; PAM type: NRG; PAM sequence: AGG
ggagatctggggctgaataa

SEQ ID NO: 12274 - DNA, 20 bp, Artificial Sequence
  Description of Artificial Sequence: Synthetic oligonucleotide
  Target: DMPK; (+) strand; PAM type: NRG; PAM sequence: GGG
gagatctggggctgaataaa

SEQ ID NO: 12275 - DNA, 20 bp, Artificial Sequence
  Description of Artificial Sequence: Synthetic oligonucleotide
  Target: DMPK; (+) strand; PAM type: NRG; PAM sequence: AAG
taaagggcttctgccctcta

SEQ ID NO: 12276 - DNA, 20 bp, Artificial Sequence
  Description of Artificial Sequence: Synthetic oligonucleotide
  Target: DMPK; (+) strand; PAM type: NRG; PAM sequence: AAG
ttctgccctctaaagtcgca

SEQ ID NO: 12277 - DNA, 20 bp, Artificial Sequence
  Description of Artificial Sequence: Synthetic oligonucleotide
  Target: DMPK; (+) strand; PAM type: NRG; PAM sequence: TAG
cctctaaagtcgcaaagacg

SEQ ID NO: 12278 - DNA, 20 bp, Artificial Sequence
  Description of Artificial Sequence: Synthetic oligonucleotide
  Target: DMPK; (+) strand; PAM type: NRG; PAM sequence: AGG
ctctaaagtcgcaaagacgt

SEQ ID NO: 12279 - DNA, 20 bp, Artificial Sequence
  Description of Artificial Sequence: Synthetic oligonucleotide
  Target: DMPK; (+) strand; PAM type: NRG; PAM sequence: GGG
tctaaagtcgcaaagacgta

SEQ ID NO: 12280 - DNA, 20 bp, Artificial Sequence
  Description of Artificial Sequence: Synthetic oligonucleotide
  Target: DMPK; (+) strand; PAM type: NRG; PAM sequence: GAG
aagtcgcaaagacgtagggt

SEQ ID NO: 12281 - DNA, 20 bp, Artificial Sequence
  Description of Artificial Sequence: Synthetic oligonucleotide
  Target: DMPK; (+) strand; PAM type: NRG; PAM sequence: TGG
cgtagggtgagccctatatc

SEQ ID NO: 12282 - DNA, 20 bp, Artificial Sequence
  Description of Artificial Sequence: Synthetic oligonucleotide
  Target: DMPK; (+) strand; PAM type: NRG; PAM sequence: CGG
gggtgagccctatatctgga

SEQ ID NO: 12283 - DNA, 20 bp, Artificial Sequence
  Description of Artificial Sequence: Synthetic oligonucleotide
  Target: DMPK; (+) strand; PAM type: NRG; PAM sequence: GGG
ggtgagccctatatctggac

SEQ ID NO: 12284 - DNA, 20 bp, Artificial Sequence
  Description of Artificial Sequence: Synthetic oligonucleotide
  Target: DMPK; (+) strand; PAM type: NRG; PAM sequence: GGG
gtgagccctatatctggacg

SEQ ID NO: 12285 - DNA, 20 bp, Artificial Sequence
  Description of Artificial Sequence: Synthetic oligonucleotide
  Target: DMPK; (+) strand; PAM type: NRG; PAM sequence: GAG
gagccctatatctggacggg

SEQ ID NO: 12286 - DNA, 20 bp, Artificial Sequence
  Description of Artificial Sequence: Synthetic oligonucleotide
  Target: DMPK; (+) strand; PAM type: NRG; PAM sequence: CAG
ctatatctggacggggagac

SEQ ID NO: 12287 - DNA, 20 bp, Artificial Sequence
  Description of Artificial Sequence: Synthetic oligonucleotide
  Target: DMPK; (+) strand; PAM type: NRG; PAM sequence: AGG
tatatctggacggggagacc

SEQ ID NO: 12288 - DNA, 20 bp, Artificial Sequence
  Description of Artificial Sequence: Synthetic oligonucleotide
  Target: DMPK; (+) strand; PAM type: NRG; PAM sequence: GAG
tatctggacggggagaccag

SEQ ID NO: 12289 - DNA, 20 bp, Artificial Sequence
  Description of Artificial Sequence: Synthetic oligonucleotide
  Target: DMPK; (+) strand; PAM type: NRG; PAM sequence: CAG
tggacggggagaccaggagc

SEQ ID NO: 12290 - DNA, 20 bp, Artificial Sequence
  Description of Artificial Sequence: Synthetic oligonucleotide
  Target: DMPK; (+) strand; PAM type: NRG; PAM sequence: AGG
ggacggggagaccaggagcc

SEQ ID NO: 12291 - DNA, 20 bp, Artificial Sequence
  Description of Artificial Sequence: Synthetic oligonucleotide
  Target: DMPK; (+) strand; PAM type: NRG; PAM sequence: GGG
gacggggagaccaggagcca

SEQ ID NO: 12292 - DNA, 20 bp, Artificial Sequence
  Description of Artificial Sequence: Synthetic oligonucleotide
  Target: DMPK; (+) strand; PAM type: NRG; PAM sequence: GAG
cggggagaccaggagccagg

SEQ ID NO: 12293 - DNA, 20 bp, Artificial Sequence
  Description of Artificial Sequence: Synthetic oligonucleotide
  Target: DMPK; (+) strand; PAM type: NRG; PAM sequence: AGG
ggggagaccaggagccaggg

SEQ ID NO: 12294 - DNA, 20 bp, Artificial Sequence
  Description of Artificial Sequence: Synthetic oligonucleotide
  Target: DMPK; (+) strand; PAM type: NRG; PAM sequence: GGG
gggagaccaggagccaggga

SEQ ID NO: 12295 - DNA, 20 bp, Artificial Sequence
  Description of Artificial Sequence: Synthetic oligonucleotide
  Target: DMPK; (+) strand; PAM type: NRG; PAM sequence: GGG
ggagaccaggagccagggag

SEQ ID NO: 12296 - DNA, 20 bp, Artificial Sequence
  Description of Artificial Sequence: Synthetic oligonucleotide
  Target: DMPK; (+) strand; PAM type: NRG; PAM sequence: CAG
ggagccagggaggggatctg

SEQ ID NO: 12297 - DNA, 20 bp, Artificial Sequence
  Description of Artificial Sequence: Synthetic oligonucleotide
  Target: DMPK; (+) strand; PAM type: NRG; PAM sequence: TGG
cagggaggggatctgcagaa

SEQ ID NO: 12298 - DNA, 20 bp, Artificial Sequence
  Description of Artificial Sequence: Synthetic oligonucleotide
  Target: DMPK; (+) strand; PAM type: NRG; PAM sequence: GGG
agggaggggatctgcagaat

SEQ ID NO: 12299 - DNA, 20 bp, Artificial Sequence
  Description of Artificial Sequence: Synthetic oligonucleotide
  Target: DMPK; (+) strand; PAM type: NRG; PAM sequence: CAG
gaggggatctgcagaatggg

SEQ ID NO: 12300 - DNA, 20 bp, Artificial Sequence
  Description of Artificial Sequence: Synthetic oligonucleotide
  Target: DMPK; (+) strand; PAM type: NRG; PAM sequence: CAG
gggatctgcagaatgggcag

SEQ ID NO: 12301 - DNA, 20 bp, Artificial Sequence
  Description of Artificial Sequence: Synthetic oligonucleotide
  Target: DMPK; (+) strand; PAM type: NRG; PAM sequence: AGG
ggatctgcagaatgggcagc

SEQ ID NO: 12302 - DNA, 20 bp, Artificial Sequence
  Description of Artificial Sequence: Synthetic oligonucleotide
  Target: DMPK; (+) strand; PAM type: NRG; PAM sequence: GAG
gcagaatgggcagcaggtct

SEQ ID NO: 12303 - DNA, 20 bp, Artificial Sequence
  Description of Artificial Sequence: Synthetic oligonucleotide
  Target: DMPK; (+) strand; PAM type: NRG; PAM sequence: AGG
cagaatgggcagcaggtctg

SEQ ID NO: 12304 - DNA, 20 bp, Artificial Sequence
  Description of Artificial Sequence: Synthetic oligonucleotide
  Target: DMPK; (+) strand; PAM type: NRG; PAM sequence: CAG
aatgggcagcaggtctgagg

SEQ ID NO: 12305 - DNA, 20 bp, Artificial Sequence
  Description of Artificial Sequence: Synthetic oligonucleotide
  Target: DMPK; (+) strand; PAM type: NRG; PAM sequence: AGG
atgggcagcaggtctgaggc

SEQ ID NO: 12306 - DNA, 20 bp, Artificial Sequence
  Description of Artificial Sequence: Synthetic oligonucleotide
  Target: DMPK; (+) strand; PAM type: NRG; PAM sequence: GGG
tgggcagcaggtctgaggca

SEQ ID NO: 12307 - DNA, 20 bp, Artificial Sequence
  Description of Artificial Sequence: Synthetic oligonucleotide
  Target: DMPK; (+) strand; PAM type: NRG; PAM sequence: GGG
gggcagcaggtctgaggcag

SEQ ID NO: 12308 - DNA, 20 bp, Artificial Sequence
  Description of Artificial Sequence: Synthetic oligonucleotide
  Target: DMPK; (+) strand; PAM type: NRG; PAM sequence: AAG
agcaggtctgaggcagggga

SEQ ID NO: 12309 - DNA, 20 bp, Artificial Sequence
  Description of Artificial Sequence: Synthetic oligonucleotide
  Target: DMPK; (+) strand; PAM type: NRG; PAM sequence: GAG
caggtctgaggcaggggaaa

SEQ ID NO: 12310 - DNA, 20 bp, Artificial Sequence
  Description of Artificial Sequence: Synthetic oligonucleotide
  Target: DMPK; (+) strand; PAM type: NRG; PAM sequence: GAG
ggtctgaggcaggggaaaga

SEQ ID NO: 12311 - DNA, 20 bp, Artificial Sequence
  Description of Artificial Sequence: Synthetic oligonucleotide
  Target: DMPK; (+) strand; PAM type: NRG; PAM sequence: AGG
gtctgaggcaggggaaagag

SEQ ID NO: 12312 - DNA, 20 bp, Artificial Sequence
  Description of Artificial Sequence: Synthetic oligonucleotide
  Target: DMPK; (+) strand; PAM type: NRG; PAM sequence: GGG
tctgaggcaggggaaagaga

SEQ ID NO: 12313 - DNA, 20 bp, Artificial Sequence
  Description of Artificial Sequence: Synthetic oligonucleotide
  Target: DMPK; (+) strand; PAM type: NRG; PAM sequence: GGG
ctgaggcaggggaaagagag

SEQ ID NO: 12314 - DNA, 20 bp, Artificial Sequence
  Description of Artificial Sequence: Synthetic oligonucleotide
  Target: DMPK; (+) strand; PAM type: NRG; PAM sequence: TGG
ggaaagagaggggtcttaca

SEQ ID NO: 12315 - DNA, 20 bp, Artificial Sequence
  Description of Artificial Sequence: Synthetic oligonucleotide
  Target: DMPK; (+) strand; PAM type: NRG; PAM sequence: GGG
gaaagagaggggtcttacat

SEQ ID NO: 12316 - DNA, 20 bp, Artificial Sequence
  Description of Artificial Sequence: Synthetic oligonucleotide
  Target: DMPK; (+) strand; PAM type: NRG; PAM sequence: AAG
agagaggggtcttacatggg

SEQ ID NO: 12317 - DNA, 20 bp, Artificial Sequence
  Description of Artificial Sequence: Synthetic oligonucleotide
  Target: DMPK; (+) strand; PAM type: NRG; PAM sequence: AGG
gagaggggtcttacatggga

SEQ ID NO: 12318 - DNA, 20 bp, Artificial Sequence
  Description of Artificial Sequence: Synthetic oligonucleotide
  Target: DMPK; (+) strand; PAM type: NRG; PAM sequence: TGG
aggggtcttacatgggaagg

SEQ ID NO: 12319 - DNA, 20 bp, Artificial Sequence
  Description of Artificial Sequence: Synthetic oligonucleotide
  Target: DMPK; (+) strand; PAM type: NRG; PAM sequence: TGG
tacatgggaaggtggatccg

SEQ ID NO: 12320 - DNA, 20 bp, Artificial Sequence
  Description of Artificial Sequence: Synthetic oligonucleotide
  Target: DMPK; (+) strand; PAM type: NRG; PAM sequence: CGG
gggaaggtggatccgtggcc

SEQ ID NO: 12321 - DNA, 20 bp, Artificial Sequence
  Description of Artificial Sequence: Synthetic oligonucleotide
  Target: DMPK; (+) strand; PAM type: NRG; PAM sequence: GGG
ggaaggtggatccgtggccc

SEQ ID NO: 12322 - DNA, 20 bp, Artificial Sequence
  Description of Artificial Sequence: Synthetic oligonucleotide
  Target: DMPK; (+) strand; PAM type: NRG; PAM sequence: GGG
gaaggtggatccgtggcccg

SEQ ID NO: 12323 - DNA, 20 bp, Artificial Sequence
  Description of Artificial Sequence: Synthetic oligonucleotide
  Target: DMPK; (+) strand; PAM type: NRG; PAM sequence: TGG
tggatccgtggcccggggac

SEQ ID NO: 12324 - DNA, 20 bp, Artificial Sequence
  Description of Artificial Sequence: Synthetic oligonucleotide
  Target: DMPK; (+) strand; PAM type: NRG; PAM sequence: GGG
ggatccgtggcccggggact

SEQ ID NO: 12325 - DNA, 20 bp, Artificial Sequence
  Description of Artificial Sequence: Synthetic oligonucleotide
  Target: DMPK; (+) strand; PAM type: NRG; PAM sequence: GGG
gatccgtggcccggggactg

SEQ ID NO: 12326 - DNA, 20 bp, Artificial Sequence
  Description of Artificial Sequence: Synthetic oligonucleotide
  Target: DMPK; (+) strand; PAM type: NRG; PAM sequence: CAG
gggactggggacccccgtga

SEQ ID NO: 12327 - DNA, 20 bp, Artificial Sequence
  Description of Artificial Sequence: Synthetic oligonucleotide
  Target: DMPK; (+) strand; PAM type: NRG; PAM sequence: TGG
ctggggacccccgtgacagc

SEQ ID NO: 12328 - DNA, 20 bp, Artificial Sequence
  Description of Artificial Sequence: Synthetic oligonucleotide
  Target: DMPK; (+) strand; PAM type: NRG; PAM sequence: AAG
gggacccccgtgacagctgg

SEQ ID NO: 12329 - DNA, 20 bp, Artificial Sequence
  Description of Artificial Sequence: Synthetic oligonucleotide
  Target: DMPK; (+) strand; PAM type: NRG; PAM sequence: AGG
ggacccccgtgacagctgga

SEQ ID NO: 12330 - DNA, 20 bp, Artificial Sequence
  Description of Artificial Sequence: Synthetic oligonucleotide
  Target: DMPK; (+) strand; PAM type: NRG; PAM sequence: GAG
acccccgtgacagctggaag

SEQ ID NO: 12331 - DNA, 20 bp, Artificial Sequence
  Description of Artificial Sequence: Synthetic oligonucleotide
  Target: DMPK; (+) strand; PAM type: NRG; PAM sequence: AAG
cccgtgacagctggaaggag

SEQ ID NO: 12332 - DNA, 20 bp, Artificial Sequence
  Description of Artificial Sequence: Synthetic oligonucleotide
  Target: DMPK; (+) strand; PAM type: NRG; PAM sequence: AAG
tgacagctggaaggagaaga

SEQ ID NO: 12333 - DNA, 20 bp, Artificial Sequence
  Description of Artificial Sequence: Synthetic oligonucleotide
  Target: DMPK; (+) strand; PAM type: NRG; PAM sequence: GAG
acagctggaaggagaagaaa

SEQ ID NO: 12334 - DNA, 20 bp, Artificial Sequence
  Description of Artificial Sequence: Synthetic oligonucleotide
  Target: DMPK; (+) strand; PAM type: NRG; PAM sequence: AGG
cagctggaaggagaagaaag

SEQ ID NO: 12335 - DNA, 20 bp, Artificial Sequence
  Description of Artificial Sequence: Synthetic oligonucleotide
  Target: DMPK; (+) strand; PAM type: NRG; PAM sequence: TAG
ggaaggagaagaaagaggca

SEQ ID NO: 12336 - DNA, 20 bp, Artificial Sequence
  Description of Artificial Sequence: Synthetic oligonucleotide
  Target: DMPK; (+) strand; PAM type: NRG; PAM sequence: AGG
gaaggagaagaaagaggcat

SEQ ID NO: 12337 - DNA, 20 bp, Artificial Sequence
  Description of Artificial Sequence: Synthetic oligonucleotide
  Target: DMPK; (+) strand; PAM type: NRG; PAM sequence: GGG
aaggagaagaaagaggcata

SEQ ID NO: 12338 - DNA, 20 bp, Artificial Sequence
  Description of Artificial Sequence: Synthetic oligonucleotide
  Target: DMPK; (+) strand; PAM type: NRG; PAM sequence: TGG
agaaagaggcatagggcgcg

SEQ ID NO: 12339 - DNA, 20 bp, Artificial Sequence
  Description of Artificial Sequence: Synthetic oligonucleotide
  Target: DMPK; (+) strand; PAM type: NRG; PAM sequence: GAG
aaagaggcatagggcgcgtg

SEQ ID NO: 12340 - DNA, 20 bp, Artificial Sequence
  Description of Artificial Sequence: Synthetic oligonucleotide
  Target: DMPK; (+) strand; PAM type: NRG; PAM sequence: AGG
aagaggcatagggcgcgtgg

SEQ ID NO: 12341 - DNA, 20 bp, Artificial Sequence
  Description of Artificial Sequence: Synthetic oligonucleotide
  Target: DMPK; (+) strand; PAM type: NRG; PAM sequence: GGG
agaggcatagggcgcgtgga

SEQ ID NO: 12342 - DNA, 20 bp, Artificial Sequence
  Description of Artificial Sequence: Synthetic oligonucleotide
  Target: DMPK; (+) strand; PAM type: NRG; PAM sequence: GGG
gaggcatagggcgcgtggag

SEQ ID NO: 12343 - DNA, 20 bp, Artificial Sequence
  Description of Artificial Sequence: Synthetic oligonucleotide
  Target: DMPK; (+) strand; PAM type: NRG; PAM sequence: AAG
atagggcgcgtggaggggcg

SEQ ID NO: 12344 - DNA, 20 bp, Artificial Sequence
  Description of Artificial Sequence: Synthetic oligonucleotide
  Target: DMPK; (+) strand; PAM type: NRG; PAM sequence: AGG
tagggcgcgtggaggggcga

SEQ ID NO: 12345 - DNA, 20 bp, Artificial Sequence
  Description of Artificial Sequence: Synthetic oligonucleotide
  Target: DMPK; (+) strand; PAM type: NRG; PAM sequence: GAG
gggcgcgtggaggggcgaag

SEQ ID NO: 12346 - DNA, 20 bp, Artificial Sequence
  Description of Artificial Sequence: Synthetic oligonucleotide
  Target: DMPK; (+) strand; PAM type: NRG; PAM sequence: AGG
ggcgcgtggaggggcgaagg

SEQ ID NO: 12347 - DNA, 20 bp, Artificial Sequence
  Description of Artificial Sequence: Synthetic oligonucleotide
  Target: DMPK; (+) strand; PAM type: NRG; PAM sequence: GGG
gcgcgtggaggggcgaagga

SEQ ID NO: 12348 - DNA, 20 bp, Artificial Sequence
  Description of Artificial Sequence: Synthetic oligonucleotide
  Target: DMPK; (+) strand; PAM type: NRG; PAM sequence: CGG
cgtggaggggcgaaggaggg

SEQ ID NO: 12349 - DNA, 20 bp, Artificial Sequence
  Description of Artificial Sequence: Synthetic oligonucleotide
  Target: DMPK; (+) strand; PAM type: NRG; PAM sequence: TGG
ggaggggcgaaggagggcgg

SEQ ID NO: 12350 - DNA, 20 bp, Artificial Sequence
  Description of Artificial Sequence: Synthetic oligonucleotide
  Target: DMPK; (+) strand; PAM type: NRG; PAM sequence: CGG
ggcgaaggagggcggtggcg

SEQ ID NO: 12351 - DNA, 20 bp, Artificial Sequence
  Description of Artificial Sequence: Synthetic oligonucleotide
  Target: DMPK; (+) strand; PAM type: NRG; PAM sequence: CAG
ggcggtggcgcggcgtgccc

SEQ ID NO: 12352 - DNA, 20 bp, Artificial Sequence
  Description of Artificial Sequence: Synthetic oligonucleotide
  Target: DMPK; (+) strand; PAM type: NRG; PAM sequence: TGG
tggcgcggcgtgccccagcg

SEQ ID NO: 12353 - DNA, 20 bp, Artificial Sequence
  Description of Artificial Sequence: Synthetic oligonucleotide
  Target: DMPK; (+) strand; PAM type: NRG; PAM sequence: GGG
ggcgcggcgtgccccagcgt

SEQ ID NO: 12354 - DNA, 20 bp, Artificial Sequence
  Description of Artificial Sequence: Synthetic oligonucleotide
  Target: DMPK; (+) strand; PAM type: NRG; PAM sequence: CAG
cgtgggtcccttccctcctc

SEQ ID NO: 12355 - DNA, 20 bp, Artificial Sequence
  Description of Artificial Sequence: Synthetic oligonucleotide
  Target: DMPK; (+) strand; PAM type: NRG; PAM sequence: AGG
gtgggtcccttccctcctcc

SEQ ID NO: 12356 - DNA, 20 bp, Artificial Sequence
  Description of Artificial Sequence: Synthetic oligonucleotide
  Target: DMPK; (+) strand; PAM type: NRG; PAM sequence: CGG
aggtgtctatacacgccccg

SEQ ID NO: 12357 - DNA, 20 bp, Artificial Sequence
  Description of Artificial Sequence: Synthetic oligonucleotide
  Target: DMPK; (+) strand; PAM type: NRG; PAM sequence: GAG
gtgtctatacacgccccgcg

SEQ ID NO: 12358 - DNA, 20 bp, Artificial Sequence
  Description of Artificial Sequence: Synthetic oligonucleotide
  Target: DMPK; (+) strand; PAM type: NRG; PAM sequence: CAG
tctatacacgccccgcggag

SEQ ID NO: 12359 - DNA, 20 bp, Artificial Sequence
  Description of Artificial Sequence: Synthetic oligonucleotide
  Target: DMPK; (+) strand; PAM type: NRG; PAM sequence: CGG
tacacgccccgcggagcaga

SEQ ID NO: 12360 - DNA, 20 bp, Artificial Sequence
  Description of Artificial Sequence: Synthetic oligonucleotide
  Target: DMPK; (+) strand; PAM type: NRG; PAM sequence: CGG
gcagacggcccacctcctcc

SEQ ID NO: 12361 - DNA, 20 bp, Artificial Sequence
  Description of Artificial Sequence: Synthetic oligonucleotide
  Target: DMPK; (+) strand; PAM type: NRG; PAM sequence: CGG
cccacctcctcccggtcctc

SEQ ID NO: 12362 - DNA, 20 bp, Artificial Sequence
  Description of Artificial Sequence: Synthetic oligonucleotide
  Target: DMPK; (+) strand; PAM type: NRG; PAM sequence: GGG
ccacctcctcccggtcctcc

SEQ ID NO: 12363 - DNA, 20 bp, Artificial Sequence
  Description of Artificial Sequence: Synthetic oligonucleotide
  Target: DMPK; (+) strand; PAM type: NRG; PAM sequence: GGG
cacctcctcccggtcctccg

SEQ ID NO: 12364 - DNA, 20 bp, Artificial Sequence
  Description of Artificial Sequence: Synthetic oligonucleotide
  Target: DMPK; (+) strand; PAM type: NRG; PAM sequence: AAG
ctcctcccggtcctccgggg

SEQ ID NO: 12365 - DNA, 20 bp, Artificial Sequence
  Description of Artificial Sequence: Synthetic oligonucleotide
  Target: DMPK; (+) strand; PAM type: NRG; PAM sequence: AGG
tcctcccggtcctccgggga

SEQ ID NO: 12366 - DNA, 20 bp, Artificial Sequence
  Description of Artificial Sequence: Synthetic oligonucleotide
  Target: DMPK; (+) strand; PAM type: NRG; PAM sequence: GGG
cctcccggtcctccggggaa

SEQ ID NO: 12367 - DNA, 20 bp, Artificial Sequence
  Description of Artificial Sequence: Synthetic oligonucleotide
  Target: DMPK; (+) strand; PAM type: NRG; PAM sequence: GGG
ctcccggtcctccggggaag

SEQ ID NO: 12368 - DNA, 20 bp, Artificial Sequence
  Description of Artificial Sequence: Synthetic oligonucleotide
  Target: DMPK; (+) strand; PAM type: NRG; PAM sequence: GAG
ctccggggaaggggacacat

SEQ ID NO: 12369 - DNA, 20 bp, Artificial Sequence
  Description of Artificial Sequence: Synthetic oligonucleotide
  Target: DMPK; (+) strand; PAM type: NRG; PAM sequence: AGG
tccggggaaggggacacatg

SEQ ID NO: 12370 - DNA, 20 bp, Artificial Sequence
  Description of Artificial Sequence: Synthetic oligonucleotide
  Target: DMPK; (+) strand; PAM type: NRG; PAM sequence: GGG
ccggggaaggggacacatga

SEQ ID NO: 12371 - DNA, 20 bp, Artificial Sequence
  Description of Artificial Sequence: Synthetic oligonucleotide
  Target: DMPK; (+) strand; PAM type: NRG; PAM sequence: TGG
acacatgagggactcacctg

SEQ ID NO: 12372 - DNA, 20 bp, Artificial Sequence
  Description of Artificial Sequence: Synthetic oligonucleotide
  Target: DMPK; (+) strand; PAM type: NRG; PAM sequence: CAG
cctgtggctccctctgcctg

SEQ ID NO: 12373 - DNA, 20 bp, Artificial Sequence
  Description of Artificial Sequence: Synthetic oligonucleotide
  Target: DMPK; (+) strand; PAM type: NRG; PAM sequence: CGG
ccatccgctcctgcaactgc

SEQ ID NO: 12374 - DNA, 20 bp, Artificial Sequence
  Description of Artificial Sequence: Synthetic oligonucleotide
  Target: DMPK; (+) strand; PAM type: NRG; PAM sequence: TAG
aactgccggacgtgtgcctc

SEQ ID NO: 12375 - DNA, 20 bp, Artificial Sequence
  Description of Artificial Sequence: Synthetic oligonucleotide
  Target: DMPK; (+) strand; PAM type: NRG; PAM sequence: AGG
actgccggacgtgtgcctct

SEQ ID NO: 12376 - DNA, 20 bp, Artificial Sequence
  Description of Artificial Sequence: Synthetic oligonucleotide
  Target: DMPK; (+) strand; PAM type: NRG; PAM sequence: CGG
ggacgtgtgcctctaggtcc

SEQ ID NO: 12377 - DNA, 20 bp, Artificial Sequence
  Description of Artificial Sequence: Synthetic oligonucleotide
  Target: DMPK; (+) strand; PAM type: NRG; PAM sequence: GAG
tgcctctaggtcccggttcc

SEQ ID NO: 12378 - DNA, 20 bp, Artificial Sequence
  Description of Artificial Sequence: Synthetic oligonucleotide
  Target: DMPK; (+) strand; PAM type: NRG; PAM sequence: TAG
ttccgagcctctgcctcgcg

SEQ ID NO: 12379 - DNA, 20 bp, Artificial Sequence
  Description of Artificial Sequence: Synthetic oligonucleotide
  Target: DMPK; (+) strand; PAM type: NRG; PAM sequence: TGG
ctgcctcgcgtagttgactg

SEQ ID NO: 12380 - DNA, 20 bp, Artificial Sequence
  Description of Artificial Sequence: Synthetic oligonucleotide
  Target: DMPK; (+) strand; PAM type: NRG; PAM sequence: GGG
tgcctcgcgtagttgactgt

SEQ ID NO: 12381 - DNA, 20 bp, Artificial Sequence
  Description of Artificial Sequence: Synthetic oligonucleotide
  Target: DMPK; (+) strand; PAM type: NRG; PAM sequence: GGG
gcctcgcgtagttgactgtg

SEQ ID NO: 12382 - DNA, 20 bp, Artificial Sequence
  Description of Artificial Sequence: Synthetic oligonucleotide
  Target: DMPK; (+) strand; PAM type: NRG; PAM sequence: GAG
ctcgcgtagttgactgtggg

SEQ ID NO: 12383 - DNA, 20 bp, Artificial Sequence
  Description of Artificial Sequence: Synthetic oligonucleotide
  Target: DMPK; (+) strand; PAM type: NRG; PAM sequence: AGG
tcgcgtagttgactgtgggg

SEQ ID NO: 12384 - DNA, 20 bp, Artificial Sequence
  Description of Artificial Sequence: Synthetic oligonucleotide
  Target: DMPK; (+) strand; PAM type: NRG; PAM sequence: AAG
gtagttgactgtggggaggt

SEQ ID NO: 12385 - DNA, 20 bp, Artificial Sequence
  Description of Artificial Sequence: Synthetic oligonucleotide
  Target: DMPK; (+) strand; PAM type: NRG; PAM sequence: AGG
tagttgactgtggggaggta

SEQ ID NO: 12386 - DNA, 20 bp, Artificial Sequence
  Description of Artificial Sequence: Synthetic oligonucleotide
  Target: DMPK; (+) strand; PAM type: NRG; PAM sequence: CGG
tgactgtggggaggtaagga

SEQ ID NO: 12387 - DNA, 20 bp, Artificial Sequence
  Description of Artificial Sequence: Synthetic oligonucleotide
  Target: DMPK; (+) strand; PAM type: NRG; PAM sequence: GAG
tgtggggaggtaaggacggt

SEQ ID NO: 12388 - DNA, 20 bp, Artificial Sequence
  Description of Artificial Sequence: Synthetic oligonucleotide
  Target: DMPK; (+) strand; PAM type: NRG; PAM sequence: CGG
gtaaggacggtgagtccgtc

SEQ ID NO: 12389 - DNA, 20 bp, Artificial Sequence
  Description of Artificial Sequence: Synthetic oligonucleotide
  Target: DMPK; (+) strand; PAM type: NRG; PAM sequence: GGG
taaggacggtgagtccgtcc

SEQ ID NO: 12390 - DNA, 20 bp, Artificial Sequence
  Description of Artificial Sequence: Synthetic oligonucleotide
  Target: DMPK; (+) strand; PAM type: NRG; PAM sequence: CGG
gacggtgagtccgtccgggc

SEQ ID NO: 12391 - DNA, 20 bp, Artificial Sequence
  Description of Artificial Sequence: Synthetic oligonucleotide
  Target: DMPK; (+) strand; PAM type: NRG; PAM sequence: GAG
tgagtccgtccgggccggac

SEQ ID NO: 12392 - DNA, 20 bp, Artificial Sequence
  Description of Artificial Sequence: Synthetic oligonucleotide
  Target: DMPK; (+) strand; PAM type: NRG; PAM sequence: GAG
agtccgtccgggccggacga

SEQ ID NO: 12393 - DNA, 20 bp, Artificial Sequence
  Description of Artificial Sequence: Synthetic oligonucleotide
  Target: DMPK; (+) strand; PAM type: NRG; PAM sequence: AGG
gtccgtccgggccggacgag

SEQ ID NO: 12394 - DNA, 20 bp, Artificial Sequence
  Description of Artificial Sequence: Synthetic oligonucleotide
  Target: DMPK; (+) strand; PAM type: NRG; PAM sequence: GGG
tccgtccgggccggacgaga

SEQ ID NO: 12395 - DNA, 20 bp, Artificial Sequence
  Description of Artificial Sequence: Synthetic oligonucleotide
  Target: DMPK; (+) strand; PAM type: NRG; PAM sequence: GGG
ccgtccgggccggacgagag

SEQ ID NO: 12396 - DNA, 20 bp, Artificial Sequence
  Description of Artificial Sequence: Synthetic oligonucleotide
  Target: DMPK; (+) strand; PAM type: NRG; PAM sequence: AAG
gccggacgagaggggatgcc

SEQ ID NO: 12397 - DNA, 20 bp, Artificial Sequence
  Description of Artificial Sequence: Synthetic oligonucleotide
  Target: DMPK; (+) strand; PAM type: NRG; PAM sequence: AGG
ccggacgagaggggatgcca

SEQ ID NO: 12398 - DNA, 20 bp, Artificial Sequence
  Description of Artificial Sequence: Synthetic oligonucleotide
  Target: DMPK; (+) strand; PAM type: NRG; PAM sequence: GGG
cggacgagaggggatgccaa

SEQ ID NO: 12399 - DNA, 20 bp, Artificial Sequence
  Description of Artificial Sequence: Synthetic oligonucleotide
  Target: DMPK; (+) strand; PAM type: NRG; PAM sequence: CGG
gggatgccaagggttgccac

SEQ ID NO: 12400 - DNA, 20 bp, Artificial Sequence
  Description of Artificial Sequence: Synthetic oligonucleotide
  Target: DMPK; (+) strand; PAM type: NRG; PAM sequence: CGG
gttgccaccggcccgcatcc

SEQ ID NO: 12401 - DNA, 20 bp, Artificial Sequence
  Description of Artificial Sequence: Synthetic oligonucleotide
  Target: DMPK; (+) strand; PAM type: NRG; PAM sequence: CGG
accggcccgcatcccggccc

SEQ ID NO: 12402 - DNA, 20 bp, Artificial Sequence
  Description of Artificial Sequence: Synthetic oligonucleotide
  Target: DMPK; (+) strand; PAM type: NRG; PAM sequence: CGG
ccgcatcccggccccggccc

SEQ ID NO: 12403 - DNA, 20 bp, Artificial Sequence
  Description of Artificial Sequence: Synthetic oligonucleotide
  Target: DMPK; (+) strand; PAM type: NRG; PAM sequence: TGG
ccccggccccgatcccgacc

SEQ ID NO: 12404 - DNA, 20 bp, Artificial Sequence
  Description of Artificial Sequence: Synthetic oligonucleotide
  Target: DMPK; (+) strand; PAM type: NRG; PAM sequence: AAG
gccccgatcccgacctggcg

SEQ ID NO: 12405 - DNA, 20 bp, Artificial Sequence
  Description of Artificial Sequence: Synthetic oligonucleotide
  Target: DMPK; (+) strand; PAM type: NRG; PAM sequence: TGG
atcccgacctggcgaagttc

SEQ ID NO: 12406 - DNA, 20 bp, Artificial Sequence
  Description of Artificial Sequence: Synthetic oligonucleotide
  Target: DMPK; (+) strand; PAM type: NRG; PAM sequence: CGG
cgaagttctggttgtccgtg

SEQ ID NO: 12407 - DNA, 20 bp, Artificial Sequence
  Description of Artificial Sequence: Synthetic oligonucleotide
  Target: DMPK; (+) strand; PAM type: NRG; PAM sequence: TGG
gttctggttgtccgtgcgga

SEQ ID NO: 12408 - DNA, 20 bp, Artificial Sequence
  Description of Artificial Sequence: Synthetic oligonucleotide
  Target: DMPK; (+) strand; PAM type: NRG; PAM sequence: CGG
tgcggatggcctccatctcc

SEQ ID NO: 12409 - DNA, 20 bp, Artificial Sequence
  Description of Artificial Sequence: Synthetic oligonucleotide
  Target: DMPK; (+) strand; PAM type: NRG; PAM sequence: CAG
atggcctccatctcccggct

SEQ ID NO: 12410 - DNA, 20 bp, Artificial Sequence
  Description of Artificial Sequence: Synthetic oligonucleotide
  Target: DMPK; (+) strand; PAM type: NRG; PAM sequence: AGG
tggcctccatctcccggctc

SEQ ID NO: 12411 - DNA, 20 bp, Artificial Sequence
  Description of Artificial Sequence: Synthetic oligonucleotide
  Target: DMPK; (+) strand; PAM type: NRG; PAM sequence: CGG
tctcccggctcaggctctgc

SEQ ID NO: 12412 - DNA, 20 bp, Artificial Sequence
  Description of Artificial Sequence: Synthetic oligonucleotide
  Target: DMPK; (+) strand; PAM type: NRG; PAM sequence: GGG
ctcccggctcaggctctgcc

SEQ ID NO: 12413 - DNA, 20 bp, Artificial Sequence
  Description of Artificial Sequence: Synthetic oligonucleotide
  Target: DMPK; (+) strand; PAM type: NRG; PAM sequence: GAG
cggctcaggctctgccgggt

SEQ ID NO: 12414 - DNA, 20 bp, Artificial Sequence
  Description of Artificial Sequence: Synthetic oligonucleotide
  Target: DMPK; (+) strand; PAM type: NRG; PAM sequence: CAG
cgggtgagcacctcctcctc

SEQ ID NO: 12415 - DNA, 20 bp, Artificial Sequence
  Description of Artificial Sequence: Synthetic oligonucleotide
  Target: DMPK; (+) strand; PAM type: NRG; PAM sequence: AGG
gggtgagcacctcctcctcc

SEQ ID NO: 12416 - DNA, 20 bp, Artificial Sequence
  Description of Artificial Sequence: Synthetic oligonucleotide
  Target: DMPK; (+) strand; PAM type: NRG; PAM sequence: GGG
ggtgagcacctcctcctcca

SEQ ID NO: 12417 - DNA, 20 bp, Artificial Sequence
  Description of Artificial Sequence: Synthetic oligonucleotide
  Target: DMPK; (+) strand; PAM type: NRG; PAM sequence: TGG
cctcctcctccagggcttcc

SEQ ID NO: 12418 - DNA, 20 bp, Artificial Sequence
  Description of Artificial Sequence: Synthetic oligonucleotide
  Target: DMPK; (+) strand; PAM type: NRG; PAM sequence: GAG
tcctcctccagggcttcctg

SEQ ID NO: 12419 - DNA, 20 bp, Artificial Sequence
  Description of Artificial Sequence: Synthetic oligonucleotide
  Target: DMPK; (+) strand; PAM type: NRG; PAM sequence: CAG
agggcttcctggagctcccg

SEQ ID NO: 12420 - DNA, 20 bp, Artificial Sequence
  Description of Artificial Sequence: Synthetic oligonucleotide
  Target: DMPK; (+) strand; PAM type: NRG; PAM sequence: CGG
gagctcccgcagcgtcacct

SEQ ID NO: 12421 - DNA, 20 bp, Artificial Sequence
  Description of Artificial Sequence: Synthetic oligonucleotide
  Target: DMPK; (+) strand; PAM type: NRG; PAM sequence: CAG
ccgcagcgtcacctcggcct

SEQ ID NO: 12422 - DNA, 20 bp, Artificial Sequence
  Description of Artificial Sequence: Synthetic oligonucleotide
  Target: DMPK; (+) strand; PAM type: NRG; PAM sequence: CAG
ctcggcctcagcctctgccg

SEQ ID NO: 12423 - DNA, 20 bp, Artificial Sequence
  Description of Artificial Sequence: Synthetic oligonucleotide
  Target: DMPK; (+) strand; PAM type: NRG; PAM sequence: AGG
tcggcctcagcctctgccgc

SEQ ID NO: 12424 - DNA, 20 bp, Artificial Sequence
  Description of Artificial Sequence: Synthetic oligonucleotide
  Target: DMPK; (+) strand; PAM type: NRG; PAM sequence: GGG
cggcctcagcctctgccgca

SEQ ID NO: 12425 - DNA, 20 bp, Artificial Sequence
  Description of Artificial Sequence: Synthetic oligonucleotide
  Target: DMPK; (+) strand; PAM type: NRG; PAM sequence: CAG
ctcagcctctgccgcaggga

SEQ ID NO: 12426 - DNA, 20 bp, Artificial Sequence
  Description of Artificial Sequence: Synthetic oligonucleotide
  Target: DMPK; (+) strand; PAM type: NRG; PAM sequence: TGG
tctgccgcagggacagccgc

SEQ ID NO: 12427 - DNA, 20 bp, Artificial Sequence
  Description of Artificial Sequence: Synthetic oligonucleotide
  Target: DMPK; (+) strand; PAM type: NRG; PAM sequence: CAG
agccgctggaactgccactt

SEQ ID NO: 12428 - DNA, 20 bp, Artificial Sequence
  Description of Artificial Sequence: Synthetic oligonucleotide
  Target: DMPK; (+) strand; PAM type: NRG; PAM sequence: TGG
ctgccacttcagcctgtgta

SEQ ID NO: 12429 - DNA, 20 bp, Artificial Sequence
  Description of Artificial Sequence: Synthetic oligonucleotide
  Target: DMPK; (+) strand; PAM type: NRG; PAM sequence: GGG
tgccacttcagcctgtgtat

SEQ ID NO: 12430 - DNA, 20 bp, Artificial Sequence
  Description of Artificial Sequence: Synthetic oligonucleotide
  Target: DMPK; (+) strand; PAM type: NRG; PAM sequence: GGG
gccacttcagcctgtgtatg

SEQ ID NO: 12431 - DNA, 20 bp, Artificial Sequence
  Description of Artificial Sequence: Synthetic oligonucleotide
  Target: DMPK; (+) strand; PAM type: NRG; PAM sequence: CAG
ttcagcctgtgtatggggac

SEQ ID NO: 12432 - DNA, 20 bp, Artificial Sequence
  Description of Artificial Sequence: Synthetic oligonucleotide
  Target: DMPK; (+) strand; PAM type: NRG; PAM sequence: AGG
tcagcctgtgtatggggacc

SEQ ID NO: 12433 - DNA, 20 bp, Artificial Sequence
  Description of Artificial Sequence: Synthetic oligonucleotide
  Target: DMPK; (+) strand; PAM type: NRG; PAM sequence: AAG
tgtgtatggggaccaggctt

SEQ ID NO: 12434 - DNA, 20 bp, Artificial Sequence
  Description of Artificial Sequence: Synthetic oligonucleotide
  Target: DMPK; (+) strand; PAM type: NRG; PAM sequence: AGG
gtgtatggggaccaggctta

SEQ ID NO: 12435 - DNA, 20 bp, Artificial Sequence
  Description of Artificial Sequence: Synthetic oligonucleotide
  Target: DMPK; (+) strand; PAM type: NRG; PAM sequence: TGG
accaggcttaaggctgcctg

SEQ ID NO: 12436 - DNA, 20 bp, Artificial Sequence
  Description of Artificial Sequence: Synthetic oligonucleotide
  Target: DMPK; (+) strand; PAM type: NRG; PAM sequence: TGG
ttaaggctgcctgtggctcc

SEQ ID NO: 12437 - DNA, 20 bp, Artificial Sequence
  Description of Artificial Sequence: Synthetic oligonucleotide
  Target: DMPK; (+) strand; PAM type: NRG; PAM sequence: AAG
aggctgcctgtggctcctgg

SEQ ID NO: 12438 - DNA, 20 bp, Artificial Sequence
  Description of Artificial Sequence: Synthetic oligonucleotide
  Target: DMPK; (+) strand; PAM type: NRG; PAM sequence: CAG
cctgtggctcctggaagact

SEQ ID NO: 12439 - DNA, 20 bp, Artificial Sequence
  Description of Artificial Sequence: Synthetic oligonucleotide
  Target: DMPK; (+) strand; PAM type: NRG; PAM sequence: AGG
ctgtggctcctggaagactc

SEQ ID NO: 12440 - DNA, 20 bp, Artificial Sequence
  Description of Artificial Sequence: Synthetic oligonucleotide
  Target: DMPK; (+) strand; PAM type: NRG; PAM sequence: TGG
ctcctggaagactcaggact

SEQ ID NO: 12441 - DNA, 20 bp, Artificial Sequence
  Description of Artificial Sequence: Synthetic oligonucleotide
  Target: DMPK; (+) strand; PAM type: NRG; PAM sequence: GGG
tcctggaagactcaggactt

SEQ ID NO: 12442 - DNA, 20 bp, Artificial Sequence
  Description of Artificial Sequence: Synthetic oligonucleotide
  Target: DMPK; (+) strand; PAM type: NRG; PAM sequence: TGG
aagactcaggacttgggcac

SEQ ID NO: 12443 - DNA, 20 bp, Artificial Sequence
  Description of Artificial Sequence: Synthetic oligonucleotide
  Target: DMPK; (+) strand; PAM type: NRG; PAM sequence: CAG
caggacttgggcactggttc

SEQ ID NO: 12444 - DNA, 20 bp, Artificial Sequence
  Description of Artificial Sequence: Synthetic oligonucleotide
  Target: DMPK; (+) strand; PAM type: NRG; PAM sequence: AGG
aggacttgggcactggttcc

SEQ ID NO: 12445 - DNA, 20 bp, Artificial Sequence
  Description of Artificial Sequence: Synthetic oligonucleotide
  Target: DMPK; (+) strand; PAM type: NRG; PAM sequence: TAG
cttgggcactggttccaggc

SEQ ID NO: 12446 - DNA, 20 bp, Artificial Sequence
  Description of Artificial Sequence: Synthetic oligonucleotide
  Target: DMPK; (+) strand; PAM type: NRG; PAM sequence: AGG
ttgggcactggttccaggct

SEQ ID NO: 12447 - DNA, 20 bp, Artificial Sequence
  Description of Artificial Sequence: Synthetic oligonucleotide
  Target: DMPK; (+) strand; PAM type: NRG; PAM sequence: TGG
ctccgtcccctcaacatttc

SEQ ID NO: 12448 - DNA, 20 bp, Artificial Sequence
  Description of Artificial Sequence: Synthetic oligonucleotide
  Target: DMPK; (+) strand; PAM type: NRG; PAM sequence: TAG
caacatttctggaatcccca

SEQ ID NO: 12449 - DNA, 20 bp, Artificial Sequence
  Description of Artificial Sequence: Synthetic oligonucleotide
  Target: DMPK; (+) strand; PAM type: NRG; PAM sequence: AAG
catagctcctgcaatgatcc

SEQ ID NO: 12450 - DNA, 20 bp, Artificial Sequence
  Description of Artificial Sequence: Synthetic oligonucleotide
  Target: DMPK; (+) strand; PAM type: NRG; PAM sequence: CAG
cctcccttccctacctccct

SEQ ID NO: 12451 - DNA, 20 bp, Artificial Sequence
  Description of Artificial Sequence: Synthetic oligonucleotide
  Target: DMPK; (+) strand; PAM type: NRG; PAM sequence: GAG
cctccctcagccccatccct

SEQ ID NO: 12452 - DNA, 20 bp, Artificial Sequence
  Description of Artificial Sequence: Synthetic oligonucleotide
  Target: DMPK; (+) strand; PAM type: NRG; PAM sequence: TGG
ctcagccccatccctgagtc

SEQ ID NO: 12453 - DNA, 20 bp, Artificial Sequence
  Description of Artificial Sequence: Synthetic oligonucleotide
  Target: DMPK; (+) strand; PAM type: NRG; PAM sequence: CAG
tctggtcctctaaatctaca

SEQ ID NO: 12454 - DNA, 20 bp, Artificial Sequence
  Description of Artificial Sequence: Synthetic oligonucleotide
  Target: DMPK; (+) strand; PAM type: NRG; PAM sequence: AGG
ctggtcctctaaatctacac

SEQ ID NO: 12455 - DNA, 20 bp, Artificial Sequence
  Description of Artificial Sequence: Synthetic oligonucleotide
  Target: DMPK; (+) strand; PAM type: NRG; PAM sequence: GGG
tggtcctctaaatctacaca

SEQ ID NO: 12456 - DNA, 20 bp, Artificial Sequence
  Description of Artificial Sequence: Synthetic oligonucleotide
  Target: DMPK; (+) strand; PAM type: NRG; PAM sequence: CAG
ctctaaatctacacagggac

SEQ ID NO: 12457 - DNA, 20 bp, Artificial Sequence
  Description of Artificial Sequence: Synthetic oligonucleotide
  Target: DMPK; (+) strand; PAM type: NRG; PAM sequence: GAG
ctaaatctacacagggacca

SEQ ID NO: 12458 - DNA, 20 bp, Artificial Sequence
  Description of Artificial Sequence: Synthetic oligonucleotide
  Target: DMPK; (+) strand; PAM type: NRG; PAM sequence: AGG
taaatctacacagggaccag

SEQ ID NO: 12459 - DNA, 20 bp, Artificial Sequence
  Description of Artificial Sequence: Synthetic oligonucleotide
  Target: DMPK; (+) strand; PAM type: NRG; PAM sequence: GGG
aaatctacacagggaccaga

SEQ ID NO: 12460 - DNA, 20 bp, Artificial Sequence
  Description of Artificial Sequence: Synthetic oligonucleotide
  Target: DMPK; (+) strand; PAM type: NRG; PAM sequence: TGG
ctacacagggaccagagggc

SEQ ID NO: 12461 - DNA, 20 bp, Artificial Sequence
  Description of Artificial Sequence: Synthetic oligonucleotide
  Target: DMPK; (+) strand; PAM type: NRG; PAM sequence: CAG
tctgctgctcaaaatccctc

SEQ ID NO: 12462 - DNA, 20 bp, Artificial Sequence
  Description of Artificial Sequence: Synthetic oligonucleotide
  Target: DMPK; (+) strand; PAM type: NRG; PAM sequence: AAG
ccctaatgccctcacgacaa

SEQ ID NO: 12463 - DNA, 20 bp, Artificial Sequence
  Description of Artificial Sequence: Synthetic oligonucleotide
  Target: DMPK; (+) strand; PAM type: NRG; PAM sequence: AGG
cctaatgccctcacgacaaa

SEQ ID NO: 12464 - DNA, 20 bp, Artificial Sequence
  Description of Artificial Sequence: Synthetic oligonucleotide
  Target: DMPK; (+) strand; PAM type: NRG; PAM sequence: TGG
ctcacgacaaaaggccttgc

SEQ ID NO: 12465 - DNA, 20 bp, Artificial Sequence
  Description of Artificial Sequence: Synthetic oligonucleotide
  Target: DMPK; (+) strand; PAM type: NRG; PAM sequence: GGG
tcacgacaaaaggccttgct

SEQ ID NO: 12466 - DNA, 20 bp, Artificial Sequence
  Description of Artificial Sequence: Synthetic oligonucleotide
  Target: DMPK; (+) strand; PAM type: NRG; PAM sequence: TGG
tgctgggttttgtttcctgc

SEQ ID NO: 12467 - DNA, 20 bp, Artificial Sequence
  Description of Artificial Sequence: Synthetic oligonucleotide
  Target: DMPK; (+) strand; PAM type: NRG; PAM sequence: CAG
ttgtttcctgctggcctctc

SEQ ID NO: 12468 - DNA, 20 bp, Artificial Sequence
  Description of Artificial Sequence: Synthetic oligonucleotide
  Target: DMPK; (+) strand; PAM type: NRG; PAM sequence: CAG
gctggcctctccagccttct

SEQ ID NO: 12469 - DNA, 20 bp, Artificial Sequence
  Description of Artificial Sequence: Synthetic oligonucleotide
  Target: DMPK; (+) strand; PAM type: NRG; PAM sequence: AGG
ctggcctctccagccttctc

SEQ ID NO: 12470 - DNA, 20 bp, Artificial Sequence
  Description of Artificial Sequence: Synthetic oligonucleotide
  Target: DMPK; (+) strand; PAM type: NRG; PAM sequence: CAG
cagccttctcaggaatgatt

SEQ ID NO: 12471 - DNA, 20 bp, Artificial Sequence
  Description of Artificial Sequence: Synthetic oligonucleotide
  Target: DMPK; (+) strand; PAM type: NRG; PAM sequence: CAG
gattcagccaaactaccttt

SEQ ID NO: 12472 - DNA, 20 bp, Artificial Sequence
  Description of Artificial Sequence: Synthetic oligonucleotide
  Target: DMPK; (+) strand; PAM type: NRG; PAM sequence: AGG
attcagccaaactacctttc

SEQ ID NO: 12473 - DNA, 20 bp, Artificial Sequence
  Description of Artificial Sequence: Synthetic oligonucleotide
  Target: DMPK; (+) strand; PAM type: NRG; PAM sequence: CAG
actacctttcaggaacaaat

SEQ ID NO: 12474 - DNA, 20 bp, Artificial Sequence
  Description of Artificial Sequence: Synthetic oligonucleotide
  Target: DMPK; (+) strand; PAM type: NRG; PAM sequence: AGG
ctacctttcaggaacaaatc

SEQ ID NO: 12475 - DNA, 20 bp, Artificial Sequence
  Description of Artificial Sequence: Synthetic oligonucleotide
  Target: DMPK; (+) strand; PAM type: NRG; PAM sequence: AAG
atcaggattcccacctgccc

SEQ ID NO: 12476 - DNA, 20 bp, Artificial Sequence
  Description of Artificial Sequence: Synthetic oligonucleotide
  Target: DMPK; (+) strand; PAM type: NRG; PAM sequence: AGG
tcaggattcccacctgccca

SEQ ID NO: 12477 - DNA, 20 bp, Artificial Sequence
  Description of Artificial Sequence: Synthetic oligonucleotide
  Target: DMPK; (+) strand; PAM type: NRG; PAM sequence: TGG
cctgcccaaggcctttgccc

SEQ ID NO: 12478 - DNA, 20 bp, Artificial Sequence
  Description of Artificial Sequence: Synthetic oligonucleotide
  Target: DMPK; (+) strand; PAM type: NRG; PAM sequence: GAG
tgcccaaggcctttgccctg

SEQ ID NO: 12479 - DNA, 20 bp, Artificial Sequence
  Description of Artificial Sequence: Synthetic oligonucleotide
  Target: DMPK; (+) strand; PAM type: NRG; PAM sequence: AGG
gcccaaggcctttgccctgg

SEQ ID NO: 12480 - DNA, 20 bp, Artificial Sequence
  Description of Artificial Sequence: Synthetic oligonucleotide
  Target: DMPK; (+) strand; PAM type: NRG; PAM sequence: TGG
gaggctctcgcctgaccact

SEQ ID NO: 12481 - DNA, 20 bp, Artificial Sequence
  Description of Artificial Sequence: Synthetic oligonucleotide
  Target: DMPK; (+) strand; PAM type: NRG; PAM sequence: TGG
acttggcacctttccttcca

SEQ ID NO: 12482 - DNA, 20 bp, Artificial Sequence
  Description of Artificial Sequence: Synthetic oligonucleotide
  Target: DMPK; (+) strand; PAM type: NRG; PAM sequence: CAG
atggcttgtttctccttcac

SEQ ID NO: 12483 - DNA, 20 bp, Artificial Sequence
  Description of Artificial Sequence: Synthetic oligonucleotide
  Target: DMPK; (+) strand; PAM type: NRG; PAM sequence: CAG
gtttctccttcaccagcgct

SEQ ID NO: 12484 - DNA, 20 bp, Artificial Sequence
  Description of Artificial Sequence: Synthetic oligonucleotide
  Target: DMPK; (+) strand; PAM type: NRG; PAM sequence: AAG
cttcaccagcgctcagctca

SEQ ID NO: 12485 - DNA, 20 bp, Artificial Sequence
  Description of Artificial Sequence: Synthetic oligonucleotide
  Target: DMPK; (+) strand; PAM type: NRG; PAM sequence: CAG
cagctcaaagatcgacttct

SEQ ID NO: 12486 - DNA, 20 bp, Artificial Sequence
  Description of Artificial Sequence: Synthetic oligonucleotide
  Target: DMPK; (+) strand; PAM type: NRG; PAM sequence: CAG
agatcgacttctcagatccc

SEQ ID NO: 12487 - DNA, 20 bp, Artificial Sequence
  Description of Artificial Sequence: Synthetic oligonucleotide
  Target: DMPK; (+) strand; PAM type: NRG; PAM sequence: CAG
ttaatgccccactgtaacta

SEQ ID NO: 12488 - DNA, 20 bp, Artificial Sequence
  Description of Artificial Sequence: Synthetic oligonucleotide
  Target: DMPK; (+) strand; PAM type: NRG; PAM sequence: GAG
aatgccccactgtaactaca

SEQ ID NO: 12489 - DNA, 20 bp, Artificial Sequence
  Description of Artificial Sequence: Synthetic oligonucleotide
  Target: DMPK; (+) strand; PAM type: NRG; PAM sequence: AAG
cagagaccgtcccatgtctg

SEQ ID NO: 12490 - DNA, 20 bp, Artificial Sequence
  Description of Artificial Sequence: Synthetic oligonucleotide
  Target: DMPK; (+) strand; PAM type: NRG; PAM sequence: TGG
gaagtaacctcgtctctccg

SEQ ID NO: 12491 - DNA, 20 bp, Artificial Sequence
  Description of Artificial Sequence: Synthetic oligonucleotide
  Target: DMPK; (+) strand; PAM type: NRG; PAM sequence: CAG
ggtttctgtctgcttctgtt

SEQ ID NO: 12492 - DNA, 20 bp, Artificial Sequence
  Description of Artificial Sequence: Synthetic oligonucleotide
  Target: DMPK; (+) strand; PAM type: NRG; PAM sequence: AGG
gtttctgtctgcttctgttc

SEQ ID NO: 12493 - DNA, 20 bp, Artificial Sequence
  Description of Artificial Sequence: Synthetic oligonucleotide
  Target: DMPK; (+) strand; PAM type: NRG; PAM sequence: AAG
tctgtctgcttctgttcagg

SEQ ID NO: 12494 - DNA, 20 bp, Artificial Sequence
  Description of Artificial Sequence: Synthetic oligonucleotide
  Target: DMPK; (+) strand; PAM type: NRG; PAM sequence: TAG
gcttctgttcaggaagtccc

SEQ ID NO: 12495 - DNA, 20 bp, Artificial Sequence
  Description of Artificial Sequence: Synthetic oligonucleotide
  Target: DMPK; (+) strand; PAM type: NRG; PAM sequence: GAG
ttctgttcaggaagtcccta

SEQ ID NO: 12496 - DNA, 20 bp, Artificial Sequence
  Description of Artificial Sequence: Synthetic oligonucleotide
  Target: DMPK; (+) strand; PAM type: NRG; PAM sequence: AGG
tctgttcaggaagtccctag

SEQ ID NO: 12497 - DNA, 20 bp, Artificial Sequence
  Description of Artificial Sequence: Synthetic oligonucleotide
  Target: DMPK; (+) strand; PAM type: NRG; PAM sequence: GGG
ctgttcaggaagtccctaga

SEQ ID NO: 12498 - DNA, 20 bp, Artificial Sequence
  Description of Artificial Sequence: Synthetic oligonucleotide
  Target: DMPK; (+) strand; PAM type: NRG; PAM sequence: CAG
gaagtccctagagggctcta

SEQ ID NO: 12499 - DNA, 20 bp, Artificial Sequence
  Description of Artificial Sequence: Synthetic oligonucleotide
  Target: DMPK; (+) strand; PAM type: NRG; PAM sequence: CGG
gctctacagtgcacgccacc

SEQ ID NO: 12500 - DNA, 20 bp, Artificial Sequence
  Description of Artificial Sequence: Synthetic oligonucleotide
  Target: DMPK; (+) strand; PAM type: NRG; PAM sequence: GGG
ctctacagtgcacgccaccc

SEQ ID NO: 12501 - DNA, 20 bp, Artificial Sequence
  Description of Artificial Sequence: Synthetic oligonucleotide
  Target: DMPK; (+) strand; PAM type: NRG; PAM sequence: AAG
tacagtgcacgccacccggg

SEQ ID NO: 12502 - DNA, 20 bp, Artificial Sequence
  Description of Artificial Sequence: Synthetic oligonucleotide
  Target: DMPK; (+) strand; PAM type: NRG; PAM sequence: CGG
tctctcccaattgtccctga

SEQ ID NO: 12503 - DNA, 20 bp, Artificial Sequence
  Description of Artificial Sequence: Synthetic oligonucleotide
  Target: DMPK; (+) strand; PAM type: NRG; PAM sequence: TGG
caacttactgtttcatcctg

SEQ ID NO: 12504 - DNA, 20 bp, Artificial Sequence
  Description of Artificial Sequence: Synthetic oligonucleotide
  Target: DMPK; (+) strand; PAM type: NRG; PAM sequence: GGG
aacttactgtttcatcctgt

SEQ ID NO: 12505 - DNA, 20 bp, Artificial Sequence
  Description of Artificial Sequence: Synthetic oligonucleotide
  Target: DMPK; (+) strand; PAM type: NRG; PAM sequence: GGG
acttactgtttcatcctgtg

SEQ ID NO: 12506 - DNA, 20 bp, Artificial Sequence
  Description of Artificial Sequence: Synthetic oligonucleotide
  Target: DMPK; (+) strand; PAM type: NRG; PAM sequence: GAG
tttcatcctgtggggacacc

SEQ ID NO: 12507 - DNA, 20 bp, Artificial Sequence
  Description of Artificial Sequence: Synthetic oligonucleotide
  Target: DMPK; (+) strand; PAM type: NRG; PAM sequence: AGG
ttcatcctgtggggacaccg

SEQ ID NO: 12508 - DNA, 20 bp, Artificial Sequence
  Description of Artificial Sequence: Synthetic oligonucleotide
  Target: DMPK; (+) strand; PAM type: NRG; PAM sequence: GGG
tcatcctgtggggacaccga

SEQ ID NO: 12509 - DNA, 20 bp, Artificial Sequence
  Description of Artificial Sequence: Synthetic oligonucleotide
  Target: DMPK; (+) strand; PAM type: NRG; PAM sequence: CAG
tgtggggacaccgagggctc

SEQ ID NO: 12510 - DNA, 20 bp, Artificial Sequence
  Description of Artificial Sequence: Synthetic oligonucleotide
  Target: DMPK; (+) strand; PAM type: NRG; PAM sequence: AGG
gtggggacaccgagggctcc

SEQ ID NO: 12511 - DNA, 20 bp, Artificial Sequence
  Description of Artificial Sequence: Synthetic oligonucleotide
  Target: DMPK; (+) strand; PAM type: NRG; PAM sequence: TGG
ggacaccgagggctccaggc

SEQ ID NO: 12512 - DNA, 20 bp, Artificial Sequence
  Description of Artificial Sequence: Synthetic oligonucleotide
  Target: DMPK; (+) strand; PAM type: NRG; PAM sequence: GGG
gacaccgagggctccaggct

SEQ ID NO: 12513 - DNA, 20 bp, Artificial Sequence
  Description of Artificial Sequence: Synthetic oligonucleotide
  Target: DMPK; (+) strand; PAM type: NRG; PAM sequence: TGG
aggctgggcgcttgcacgtg

SEQ ID NO: 12514 - DNA, 20 bp, Artificial Sequence
  Description of Artificial Sequence: Synthetic oligonucleotide
  Target: DMPK; (+) strand; PAM type: NRG; PAM sequence: AAG
ggcgcttgcacgtgtggctc

SEQ ID NO: 12515 - DNA, 20 bp, Artificial Sequence
  Description of Artificial Sequence: Synthetic oligonucleotide
  Target: DMPK; (+) strand; PAM type: NRG; PAM sequence: CAG
gcttgcacgtgtggctcaag

SEQ ID NO: 12516 - DNA, 20 bp, Artificial Sequence
  Description of Artificial Sequence: Synthetic oligonucleotide
  Target: DMPK; (+) strand; PAM type: NRG; PAM sequence: CGG
gtgtggctcaagcagctgct

SEQ ID NO: 12517 - DNA, 20 bp, Artificial Sequence
  Description of Artificial Sequence: Synthetic oligonucleotide
  Target: DMPK; (+) strand; PAM type: NRG; PAM sequence: CAG
tcaagcagctgctcggcctc

SEQ ID NO: 12518 - DNA, 20 bp, Artificial Sequence
  Description of Artificial Sequence: Synthetic oligonucleotide
  Target: DMPK; (+) strand; PAM type: NRG; PAM sequence: TGG
ctgctcggcctccagttcca

SEQ ID NO: 12519 - DNA, 20 bp, Artificial Sequence
  Description of Artificial Sequence: Synthetic oligonucleotide
  Target: DMPK; (+) strand; PAM type: NRG; PAM sequence: GGG
tgctcggcctccagttccat

SEQ ID NO: 12520 - DNA, 20 bp, Artificial Sequence
  Description of Artificial Sequence: Synthetic oligonucleotide
  Target: DMPK; (+) strand; PAM type: NRG; PAM sequence: TGG
ggcctccagttccatgggtg

SEQ ID NO: 12521 - DNA, 20 bp, Artificial Sequence
  Description of Artificial Sequence: Synthetic oligonucleotide
  Target: DMPK; (+) strand; PAM type: NRG; PAM sequence: GGG
gcctccagttccatgggtgt

SEQ ID NO: 12522 - DNA, 20 bp, Artificial Sequence
  Description of Artificial Sequence: Synthetic oligonucleotide
  Target: DMPK; (+) strand; PAM type: NRG; PAM sequence: GGG
cctccagttccatgggtgtg

SEQ ID NO: 12523 - DNA, 20 bp, Artificial Sequence
  Description of Artificial Sequence: Synthetic oligonucleotide
  Target: DMPK; (+) strand; PAM type: NRG; PAM sequence: TGG
agttccatgggtgtggggcc

SEQ ID NO: 12524 - DNA, 20 bp, Artificial Sequence
  Description of Artificial Sequence: Synthetic oligonucleotide
  Target: DMPK; (+) strand; PAM type: NRG; PAM sequence: GGG
gttccatgggtgtggggcct

SEQ ID NO: 12525 - DNA, 20 bp, Artificial Sequence
  Description of Artificial Sequence: Synthetic oligonucleotide
  Target: DMPK; (+) strand; PAM type: NRG; PAM sequence: TGG
gcctgggacctcactgtccc

SEQ ID NO: 12526 - DNA, 20 bp, Artificial Sequence
  Description of Artificial Sequence: Synthetic oligonucleotide
  Target: DMPK; (+) strand; PAM type: NRG; PAM sequence: GGG
cctgggacctcactgtccct

SEQ ID NO: 12527 - DNA, 20 bp, Artificial Sequence
  Description of Artificial Sequence: Synthetic oligonucleotide
  Target: DMPK; (+) strand; PAM type: NRG; PAM sequence: GGG
ctgggacctcactgtccctg

SEQ ID NO: 12528 - DNA, 20 bp, Artificial Sequence
  Description of Artificial Sequence: Synthetic oligonucleotide
  Target: DMPK; (+) strand; PAM type: NRG; PAM sequence: GAG
gggacctcactgtccctggg

SEQ ID NO: 12529 - DNA, 20 bp, Artificial Sequence
  Description of Artificial Sequence: Synthetic oligonucleotide
  Target: DMPK; (+) strand; PAM type: NRG; PAM sequence: GAG
gacctcactgtccctgggga

SEQ ID NO: 12530 - DNA, 20 bp, Artificial Sequence
  Description of Artificial Sequence: Synthetic oligonucleotide
  Target: DMPK; (+) strand; PAM type: NRG; PAM sequence: AGG
acctcactgtccctggggag

SEQ ID NO: 12531 - DNA, 20 bp, Artificial Sequence
  Description of Artificial Sequence: Synthetic oligonucleotide
  Target: DMPK; (+) strand; PAM type: NRG; PAM sequence: GAG
ctcactgtccctggggagag

SEQ ID NO: 12532 - DNA, 20 bp, Artificial Sequence
  Description of Artificial Sequence: Synthetic oligonucleotide
  Target: DMPK; (+) strand; PAM type: NRG; PAM sequence: AGG
tcactgtccctggggagagg

SEQ ID NO: 12533 - DNA, 20 bp, Artificial Sequence
  Description of Artificial Sequence: Synthetic oligonucleotide
  Target: DMPK; (+) strand; PAM type: NRG; PAM sequence: GAG
actgtccctggggagaggag

SEQ ID NO: 12534 - DNA, 20 bp, Artificial Sequence
  Description of Artificial Sequence: Synthetic oligonucleotide
  Target: DMPK; (+) strand; PAM type: NRG; PAM sequence: AGG
ctgtccctggggagaggagg

SEQ ID NO: 12535 - DNA, 20 bp, Artificial Sequence
  Description of Artificial Sequence: Synthetic oligonucleotide
  Target: DMPK; (+) strand; PAM type: NRG; PAM sequence: GGG
tgtccctggggagaggagga

SEQ ID NO: 12536 - DNA, 20 bp, Artificial Sequence
  Description of Artificial Sequence: Synthetic oligonucleotide
  Target: DMPK; (+) strand; PAM type: NRG; PAM sequence: GAG
tccctggggagaggaggagg

SEQ ID NO: 12537 - DNA, 20 bp, Artificial Sequence
  Description of Artificial Sequence: Synthetic oligonucleotide
  Target: DMPK; (+) strand; PAM type: NRG; PAM sequence: TGG
ctggggagaggaggagggag

SEQ ID NO: 12538 - DNA, 20 bp, Artificial Sequence
  Description of Artificial Sequence: Synthetic oligonucleotide
  Target: DMPK; (+) strand; PAM type: NRG; PAM sequence: GGG
tggggagaggaggagggagt

SEQ ID NO: 12539 - DNA, 20 bp, Artificial Sequence
  Description of Artificial Sequence: Synthetic oligonucleotide
  Target: DMPK; (+) strand; PAM type: NRG; PAM sequence: GGG
ggggagaggaggagggagtg

SEQ ID NO: 12540 - DNA, 20 bp, Artificial Sequence
  Description of Artificial Sequence: Synthetic oligonucleotide
  Target: DMPK; (+) strand; PAM type: NRG; PAM sequence: GAG
ggagaggaggagggagtggg

SEQ ID NO: 12541 - DNA, 20 bp, Artificial Sequence
  Description of Artificial Sequence: Synthetic oligonucleotide
  Target: DMPK; (+) strand; PAM type: NRG; PAM sequence: AGG
gagaggaggagggagtgggg

SEQ ID NO: 12542 - DNA, 20 bp, Artificial Sequence
  Description of Artificial Sequence: Synthetic oligonucleotide
  Target: DMPK; (+) strand; PAM type: NRG; PAM sequence: GGG
agaggaggagggagtgggga

SEQ ID NO: 12543 - DNA, 20 bp, Artificial Sequence
  Description of Artificial Sequence: Synthetic oligonucleotide
  Target: DMPK; (+) strand; PAM type: NRG; PAM sequence: GAG
aggaggagggagtggggagg

SEQ ID NO: 12544 - DNA, 20 bp, Artificial Sequence
  Description of Artificial Sequence: Synthetic oligonucleotide
  Target: DMPK; (+) strand; PAM type: NRG; PAM sequence: CAG
ggagggagtggggagggaga

SEQ ID NO: 12545 - DNA, 20 bp, Artificial Sequence
  Description of Artificial Sequence: Synthetic oligonucleotide
  Target: DMPK; (+) strand; PAM type: NRG; PAM sequence: TGG
gagacagaatgctgattctc

SEQ ID NO: 12546 - DNA, 20 bp, Artificial Sequence
  Description of Artificial Sequence: Synthetic oligonucleotide
  Target: DMPK; (+) strand; PAM type: NRG; PAM sequence: TGG
acagaatgctgattctctgg

SEQ ID NO: 12547 - DNA, 20 bp, Artificial Sequence
  Description of Artificial Sequence: Synthetic oligonucleotide
  Target: DMPK; (+) strand; PAM type: NRG; PAM sequence: GAG
agaatgctgattctctggtg

SEQ ID NO: 12548 - DNA, 20 bp, Artificial Sequence
  Description of Artificial Sequence: Synthetic oligonucleotide
  Target: DMPK; (+) strand; PAM type: NRG; PAM sequence: CAG
ctgattctctggtggagaac

SEQ ID NO: 12549 - DNA, 20 bp, Artificial Sequence
  Description of Artificial Sequence: Synthetic oligonucleotide
  Target: DMPK; (+) strand; PAM type: NRG; PAM sequence: TGG
tggtggagaaccagaacttc

SEQ ID NO: 12550 - DNA, 20 bp, Artificial Sequence
  Description of Artificial Sequence: Synthetic oligonucleotide
  Target: DMPK; (+) strand; PAM type: NRG; PAM sequence: TGG
gaaccagaacttctggcctg

SEQ ID NO: 12551 - DNA, 20 bp, Artificial Sequence
  Description of Artificial Sequence: Synthetic oligonucleotide
  Target: DMPK; (+) strand; PAM type: NRG; PAM sequence: GGG
aaccagaacttctggcctgt

SEQ ID NO: 12552 - DNA, 20 bp, Artificial Sequence
  Description of Artificial Sequence: Synthetic oligonucleotide
  Target: DMPK; (+) strand; PAM type: NRG; PAM sequence: TAG
cagaacttctggcctgtggg

SEQ ID NO: 12553 - DNA, 20 bp, Artificial Sequence
  Description of Artificial Sequence: Synthetic oligonucleotide
  Target: DMPK; (+) strand; PAM type: NRG; PAM sequence: AGG
agaacttctggcctgtgggt

SEQ ID NO: 12554 - DNA, 20 bp, Artificial Sequence
  Description of Artificial Sequence: Synthetic oligonucleotide
  Target: DMPK; (+) strand; PAM type: NRG; PAM sequence: GGG
gaacttctggcctgtgggta

SEQ ID NO: 12555 - DNA, 20 bp, Artificial Sequence
  Description of Artificial Sequence: Synthetic oligonucleotide
  Target: DMPK; (+) strand; PAM type: NRG; PAM sequence: GGG
aacttctggcctgtgggtag

SEQ ID NO: 12556 - DNA, 20 bp, Artificial Sequence
  Description of Artificial Sequence: Synthetic oligonucleotide
  Target: DMPK; (+) strand; PAM type: NRG; PAM sequence: CAG
ttctggcctgtgggtagggg

SEQ ID NO: 12557 - DNA, 20 bp, Artificial Sequence
  Description of Artificial Sequence: Synthetic oligonucleotide
  Target: DMPK; (+) strand; PAM type: NRG; PAM sequence: AAG
gggtaggggcagctgcttcc

SEQ ID NO: 12558 - DNA, 20 bp, Artificial Sequence
  Description of Artificial Sequence: Synthetic oligonucleotide
  Target: DMPK; (+) strand; PAM type: NRG; PAM sequence: GAG
cttccaagacctcctgattt

SEQ ID NO: 12559 - DNA, 20 bp, Artificial Sequence
  Description of Artificial Sequence: Synthetic oligonucleotide
  Target: DMPK; (+) strand; PAM type: NRG; PAM sequence: AGG
ttccaagacctcctgatttg

SEQ ID NO: 12560 - DNA, 20 bp, Artificial Sequence
  Description of Artificial Sequence: Synthetic oligonucleotide
  Target: DMPK; (+) strand; PAM type: NRG; PAM sequence: AAG
caagacctcctgatttgagg

SEQ ID NO: 12561 - DNA, 20 bp, Artificial Sequence
  Description of Artificial Sequence: Synthetic oligonucleotide
  Target: DMPK; (+) strand; PAM type: NRG; PAM sequence: AGG
aagacctcctgatttgagga

SEQ ID NO: 12562 - DNA, 20 bp, Artificial Sequence
  Description of Artificial Sequence: Synthetic oligonucleotide
  Target: DMPK; (+) strand; PAM type: NRG; PAM sequence: GGG
agacctcctgatttgaggaa

SEQ ID NO: 12563 - DNA, 20 bp, Artificial Sequence
  Description of Artificial Sequence: Synthetic oligonucleotide
  Target: DMPK; (+) strand; PAM type: NRG; PAM sequence: GGG
gacctcctgatttgaggaag

SEQ ID NO: 12564 - DNA, 20 bp, Artificial Sequence
  Description of Artificial Sequence: Synthetic oligonucleotide
  Target: DMPK; (+) strand; PAM type: NRG; PAM sequence: GAG
cctcctgatttgaggaaggg

SEQ ID NO: 12565 - DNA, 20 bp, Artificial Sequence
  Description of Artificial Sequence: Synthetic oligonucleotide
  Target: DMPK; (+) strand; PAM type: NRG; PAM sequence: CAG
cctgatttgaggaaggggag

SEQ ID NO: 12566 - DNA, 20 bp, Artificial Sequence
  Description of Artificial Sequence: Synthetic oligonucleotide
  Target: DMPK; (+) strand; PAM type: NRG; PAM sequence: CAG
gatttgaggaaggggagcag

SEQ ID NO: 12567 - DNA, 20 bp, Artificial Sequence
  Description of Artificial Sequence: Synthetic oligonucleotide
  Target: DMPK; (+) strand; PAM type: NRG; PAM sequence: GAG
tttgaggaaggggagcagca

SEQ ID NO: 12568 - DNA, 20 bp, Artificial Sequence
  Description of Artificial Sequence: Synthetic oligonucleotide
  Target: DMPK; (+) strand; PAM type: NRG; PAM sequence: AAG
ggaaggggagcagcagagcg

SEQ ID NO: 12569 - DNA, 20 bp, Artificial Sequence
  Description of Artificial Sequence: Synthetic oligonucleotide
  Target: DMPK; (+) strand; PAM type: NRG; PAM sequence: GAG
aaggggagcagcagagcgaa

SEQ ID NO: 12570 - DNA, 20 bp, Artificial Sequence
  Description of Artificial Sequence: Synthetic oligonucleotide
  Target: DMPK; (+) strand; PAM type: NRG; PAM sequence: CAG
gagcagcagagcgaagagaa

SEQ ID NO: 12571 - DNA, 20 bp, Artificial Sequence
  Description of Artificial Sequence: Synthetic oligonucleotide
  Target: DMPK; (+) strand; PAM type: NRG; PAM sequence: GAG
gcagcagagcgaagagaaca

SEQ ID NO: 12572 - DNA, 20 bp, Artificial Sequence
  Description of Artificial Sequence: Synthetic oligonucleotide
  Target: DMPK; (+) strand; PAM type: NRG; PAM sequence: CAG
gagcgaagagaacagagtcc

SEQ ID NO: 12573 - DNA, 20 bp, Artificial Sequence
  Description of Artificial Sequence: Synthetic oligonucleotide
  Target: DMPK; (+) strand; PAM type: NRG; PAM sequence: AGG
agcgaagagaacagagtccc

SEQ ID NO: 12574 - DNA, 20 bp, Artificial Sequence
  Description of Artificial Sequence: Synthetic oligonucleotide
  Target: DMPK; (+) strand; PAM type: NRG; PAM sequence: TAG
gaagagaacagagtcccagg

SEQ ID NO: 12575 - DNA, 20 bp, Artificial Sequence
  Description of Artificial Sequence: Synthetic oligonucleotide
  Target: DMPK; (+) strand; PAM type: NRG; PAM sequence: AGG
aagagaacagagtcccaggt

SEQ ID NO: 12576 - DNA, 20 bp, Artificial Sequence
  Description of Artificial Sequence: Synthetic oligonucleotide
  Target: DMPK; (+) strand; PAM type: NRG; PAM sequence: TAG
cagagtcccaggtaggccaa

SEQ ID NO: 12577 - DNA, 20 bp, Artificial Sequence
  Description of Artificial Sequence: Synthetic oligonucleotide
  Target: DMPK; (+) strand; PAM type: NRG; PAM sequence: TAG
ccaatagcccctcctctgct

SEQ ID NO: 12578 - DNA, 20 bp, Artificial Sequence
  Description of Artificial Sequence: Synthetic oligonucleotide
  Target: DMPK; (+) strand; PAM type: NRG; PAM sequence: AGG
caatagcccctcctctgctt

SEQ ID NO: 12579 - DNA, 20 bp, Artificial Sequence
  Description of Artificial Sequence: Synthetic oligonucleotide
  Target: DMPK; (+) strand; PAM type: NRG; PAM sequence: AAG
gcccctcctctgcttaggaa

SEQ ID NO: 12580 - DNA, 20 bp, Artificial Sequence
  Description of Artificial Sequence: Synthetic oligonucleotide
  Target: DMPK; (+) strand; PAM type: NRG; PAM sequence: TGG
gaaaagccctgcccctctcc

SEQ ID NO: 12581 - DNA, 20 bp, Artificial Sequence
  Description of Artificial Sequence: Synthetic oligonucleotide
  Target: DMPK; (+) strand; PAM type: NRG; PAM sequence: TGG
ccctgcccctctcctggcct

SEQ ID NO: 12582 - DNA, 20 bp, Artificial Sequence
  Description of Artificial Sequence: Synthetic oligonucleotide
  Target: DMPK; (+) strand; PAM type: NRG; PAM sequence: GGG
cctgcccctctcctggcctt

SEQ ID NO: 12583 - DNA, 20 bp, Artificial Sequence
  Description of Artificial Sequence: Synthetic oligonucleotide
  Target: DMPK; (+) strand; PAM type: NRG; PAM sequence: TGG
ctctcctggccttgggcccc

SEQ ID NO: 12584 - DNA, 20 bp, Artificial Sequence
  Description of Artificial Sequence: Synthetic oligonucleotide
  Target: DMPK; (+) strand; PAM type: NRG; PAM sequence: GGG
tctcctggccttgggcccct

SEQ ID NO: 12585 - DNA, 20 bp, Artificial Sequence
  Description of Artificial Sequence: Synthetic oligonucleotide
  Target: DMPK; (+) strand; PAM type: NRG; PAM sequence: GAG
tcctggccttgggcccctgg

SEQ ID NO: 12586 - DNA, 20 bp, Artificial Sequence
  Description of Artificial Sequence: Synthetic oligonucleotide
  Target: DMPK; (+) strand; PAM type: NRG; PAM sequence: CAG
tgctctttctaaaccttctg

SEQ ID NO: 12587 - DNA, 20 bp, Artificial Sequence
  Description of Artificial Sequence: Synthetic oligonucleotide
  Target: DMPK; (+) strand; PAM type: NRG; PAM sequence: AGG
gctctttctaaaccttctgc

SEQ ID NO: 12588 - DNA, 20 bp, Artificial Sequence
  Description of Artificial Sequence: Synthetic oligonucleotide
  Target: DMPK; (+) strand; PAM type: NRG; PAM sequence: GGG
ctctttctaaaccttctgca

SEQ ID NO: 12589 - DNA, 20 bp, Artificial Sequence
  Description of Artificial Sequence: Synthetic oligonucleotide
  Target: DMPK; (+) strand; PAM type: NRG; PAM sequence: TGG
ctaaaccttctgcagggact

SEQ ID NO: 12590 - DNA, 20 bp, Artificial Sequence
  Description of Artificial Sequence: Synthetic oligonucleotide
  Target: DMPK; (+) strand; PAM type: NRG; PAM sequence: GGG
taaaccttctgcagggactt

SEQ ID NO: 12591 - DNA, 20 bp, Artificial Sequence
  Description of Artificial Sequence: Synthetic oligonucleotide
  Target: DMPK; (+) strand; PAM type: NRG; PAM sequence: GGG
aaaccttctgcagggacttg

SEQ ID NO: 12592 - DNA, 20 bp, Artificial Sequence
  Description of Artificial Sequence: Synthetic oligonucleotide
  Target: DMPK; (+) strand; PAM type: NRG; PAM sequence: CAG
ttctgcagggacttggggtc

SEQ ID NO: 12593 - DNA, 20 bp, Artificial Sequence
  Description of Artificial Sequence: Synthetic oligonucleotide
  Target: DMPK; (+) strand; PAM type: NRG; PAM sequence: TAG
gggtccagacccccatgttc

SEQ ID NO: 12594 - DNA, 20 bp, Artificial Sequence
  Description of Artificial Sequence: Synthetic oligonucleotide
  Target: DMPK; (+) strand; PAM type: NRG; PAM sequence: AGG
ggtccagacccccatgttct

SEQ ID NO: 12595 - DNA, 20 bp, Artificial Sequence
  Description of Artificial Sequence: Synthetic oligonucleotide
  Target: DMPK; (+) strand; PAM type: NRG; PAM sequence: GGG
gtccagacccccatgttcta

SEQ ID NO: 12596 - DNA, 20 bp, Artificial Sequence
  Description of Artificial Sequence: Synthetic oligonucleotide
  Target: DMPK; (+) strand; PAM type: NRG; PAM sequence: CAG
agacccccatgttctagggt

SEQ ID NO: 12597 - DNA, 20 bp, Artificial Sequence
  Description of Artificial Sequence: Synthetic oligonucleotide
  Target: DMPK; (+) strand; PAM type: NRG; PAM sequence: CAG
cccttgacatgtgaccgctg

SEQ ID NO: 12598 - DNA, 20 bp, Artificial Sequence
  Description of Artificial Sequence: Synthetic oligonucleotide
  Target: DMPK; (+) strand; PAM type: NRG; PAM sequence: CAG
ccgctgcagacccctcttct

SEQ ID NO: 12599 - DNA, 20 bp, Artificial Sequence
  Description of Artificial Sequence: Synthetic oligonucleotide
  Target: DMPK; (+) strand; PAM type: NRG; PAM sequence: AGG
cgctgcagacccctcttctc

SEQ ID NO: 12600 - DNA, 20 bp, Artificial Sequence
  Description of Artificial Sequence: Synthetic oligonucleotide
  Target: DMPK; (+) strand; PAM type: NRG; PAM sequence: GGG
gctgcagacccctcttctca

SEQ ID NO: 12601 - DNA, 20 bp, Artificial Sequence
  Description of Artificial Sequence: Synthetic oligonucleotide
  Target: DMPK; (+) strand; PAM type: NRG; PAM sequence: CAG
gacccctcttctcagggcct

SEQ ID NO: 12602 - DNA, 20 bp, Artificial Sequence
  Description of Artificial Sequence: Synthetic oligonucleotide
  Target: DMPK; (+) strand; PAM type: NRG; PAM sequence: AGG
acccctcttctcagggcctc

SEQ ID NO: 12603 - DNA, 20 bp, Artificial Sequence
  Description of Artificial Sequence: Synthetic oligonucleotide
  Target: DMPK; (+) strand; PAM type: NRG; PAM sequence: CAG
ctcttctcagggcctcagga

SEQ ID NO: 12604 - DNA, 20 bp, Artificial Sequence
  Description of Artificial Sequence: Synthetic oligonucleotide
  Target: DMPK; (+) strand; PAM type: NRG; PAM sequence: AGG
tcttctcagggcctcaggac

SEQ ID NO: 12605 - DNA, 20 bp, Artificial Sequence
  Description of Artificial Sequence: Synthetic oligonucleotide
  Target: DMPK; (+) strand; PAM type: NRG; PAM sequence: GGG
cttctcagggcctcaggaca

SEQ ID NO: 12606 - DNA, 20 bp, Artificial Sequence
  Description of Artificial Sequence: Synthetic oligonucleotide
  Target: DMPK; (+) strand; PAM type: NRG; PAM sequence: GAG
tctcagggcctcaggacagg

SEQ ID NO: 12607 - DNA, 20 bp, Artificial Sequence
  Description of Artificial Sequence: Synthetic oligonucleotide
  Target: DMPK; (+) strand; PAM type: NRG; PAM sequence: AGG
ctcagggcctcaggacaggg

SEQ ID NO: 12608 - DNA, 20 bp, Artificial Sequence
  Description of Artificial Sequence: Synthetic oligonucleotide
  Target: DMPK; (+) strand; PAM type: NRG; PAM sequence: TGG
ggacagggaggccgacctga

SEQ ID NO: 12609 - DNA, 20 bp, Artificial Sequence
  Description of Artificial Sequence: Synthetic oligonucleotide
  Target: DMPK; (+) strand; PAM type: NRG; PAM sequence: GGG
gacagggaggccgacctgat

SEQ ID NO: 12610 - DNA, 20 bp, Artificial Sequence
  Description of Artificial Sequence: Synthetic oligonucleotide
  Target: DMPK; (+) strand; PAM type: NRG; PAM sequence: GGG
acagggaggccgacctgatg

SEQ ID NO: 12611 - DNA, 20 bp, Artificial Sequence
  Description of Artificial Sequence: Synthetic oligonucleotide
  Target: DMPK; (+) strand; PAM type: NRG; PAM sequence: GAG
agggaggccgacctgatggg

SEQ ID NO: 12612 - DNA, 20 bp, Artificial Sequence
  Description of Artificial Sequence: Synthetic oligonucleotide
  Target: DMPK; (+) strand; PAM type: NRG; PAM sequence: TGG
gacctgatggggagactgct

SEQ ID NO: 12613 - DNA, 20 bp, Artificial Sequence
  Description of Artificial Sequence: Synthetic oligonucleotide
  Target: DMPK; (+) strand; PAM type: NRG; PAM sequence: TGG
atggggagactgcttggctc

SEQ ID NO: 12614 - DNA, 20 bp, Artificial Sequence
  Description of Artificial Sequence: Synthetic oligonucleotide
  Target: DMPK; (+) strand; PAM type: NRG; PAM sequence: CAG
cttggctctggccacctcca

SEQ ID NO: 12615 - DNA, 20 bp, Artificial Sequence
  Description of Artificial Sequence: Synthetic oligonucleotide
  Target: DMPK; (+) strand; PAM type: NRG; PAM sequence: TGG
tctggccacctccacagatg

SEQ ID NO: 12616 - DNA, 20 bp, Artificial Sequence
  Description of Artificial Sequence: Synthetic oligonucleotide
  Target: DMPK; (+) strand; PAM type: NRG; PAM sequence: AAG
acctccacagatgtggtcct

SEQ ID NO: 12617 - DNA, 20 bp, Artificial Sequence
  Description of Artificial Sequence: Synthetic oligonucleotide
  Target: DMPK; (+) strand; PAM type: NRG; PAM sequence: TGG
cacagatgtggtcctaagac

SEQ ID NO: 12618 - DNA, 20 bp, Artificial Sequence
  Description of Artificial Sequence: Synthetic oligonucleotide
  Target: DMPK; (+) strand; PAM type: NRG; PAM sequence: GGG
acagatgtggtcctaagact

SEQ ID NO: 12619 - DNA, 20 bp, Artificial Sequence
  Description of Artificial Sequence: Synthetic oligonucleotide
  Target: DMPK; (+) strand; PAM type: NRG; PAM sequence: TGG
tgtggtcctaagactgggca

SEQ ID NO: 12620 - DNA, 20 bp, Artificial Sequence
  Description of Artificial Sequence: Synthetic oligonucleotide
  Target: DMPK; (+) strand; PAM type: NRG; PAM sequence: GGG
gtggtcctaagactgggcat

SEQ ID NO: 12621 - DNA, 20 bp, Artificial Sequence
  Description of Artificial Sequence: Synthetic oligonucleotide
  Target: DMPK; (+) strand; PAM type: NRG; PAM sequence: AAG
aagactgggcatgggacccc

SEQ ID NO: 12622 - DNA, 20 bp, Artificial Sequence
  Description of Artificial Sequence: Synthetic oligonucleotide
  Target: DMPK; (+) strand; PAM type: NRG; PAM sequence: TGG
ctgggcatgggaccccaaga

SEQ ID NO: 12623 - DNA, 20 bp, Artificial Sequence
  Description of Artificial Sequence: Synthetic oligonucleotide
  Target: DMPK; (+) strand; PAM type: NRG; PAM sequence: GAG
ggaccccaagatggcaactt

SEQ ID NO: 12624 - DNA, 20 bp, Artificial Sequence
  Description of Artificial Sequence: Synthetic oligonucleotide
  Target: DMPK; (+) strand; PAM type: NRG; PAM sequence: AGG
gaccccaagatggcaacttg

SEQ ID NO: 12625 - DNA, 20 bp, Artificial Sequence
  Description of Artificial Sequence: Synthetic oligonucleotide
  Target: DMPK; (+) strand; PAM type: NRG; PAM sequence: CAG
ccaagatggcaacttgaggt

SEQ ID NO: 12626 - DNA, 20 bp, Artificial Sequence
  Description of Artificial Sequence: Synthetic oligonucleotide
  Target: DMPK; (+) strand; PAM type: NRG; PAM sequence: CAG
tgaggtcagcacaccccact

SEQ ID NO: 12627 - DNA, 20 bp, Artificial Sequence
  Description of Artificial Sequence: Synthetic oligonucleotide
  Target: DMPK; (+) strand; PAM type: NRG; PAM sequence: TGG
cagcacaccccactcagctg

SEQ ID NO: 12628 - DNA, 20 bp, Artificial Sequence
  Description of Artificial Sequence: Synthetic oligonucleotide
  Target: DMPK; (+) strand; PAM type: NRG; PAM sequence: GGG
agcacaccccactcagctgt

SEQ ID NO: 12629 - DNA, 20 bp, Artificial Sequence
  Description of Artificial Sequence: Synthetic oligonucleotide
  Target: DMPK; (+) strand; PAM type: NRG; PAM sequence: AAG
acaccccactcagctgtggg

SEQ ID NO: 12630 - DNA, 20 bp, Artificial Sequence
  Description of Artificial Sequence: Synthetic oligonucleotide
  Target: DMPK; (+) strand; PAM type: NRG; PAM sequence: AGG
caccccactcagctgtggga

SEQ ID NO: 12631 - DNA, 20 bp, Artificial Sequence
  Description of Artificial Sequence: Synthetic oligonucleotide
  Target: DMPK; (+) strand; PAM type: NRG; PAM sequence: GGG
accccactcagctgtgggaa

SEQ ID NO: 12632 - DNA, 20 bp, Artificial Sequence
  Description of Artificial Sequence: Synthetic oligonucleotide
  Target: DMPK; (+) strand; PAM type: NRG; PAM sequence: GGG
ccccactcagctgtgggaag

SEQ ID NO: 12633 - DNA, 20 bp, Artificial Sequence
  Description of Artificial Sequence: Synthetic oligonucleotide
  Target: DMPK; (+) strand; PAM type: NRG; PAM sequence: CAG
actcagctgtgggaagggga

SEQ ID NO: 12634 - DNA, 20 bp, Artificial Sequence
  Description of Artificial Sequence: Synthetic oligonucleotide
  Target: DMPK; (+) strand; PAM type: NRG; PAM sequence: TGG
ggaaggggacagctcctccc

SEQ ID NO: 12635 - DNA, 20 bp, Artificial Sequence
  Description of Artificial Sequence: Synthetic oligonucleotide
  Target: DMPK; (+) strand; PAM type: NRG; PAM sequence: GGG
gaaggggacagctcctccct

SEQ ID NO: 12636 - DNA, 20 bp, Artificial Sequence
  Description of Artificial Sequence: Synthetic oligonucleotide
  Target: DMPK; (+) strand; PAM type: NRG; PAM sequence: GGG
aaggggacagctcctccctg

SEQ ID NO: 12637 - DNA, 20 bp, Artificial Sequence
  Description of Artificial Sequence: Synthetic oligonucleotide
  Target: DMPK; (+) strand; PAM type: NRG; PAM sequence: AAG
cagctcctccctggggtatg

SEQ ID NO: 12638 - DNA, 20 bp, Artificial Sequence
  Description of Artificial Sequence: Synthetic oligonucleotide
  Target: DMPK; (+) strand; PAM type: NRG; PAM sequence: TGG
ctcctccctggggtatgaag

SEQ ID NO: 12639 - DNA, 20 bp, Artificial Sequence
  Description of Artificial Sequence: Synthetic oligonucleotide
  Target: DMPK; (+) strand; PAM type: NRG; PAM sequence: CAG
agtggctgtcccctccaacc

SEQ ID NO: 12640 - DNA, 20 bp, Artificial Sequence
  Description of Artificial Sequence: Synthetic oligonucleotide
  Target: DMPK; (+) strand; PAM type: NRG; PAM sequence: CAG
ggctgtcccctccaacccag

SEQ ID NO: 12641 - DNA, 20 bp, Artificial Sequence
  Description of Artificial Sequence: Synthetic oligonucleotide
  Target: DMPK; (+) strand; PAM type: NRG; PAM sequence: TGG
caacccagcagtccctcctg

SEQ ID NO: 12642 - DNA, 20 bp, Artificial Sequence
  Description of Artificial Sequence: Synthetic oligonucleotide
  Target: DMPK; (+) strand; PAM type: NRG; PAM sequence: GGG
aacccagcagtccctcctgt

SEQ ID NO: 12643 - DNA, 20 bp, Artificial Sequence
  Description of Artificial Sequence: Synthetic oligonucleotide
  Target: DMPK; (+) strand; PAM type: NRG; PAM sequence: CGG
cagtccctcctgtgggaaca

SEQ ID NO: 12644 - DNA, 20 bp, Artificial Sequence
  Description of Artificial Sequence: Synthetic oligonucleotide
  Target: DMPK; (+) strand; PAM type: NRG; PAM sequence: CAG
cctcctgtgggaacacggct

SEQ ID NO: 12645 - DNA, 20 bp, Artificial Sequence
  Description of Artificial Sequence: Synthetic oligonucleotide
  Target: DMPK; (+) strand; PAM type: NRG; PAM sequence: AGG
ctcctgtgggaacacggctc

SEQ ID NO: 12646 - DNA, 20 bp, Artificial Sequence
  Description of Artificial Sequence: Synthetic oligonucleotide
  Target: DMPK; (+) strand; PAM type: NRG; PAM sequence: TAG
tgggaacacggctcaggacc

SEQ ID NO: 12647 - DNA, 20 bp, Artificial Sequence
  Description of Artificial Sequence: Synthetic oligonucleotide
  Target: DMPK; (+) strand; PAM type: NRG; PAM sequence: TGG
ggctcaggacctagctatcc

SEQ ID NO: 12648 - DNA, 20 bp, Artificial Sequence
  Description of Artificial Sequence: Synthetic oligonucleotide
  Target: DMPK; (+) strand; PAM type: NRG; PAM sequence: TGG
agctatcctggacatgcgcc

SEQ ID NO: 12649 - DNA, 20 bp, Artificial Sequence
  Description of Artificial Sequence: Synthetic oligonucleotide
  Target: DMPK; (+) strand; PAM type: NRG; PAM sequence: GGG
gctatcctggacatgcgcct

SEQ ID NO: 12650 - DNA, 20 bp, Artificial Sequence
  Description of Artificial Sequence: Synthetic oligonucleotide
  Target: DMPK; (+) strand; PAM type: NRG; PAM sequence: TAG
gacatgcgcctgggttctaa

SEQ ID NO: 12651 - DNA, 20 bp, Artificial Sequence
  Description of Artificial Sequence: Synthetic oligonucleotide
  Target: DMPK; (+) strand; PAM type: NRG; PAM sequence: GAG
catgcgcctgggttctaata

SEQ ID NO: 12652 - DNA, 20 bp, Artificial Sequence
  Description of Artificial Sequence: Synthetic oligonucleotide
  Target: DMPK; (+) strand; PAM type: NRG; PAM sequence: AGG
atgcgcctgggttctaatag

SEQ ID NO: 12653 - DNA, 20 bp, Artificial Sequence
  Description of Artificial Sequence: Synthetic oligonucleotide
  Target: DMPK; (+) strand; PAM type: NRG; PAM sequence: TGG
gcctgggttctaatagagga

SEQ ID NO: 12654 - DNA, 20 bp, Artificial Sequence
  Description of Artificial Sequence: Synthetic oligonucleotide
  Target: DMPK; (+) strand; PAM type: NRG; PAM sequence: GGG
cctgggttctaatagaggat

SEQ ID NO: 12655 - DNA, 20 bp, Artificial Sequence
  Description of Artificial Sequence: Synthetic oligonucleotide
  Target: DMPK; (+) strand; PAM type: NRG; PAM sequence: CAG
ttcaatcctgacccaccgtt

SEQ ID NO: 12656 - DNA, 20 bp, Artificial Sequence
  Description of Artificial Sequence: Synthetic oligonucleotide
  Target: DMPK; (+) strand; PAM type: NRG; PAM sequence: AGG
tcaatcctgacccaccgttc

SEQ ID NO: 12657 - DNA, 20 bp, Artificial Sequence
  Description of Artificial Sequence: Synthetic oligonucleotide
  Target: DMPK; (+) strand; PAM type: NRG; PAM sequence: CAG
gacccaccgttcaggccccg

SEQ ID NO: 12658 - DNA, 20 bp, Artificial Sequence
  Description of Artificial Sequence: Synthetic oligonucleotide
  Target: DMPK; (+) strand; PAM type: NRG; PAM sequence: CGG
ccaccgttcaggccccgcag

SEQ ID NO: 12659 - DNA, 20 bp, Artificial Sequence
  Description of Artificial Sequence: Synthetic oligonucleotide
  Target: DMPK; (+) strand; PAM type: NRG; PAM sequence: CAG
gttcaggccccgcagcggtt

SEQ ID NO: 12660 - DNA, 20 bp, Artificial Sequence
  Description of Artificial Sequence: Synthetic oligonucleotide
  Target: DMPK; (+) strand; PAM type: NRG; PAM sequence: AAG
ccccgcagcggttcagaatc

SEQ ID NO: 12661 - DNA, 20 bp, Artificial Sequence
  Description of Artificial Sequence: Synthetic oligonucleotide
  Target: DMPK; (+) strand; PAM type: NRG; PAM sequence: TGG
gcagcggttcagaatcaagc

SEQ ID NO: 12662 - DNA, 20 bp, Artificial Sequence
  Description of Artificial Sequence: Synthetic oligonucleotide
  Target: DMPK; (+) strand; PAM type: NRG; PAM sequence: GAG
agcggttcagaatcaagctg

SEQ ID NO: 12663 - DNA, 20 bp, Artificial Sequence
  Description of Artificial Sequence: Synthetic oligonucleotide
  Target: DMPK; (+) strand; PAM type: NRG; PAM sequence: AAG
agctggagttcattaatgat

SEQ ID NO: 12664 - DNA, 20 bp, Artificial Sequence
  Description of Artificial Sequence: Synthetic oligonucleotide
  Target: DMPK; (+) strand; PAM type: NRG; PAM sequence: AGG
gctggagttcattaatgata

SEQ ID NO: 12665 - DNA, 20 bp, Artificial Sequence
  Description of Artificial Sequence: Synthetic oligonucleotide
  Target: DMPK; (+) strand; PAM type: NRG; PAM sequence: TAG
agttcattaatgataaggta

SEQ ID NO: 12666 - DNA, 20 bp, Artificial Sequence
  Description of Artificial Sequence: Synthetic oligonucleotide
  Target: DMPK; (+) strand; PAM type: NRG; PAM sequence: CAG
atagtatgtgtaatgttgtc

SEQ ID NO: 12667 - DNA, 20 bp, Artificial Sequence
  Description of Artificial Sequence: Synthetic oligonucleotide
  Target: DMPK; (+) strand; PAM type: NRG; PAM sequence: AAG
gtaatgttgtccagtaataa

SEQ ID NO: 12668 - DNA, 20 bp, Artificial Sequence
  Description of Artificial Sequence: Synthetic oligonucleotide
  Target: DMPK; (+) strand; PAM type: NRG; PAM sequence: TAG
gtccagtaataaaagctgac

SEQ ID NO: 12669 - DNA, 20 bp, Artificial Sequence
  Description of Artificial Sequence: Synthetic oligonucleotide
  Target: DMPK; (+) strand; PAM type: NRG; PAM sequence: TAG
tagaaaaccaactgttctct

SEQ ID NO: 12670 - DNA, 20 bp, Artificial Sequence
  Description of Artificial Sequence: Synthetic oligonucleotide
  Target: DMPK; (+) strand; PAM type: NRG; PAM sequence: AAG
accaactgttctcttagaca

SEQ ID NO: 12671 - DNA, 20 bp, Artificial Sequence
  Description of Artificial Sequence: Synthetic oligonucleotide
  Target: DMPK; (+) strand; PAM type: NRG; PAM sequence: TAG
aactgttctcttagacaaag

SEQ ID NO: 12672 - DNA, 20 bp, Artificial Sequence
  Description of Artificial Sequence: Synthetic oligonucleotide
  Target: DMPK; (+) strand; PAM type: NRG; PAM sequence: GAG
tctcttagacaaagtagcat

SEQ ID NO: 12673 - DNA, 20 bp, Artificial Sequence
  Description of Artificial Sequence: Synthetic oligonucleotide
  Target: DMPK; (+) strand; PAM type: NRG; PAM sequence: AGG
ctcttagacaaagtagcatg

SEQ ID NO: 12674 - DNA, 20 bp, Artificial Sequence
  Description of Artificial Sequence: Synthetic oligonucleotide
  Target: DMPK; (+) strand; PAM type: NRG; PAM sequence: AAG
ttagacaaagtagcatgagg

SEQ ID NO: 12675 - DNA, 20 bp, Artificial Sequence
  Description of Artificial Sequence: Synthetic oligonucleotide
  Target: DMPK; (+) strand; PAM type: NRG; PAM sequence: AGG
tagacaaagtagcatgagga

SEQ ID NO: 12676 - DNA, 20 bp, Artificial Sequence
  Description of Artificial Sequence: Synthetic oligonucleotide
  Target: DMPK; (+) strand; PAM type: NRG; PAM sequence: GGG
agacaaagtagcatgaggaa

SEQ ID NO: 12677 - DNA, 20 bp, Artificial Sequence
  Description of Artificial Sequence: Synthetic oligonucleotide
  Target: DMPK; (+) strand; PAM type: NRG; PAM sequence: GGG
gacaaagtagcatgaggaag

SEQ ID NO: 12678 - DNA, 20 bp, Artificial Sequence
  Description of Artificial Sequence: Synthetic oligonucleotide
  Target: DMPK; (+) strand; PAM type: NRG; PAM sequence: CAG
tccactatttaaacatgtgt

SEQ ID NO: 12679 - DNA, 20 bp, Artificial Sequence
  Description of Artificial Sequence: Synthetic oligonucleotide
  Target: DMPK; (+) strand; PAM type: NRG; PAM sequence: GAG
acatgtgtcagtacacgtgt

SEQ ID NO: 12680 - DNA, 20 bp, Artificial Sequence
  Description of Artificial Sequence: Synthetic oligonucleotide
  Target: DMPK; (+) strand; PAM type: NRG; PAM sequence: CAG
gtgtcagtacacgtgtgagc

SEQ ID NO: 12681 - DNA, 20 bp, Artificial Sequence
  Description of Artificial Sequence: Synthetic oligonucleotide
  Target: DMPK; (+) strand; PAM type: NRG; PAM sequence: AGG
tgtcagtacacgtgtgagcc

SEQ ID NO: 12682 - DNA, 20 bp, Artificial Sequence
  Description of Artificial Sequence: Synthetic oligonucleotide
  Target: DMPK; (+) strand; PAM type: NRG; PAM sequence: GGG
gtcagtacacgtgtgagcca

SEQ ID NO: 12683 - DNA, 20 bp, Artificial Sequence
  Description of Artificial Sequence: Synthetic oligonucleotide
  Target: DMPK; (+) strand; PAM type: NRG; PAM sequence: TGG
agccagggaccactgccatc

SEQ ID NO: 12684 - DNA, 20 bp, Artificial Sequence
  Description of Artificial Sequence: Synthetic oligonucleotide
  Target: DMPK; (+) strand; PAM type: NRG; PAM sequence: GAG
agggaccactgccatctggt

SEQ ID NO: 12685 - DNA, 20 bp, Artificial Sequence
  Description of Artificial Sequence: Synthetic oligonucleotide
  Target: DMPK; (+) strand; PAM type: NRG; PAM sequence: GAG
ctgccatctggtgagctcac

SEQ ID NO: 12686 - DNA, 20 bp, Artificial Sequence
  Description of Artificial Sequence: Synthetic oligonucleotide
  Target: DMPK; (+) strand; PAM type: NRG; PAM sequence: AAG
ttttctaatttacttgtgat

SEQ ID NO: 12687 - DNA, 20 bp, Artificial Sequence
  Description of Artificial Sequence: Synthetic oligonucleotide
  Target: DMPK; (+) strand; PAM type: NRG; PAM sequence: GAG
gtgtaattaatacttttgtt

SEQ ID NO: 12688 - DNA, 20 bp, Artificial Sequence
  Description of Artificial Sequence: Synthetic oligonucleotide
  Target: DMPK; (+) strand; PAM type: NRG; PAM sequence: CAG
attaatacttttgttgagac

SEQ ID NO: 12689 - DNA, 20 bp, Artificial Sequence
  Description of Artificial Sequence: Synthetic oligonucleotide
  Target: DMPK; (+) strand; PAM type: NRG; PAM sequence: AGG
ttaatacttttgttgagacc

SEQ ID NO: 12690 - DNA, 20 bp, Artificial Sequence
  Description of Artificial Sequence: Synthetic oligonucleotide
  Target: DMPK; (+) strand; PAM type: NRG; PAM sequence: TAG
ccaggtctcactttgttgcc

SEQ ID NO: 12691 - DNA, 20 bp, Artificial Sequence
  Description of Artificial Sequence: Synthetic oligonucleotide
  Target: DMPK; (+) strand; PAM type: NRG; PAM sequence: AGG
caggtctcactttgttgcct

SEQ ID NO: 12692 - DNA, 20 bp, Artificial Sequence
  Description of Artificial Sequence: Synthetic oligonucleotide
  Target: DMPK; (+) strand; PAM type: NRG; PAM sequence: TGG
tctcactttgttgcctaggc

SEQ ID NO: 12693 - DNA, 20 bp, Artificial Sequence
  Description of Artificial Sequence: Synthetic oligonucleotide
  Target: DMPK; (+) strand; PAM type: NRG; PAM sequence: TGG
gcctaggctggaatctatca

SEQ ID NO: 12694 - DNA, 20 bp, Artificial Sequence
  Description of Artificial Sequence: Synthetic oligonucleotide
  Target: DMPK; (+) strand; PAM type: NRG; PAM sequence: AAG
gaatctatcatggctcactg

SEQ ID NO: 12695 - DNA, 20 bp, Artificial Sequence
  Description of Artificial Sequence: Synthetic oligonucleotide
  Target: DMPK; (+) strand; PAM type: NRG; PAM sequence: CAG
ctcactgaagcctcaaactc

SEQ ID NO: 12696 - DNA, 20 bp, Artificial Sequence
  Description of Artificial Sequence: Synthetic oligonucleotide
  Target: DMPK; (+) strand; PAM type: NRG; PAM sequence: AGG
tcactgaagcctcaaactcc

SEQ ID NO: 12697 - DNA, 20 bp, Artificial Sequence
  Description of Artificial Sequence: Synthetic oligonucleotide
  Target: DMPK; (+) strand; PAM type: NRG; PAM sequence: AAG
aagcctcaaactccaggctc

SEQ ID NO: 12698 - DNA, 20 bp, Artificial Sequence
  Description of Artificial Sequence: Synthetic oligonucleotide
  Target: DMPK; (+) strand; PAM type: NRG; PAM sequence: CAG
ctcaagtgattctcctactt

SEQ ID NO: 12699 - DNA, 20 bp, Artificial Sequence
  Description of Artificial Sequence: Synthetic oligonucleotide
  Target: DMPK; (+) strand; PAM type: NRG; PAM sequence: GAG
ttctcctacttcagactcct

SEQ ID NO: 12700 - DNA, 20 bp, Artificial Sequence
  Description of Artificial Sequence: Synthetic oligonucleotide
  Target: DMPK; (+) strand; PAM type: NRG; PAM sequence: TAG
tcctacttcagactcctgag

SEQ ID NO: 12701 - DNA, 20 bp, Artificial Sequence
  Description of Artificial Sequence: Synthetic oligonucleotide
  Target: DMPK; (+) strand; PAM type: NRG; PAM sequence: TAG
acttcagactcctgagtagc

SEQ ID NO: 12702 - DNA, 20 bp, Artificial Sequence
  Description of Artificial Sequence: Synthetic oligonucleotide
  Target: DMPK; (+) strand; PAM type: NRG; PAM sequence: AGG
cttcagactcctgagtagct

SEQ ID NO: 12703 - DNA, 20 bp, Artificial Sequence
  Description of Artificial Sequence: Synthetic oligonucleotide
  Target: DMPK; (+) strand; PAM type: NRG; PAM sequence: CAG
ctcctgagtagctaggactg

SEQ ID NO: 12704 - DNA, 20 bp, Artificial Sequence
  Description of Artificial Sequence: Synthetic oligonucleotide
  Target: DMPK; (+) strand; PAM type: NRG; PAM sequence: AGG
tcctgagtagctaggactgc

SEQ ID NO: 12705 - DNA, 20 bp, Artificial Sequence
  Description of Artificial Sequence: Synthetic oligonucleotide
  Target: DMPK; (+) strand; PAM type: NRG; PAM sequence: CAG
agtagctaggactgcaggca

SEQ ID NO: 12706 - DNA, 20 bp, Artificial Sequence
  Description of Artificial Sequence: Synthetic oligonucleotide
  Target: DMPK; (+) strand; PAM type: NRG; PAM sequence: TGG
caggcacagaccaccatgcc

SEQ ID NO: 12707 - DNA, 20 bp, Artificial Sequence
  Description of Artificial Sequence: Synthetic oligonucleotide
  Target: DMPK; (+) strand; PAM type: NRG; PAM sequence: TAG
acgattttttcaattttttg

SEQ ID NO: 12708 - DNA, 20 bp, Artificial Sequence
  Description of Artificial Sequence: Synthetic oligonucleotide
  Target: DMPK; (+) strand; PAM type: NRG; PAM sequence: GAG
gattttttcaattttttgta

SEQ ID NO: 12709 - DNA, 20 bp, Artificial Sequence
  Description of Artificial Sequence: Synthetic oligonucleotide
  Target: DMPK; (+) strand; PAM type: NRG; PAM sequence: CAG
ttttcaattttttgtagaga

SEQ ID NO: 12710 - DNA, 20 bp, Artificial Sequence
  Description of Artificial Sequence: Synthetic oligonucleotide
  Target: DMPK; (+) strand; PAM type: NRG; PAM sequence: AGG
tttcaattttttgtagagac

SEQ ID NO: 12711 - DNA, 20 bp, Artificial Sequence
  Description of Artificial Sequence: Synthetic oligonucleotide
  Target: DMPK; (+) strand; PAM type: NRG; PAM sequence: GGG
ttcaattttttgtagagaca

SEQ ID NO: 12712 - DNA, 20 bp, Artificial Sequence
  Description of Artificial Sequence: Synthetic oligonucleotide
  Target: DMPK; (+) strand; PAM type: NRG; PAM sequence: CAG
cagggtctcattatgttgct

SEQ ID NO: 12713 - DNA, 20 bp, Artificial Sequence
  Description of Artificial Sequence: Synthetic oligonucleotide
  Target: DMPK; (+) strand; PAM type: NRG; PAM sequence: AGG
agggtctcattatgttgctc

SEQ ID NO: 12714 - DNA, 20 bp, Artificial Sequence
  Description of Artificial Sequence: Synthetic oligonucleotide
  Target: DMPK; (+) strand; PAM type: NRG; PAM sequence: TGG
tctcattatgttgctcaggc

SEQ ID NO: 12715 - DNA, 20 bp, Artificial Sequence
  Description of Artificial Sequence: Synthetic oligonucleotide
  Target: DMPK; (+) strand; PAM type: NRG; PAM sequence: TGG
tcaggctggtcttgaactcc

SEQ ID NO: 12716 - DNA, 20 bp, Artificial Sequence
  Description of Artificial Sequence: Synthetic oligonucleotide
  Target: DMPK; (+) strand; PAM type: NRG; PAM sequence: GGG
caggctggtcttgaactcct

SEQ ID NO: 12717 - DNA, 20 bp, Artificial Sequence
  Description of Artificial Sequence: Synthetic oligonucleotide
  Target: DMPK; (+) strand; PAM type: NRG; PAM sequence: AAG
ggtcttgaactcctgggctg

SEQ ID NO: 12718 - DNA, 20 bp, Artificial Sequence
  Description of Artificial Sequence: Synthetic oligonucleotide
  Target: DMPK; (+) strand; PAM type: NRG; PAM sequence: CAG
ctgaagcaatccgtccactt

SEQ ID NO: 12719 - DNA, 20 bp, Artificial Sequence
  Description of Artificial Sequence: Synthetic oligonucleotide
  Target: DMPK; (+) strand; PAM type: NRG; PAM sequence: AAG
ccgtccacttcagcctccca

SEQ ID NO: 12720 - DNA, 20 bp, Artificial Sequence
  Description of Artificial Sequence: Synthetic oligonucleotide
  Target: DMPK; (+) strand; PAM type: NRG; PAM sequence: TGG
acttcagcctcccaaagtgc

SEQ ID NO: 12721 - DNA, 20 bp, Artificial Sequence
  Description of Artificial Sequence: Synthetic oligonucleotide
  Target: DMPK; (+) strand; PAM type: NRG; PAM sequence: GGG
cttcagcctcccaaagtgct

SEQ ID NO: 12722 - DNA, 20 bp, Artificial Sequence
  Description of Artificial Sequence: Synthetic oligonucleotide
  Target: DMPK; (+) strand; PAM type: NRG; PAM sequence: AAG
tcccaaagtgctgggattcc

SEQ ID NO: 12723 - DNA, 20 bp, Artificial Sequence
  Description of Artificial Sequence: Synthetic oligonucleotide
  Target: DMPK; (+) strand; PAM type: NRG; PAM sequence: GAG
agtgctgggattccaagcgt

SEQ ID NO: 12724 - DNA, 20 bp, Artificial Sequence
  Description of Artificial Sequence: Synthetic oligonucleotide
  Target: DMPK; (+) strand; PAM type: NRG; PAM sequence: CAG
caagcgtgagccaccatgcc

SEQ ID NO: 12725 - DNA, 20 bp, Artificial Sequence
  Description of Artificial Sequence: Synthetic oligonucleotide
  Target: DMPK; (+) strand; PAM type: NRG; PAM sequence: TAG
accatgcccagcctgtaaat

SEQ ID NO: 12726 - DNA, 20 bp, Artificial Sequence
  Description of Artificial Sequence: Synthetic oligonucleotide
  Target: DMPK; (+) strand; PAM type: NRG; PAM sequence: GAG
actttttttttttttttttt

SEQ ID NO: 12727 - DNA, 20 bp, Artificial Sequence
  Description of Artificial Sequence: Synthetic oligonucleotide
  Target: DMPK; (+) strand; PAM type: NRG; PAM sequence: AAG
ttttttttttttttgagatg

SEQ ID NO: 12728 - DNA, 20 bp, Artificial Sequence
  Description of Artificial Sequence: Synthetic oligonucleotide
  Target: DMPK; (+) strand; PAM type: NRG; PAM sequence: CAG
gaagtttcactcttgttgcc

SEQ ID NO: 12729 - DNA, 20 bp, Artificial Sequence
  Description of Artificial Sequence: Synthetic oligonucleotide
  Target: DMPK; (+) strand; PAM type: NRG; PAM sequence: AGG
aagtttcactcttgttgccc

SEQ ID NO: 12730 - DNA, 20 bp, Artificial Sequence
  Description of Artificial Sequence: Synthetic oligonucleotide
  Target: DMPK; (+) strand; PAM type: NRG; PAM sequence: TGG
ttcactcttgttgcccaggc

SEQ ID NO: 12731 - DNA, 20 bp, Artificial Sequence
  Description of Artificial Sequence: Synthetic oligonucleotide
  Target: DMPK; (+) strand; PAM type: NRG; PAM sequence: TGG
ttgcccaggctggaatgcaa

SEQ ID NO: 12732 - DNA, 20 bp, Artificial Sequence
  Description of Artificial Sequence: Synthetic oligonucleotide
  Target: DMPK; (+) strand; PAM type: NRG; PAM sequence: CAG
ggaatgcaatggcacgatct

SEQ ID NO: 12733 - DNA, 20 bp, Artificial Sequence
  Description of Artificial Sequence: Synthetic oligonucleotide
  Target: DMPK; (+) strand; PAM type: NRG; PAM sequence: TGG
tcaccacaacctccccctcc

SEQ ID NO: 12734 - DNA, 20 bp, Artificial Sequence
  Description of Artificial Sequence: Synthetic oligonucleotide
  Target: DMPK; (+) strand; PAM type: NRG; PAM sequence: GGG
caccacaacctccccctcct

SEQ ID NO: 12735 - DNA, 20 bp, Artificial Sequence
  Description of Artificial Sequence: Synthetic oligonucleotide
  Target: DMPK; (+) strand; PAM type: NRG; PAM sequence: CAG
gggttctgattctcctgcct

SEQ ID NO: 12736 - DNA, 20 bp, Artificial Sequence
  Description of Artificial Sequence: Synthetic oligonucleotide
  Target: DMPK; (+) strand; PAM type: NRG; PAM sequence: GAG
ttctcctgcctcagcctcct

SEQ ID NO: 12737 - DNA, 20 bp, Artificial Sequence
  Description of Artificial Sequence: Synthetic oligonucleotide
  Target: DMPK; (+) strand; PAM type: NRG; PAM sequence: TAG
tcctgcctcagcctcctgag

SEQ ID NO: 12738 - DNA, 20 bp, Artificial Sequence
  Description of Artificial Sequence: Synthetic oligonucleotide
  Target: DMPK; (+) strand; PAM type: NRG; PAM sequence: TGG
gcctcagcctcctgagtagc

SEQ ID NO: 12739 - DNA, 20 bp, Artificial Sequence
  Description of Artificial Sequence: Synthetic oligonucleotide
  Target: DMPK; (+) strand; PAM type: NRG; PAM sequence: GGG
cctcagcctcctgagtagct

SEQ ID NO: 12740 - DNA, 20 bp, Artificial Sequence
  Description of Artificial Sequence: Synthetic oligonucleotide
  Target: DMPK; (+) strand; PAM type: NRG; PAM sequence: CAG
ctcctgagtagctgggatta

SEQ ID NO: 12741 - DNA, 20 bp, Artificial Sequence
  Description of Artificial Sequence: Synthetic oligonucleotide
  Target: DMPK; (+) strand; PAM type: NRG; PAM sequence: AGG
tcctgagtagctgggattac

SEQ ID NO: 12742 - DNA, 20 bp, Artificial Sequence
  Description of Artificial Sequence: Synthetic oligonucleotide
  Target: DMPK; (+) strand; PAM type: NRG; PAM sequence: TGG
caggtatatgccaccacgcc

SEQ ID NO: 12743 - DNA, 20 bp, Artificial Sequence
  Description of Artificial Sequence: Synthetic oligonucleotide
  Target: DMPK; (+) strand; PAM type: NRG; PAM sequence: TAG
gcctggctaattttgttttt

SEQ ID NO: 12744 - DNA, 20 bp, Artificial Sequence
  Description of Artificial Sequence: Synthetic oligonucleotide
  Target: DMPK; (+) strand; PAM type: NRG; PAM sequence: TAG
tggctaattttgttttttag

SEQ ID NO: 12745 - DNA, 20 bp, Artificial Sequence
  Description of Artificial Sequence: Synthetic oligonucleotide
  Target: DMPK; (+) strand; PAM type: NRG; PAM sequence: GAG
gctaattttgttttttagta

SEQ ID NO: 12746 - DNA, 20 bp, Artificial Sequence
  Description of Artificial Sequence: Synthetic oligonucleotide
  Target: DMPK; (+) strand; PAM type: NRG; PAM sequence: GAG
ttttgttttttagtagagat

SEQ ID NO: 12747 - DNA, 20 bp, Artificial Sequence
  Description of Artificial Sequence: Synthetic oligonucleotide
  Target: DMPK; (+) strand; PAM type: NRG; PAM sequence: AGG
tttgttttttagtagagatg

SEQ ID NO: 12748 - DNA, 20 bp, Artificial Sequence
  Description of Artificial Sequence: Synthetic oligonucleotide
  Target: DMPK; (+) strand; PAM type: NRG; PAM sequence: TGG
gagatgaggtttctccacgt

SEQ ID NO: 12749 - DNA, 20 bp, Artificial Sequence
  Description of Artificial Sequence: Synthetic oligonucleotide
  Target: DMPK; (+) strand; PAM type: NRG; PAM sequence: CAG
tgaggtttctccacgttggt

SEQ ID NO: 12750 - DNA, 20 bp, Artificial Sequence
  Description of Artificial Sequence: Synthetic oligonucleotide
  Target: DMPK; (+) strand; PAM type: NRG; PAM sequence: AGG
gaggtttctccacgttggtc

SEQ ID NO: 12751 - DNA, 20 bp, Artificial Sequence
  Description of Artificial Sequence: Synthetic oligonucleotide
  Target: DMPK; (+) strand; PAM type: NRG; PAM sequence: TGG
tttctccacgttggtcaggc

SEQ ID NO: 12752 - DNA, 20 bp, Artificial Sequence
  Description of Artificial Sequence: Synthetic oligonucleotide
  Target: DMPK; (+) strand; PAM type: NRG; PAM sequence: CAG
tggtctcgaactcctgacct

SEQ ID NO: 12753 - DNA, 20 bp, Artificial Sequence
  Description of Artificial Sequence: Synthetic oligonucleotide
  Target: DMPK; (+) strand; PAM type: NRG; PAM sequence: AGG
ggtctcgaactcctgacctc

SEQ ID NO: 12754 - DNA, 20 bp, Artificial Sequence
  Description of Artificial Sequence: Synthetic oligonucleotide
  Target: DMPK; (+) strand; PAM type: NRG; PAM sequence: AAG
ccacccacctcatcctccca

SEQ ID NO: 12755 - DNA, 20 bp, Artificial Sequence
  Description of Artificial Sequence: Synthetic oligonucleotide
  Target: DMPK; (+) strand; PAM type: NRG; PAM sequence: TGG
acctcatcctcccaaagcac

SEQ ID NO: 12756 - DNA, 20 bp, Artificial Sequence
  Description of Artificial Sequence: Synthetic oligonucleotide
  Target: DMPK; (+) strand; PAM type: NRG; PAM sequence: CAG
ctcccaaagcactggaatta

SEQ ID NO: 12757 - DNA, 20 bp, Artificial Sequence
  Description of Artificial Sequence: Synthetic oligonucleotide
  Target: DMPK; (+) strand; PAM type: NRG; PAM sequence: AGG
tcccaaagcactggaattac

SEQ ID NO: 12758 - DNA, 20 bp, Artificial Sequence
  Description of Artificial Sequence: Synthetic oligonucleotide
  Target: DMPK; (+) strand; PAM type: NRG; PAM sequence: GAG
agcactggaattacaggcgt

SEQ ID NO: 12759 - DNA, 20 bp, Artificial Sequence
  Description of Artificial Sequence: Synthetic oligonucleotide
  Target: DMPK; (+) strand; PAM type: NRG; PAM sequence: CGG
caggcgtgagccaccacacc

SEQ ID NO: 12760 - DNA, 20 bp, Artificial Sequence
  Description of Artificial Sequence: Synthetic oligonucleotide
  Target: DMPK; (+) strand; PAM type: NRG; PAM sequence: GAG
actttttttttttttttttt

SEQ ID NO: 12761 - DNA, 20 bp, Artificial Sequence
  Description of Artificial Sequence: Synthetic oligonucleotide
  Target: DMPK; (+) strand; PAM type: NRG; PAM sequence: CGG
ttttttttttttttttgaga

SEQ ID NO: 12762 - DNA, 20 bp, Artificial Sequence
  Description of Artificial Sequence: Synthetic oligonucleotide
  Target: DMPK; (+) strand; PAM type: NRG; PAM sequence: GAG
ttttttttttttttgagacg

SEQ ID NO: 12763 - DNA, 20 bp, Artificial Sequence
  Description of Artificial Sequence: Synthetic oligonucleotide
  Target: DMPK; (+) strand; PAM type: NRG; PAM sequence: CAG
cggagtcttgctctgtcgcc

SEQ ID NO: 12764 - DNA, 20 bp, Artificial Sequence
  Description of Artificial Sequence: Synthetic oligonucleotide
  Target: DMPK; (+) strand; PAM type: NRG; PAM sequence: AGG
ggagtcttgctctgtcgccc

SEQ ID NO: 12765 - DNA, 20 bp, Artificial Sequence
  Description of Artificial Sequence: Synthetic oligonucleotide
  Target: DMPK; (+) strand; PAM type: NRG; PAM sequence: TGG
tcttgctctgtcgcccaggc

SEQ ID NO: 12766 - DNA, 20 bp, Artificial Sequence
  Description of Artificial Sequence: Synthetic oligonucleotide
  Target: DMPK; (+) strand; PAM type: NRG; PAM sequence: GAG
ttgctctgtcgcccaggctg

SEQ ID NO: 12767 - DNA, 20 bp, Artificial Sequence
  Description of Artificial Sequence: Synthetic oligonucleotide
  Target: DMPK; (+) strand; PAM type: NRG; PAM sequence: CAG
ctgtcgcccaggctggagtg

SEQ ID NO: 12768 - DNA, 20 bp, Artificial Sequence
  Description of Artificial Sequence: Synthetic oligonucleotide
  Target: DMPK; (+) strand; PAM type: NRG; PAM sequence: TGG
tcgcccaggctggagtgcag

SEQ ID NO: 12769 - DNA, 20 bp, Artificial Sequence
  Description of Artificial Sequence: Synthetic oligonucleotide
  Target: DMPK; (+) strand; PAM type: NRG; PAM sequence: CGG
ggagtgcagtggcatgatct

SEQ ID NO: 12770 - DNA, 20 bp, Artificial Sequence
  Description of Artificial Sequence: Synthetic oligonucleotide
  Target: DMPK; (+) strand; PAM type: NRG; PAM sequence: AAG
gcatgatctcggctcactgc

SEQ ID NO: 12771 - DNA, 20 bp, Artificial Sequence
  Description of Artificial Sequence: Synthetic oligonucleotide
  Target: DMPK; (+) strand; PAM type: NRG; PAM sequence: CGG
tcactgcaagctccgcctcc

SEQ ID NO: 12772 - DNA, 20 bp, Artificial Sequence
  Description of Artificial Sequence: Synthetic oligonucleotide
  Target: DMPK; (+) strand; PAM type: NRG; PAM sequence: GGG
cactgcaagctccgcctccc

SEQ ID NO: 12773 - DNA, 20 bp, Artificial Sequence
  Description of Artificial Sequence: Synthetic oligonucleotide
  Target: DMPK; (+) strand; PAM type: NRG; PAM sequence: AAG
attctcctgcctcgcctccc

SEQ ID NO: 12774 - DNA, 20 bp, Artificial Sequence
  Description of Artificial Sequence: Synthetic oligonucleotide
  Target: DMPK; (+) strand; PAM type: NRG; PAM sequence: TAG
ctcctgcctcgcctcccaag

SEQ ID NO: 12775 - DNA, 20 bp, Artificial Sequence
  Description of Artificial Sequence: Synthetic oligonucleotide
  Target: DMPK; (+) strand; PAM type: NRG; PAM sequence: TGG
tgcctcgcctcccaagtagc

SEQ ID NO: 12776 - DNA, 20 bp, Artificial Sequence
  Description of Artificial Sequence: Synthetic oligonucleotide
  Target: DMPK; (+) strand; PAM type: NRG; PAM sequence: GGG
gcctcgcctcccaagtagct

SEQ ID NO: 12777 - DNA, 20 bp, Artificial Sequence
  Description of Artificial Sequence: Synthetic oligonucleotide
  Target: DMPK; (+) strand; PAM type: NRG; PAM sequence: AAG
tcccaagtagctgggaccgc

SEQ ID NO: 12778 - DNA, 20 bp, Artificial Sequence
  Description of Artificial Sequence: Synthetic oligonucleotide
  Target: DMPK; (+) strand; PAM type: NRG; PAM sequence: CGG
caagcgcccgccaccatgcc

SEQ ID NO: 12779 - DNA, 20 bp, Artificial Sequence
  Description of Artificial Sequence: Synthetic oligonucleotide
  Target: DMPK; (+) strand; PAM type: NRG; PAM sequence: TAG
ggctaatttttttgtatttt

SEQ ID NO: 12780 - DNA, 20 bp, Artificial Sequence
  Description of Artificial Sequence: Synthetic oligonucleotide
  Target: DMPK; (+) strand; PAM type: NRG; PAM sequence: TAG
taatttttttgtatttttag

SEQ ID NO: 12781 - DNA, 20 bp, Artificial Sequence
  Description of Artificial Sequence: Synthetic oligonucleotide
  Target: DMPK; (+) strand; PAM type: NRG; PAM sequence: GAG
atttttttgtatttttagta

SEQ ID NO: 12782 - DNA, 20 bp, Artificial Sequence
  Description of Artificial Sequence: Synthetic oligonucleotide
  Target: DMPK; (+) strand; PAM type: NRG; PAM sequence: CGG
ttttgtatttttagtagaga

SEQ ID NO: 12783 - DNA, 20 bp, Artificial Sequence
  Description of Artificial Sequence: Synthetic oligonucleotide
  Target: DMPK; (+) strand; PAM type: NRG; PAM sequence: GGG
tttgtatttttagtagagac

SEQ ID NO: 12784 - DNA, 20 bp, Artificial Sequence
  Description of Artificial Sequence: Synthetic oligonucleotide
  Target: DMPK; (+) strand; PAM type: NRG; PAM sequence: GGG
ttgtatttttagtagagacg

SEQ ID NO: 12785 - DNA, 20 bp, Artificial Sequence
  Description of Artificial Sequence: Synthetic oligonucleotide
  Target: DMPK; (+) strand; PAM type: NRG; PAM sequence: TAG
gagacggggtttcaccgtgt

SEQ ID NO: 12786 - DNA, 20 bp, Artificial Sequence
  Description of Artificial Sequence: Synthetic oligonucleotide
  Target: DMPK; (+) strand; PAM type: NRG; PAM sequence: CAG
cggggtttcaccgtgttagc

SEQ ID NO: 12787 - DNA, 20 bp, Artificial Sequence
  Description of Artificial Sequence: Synthetic oligonucleotide
  Target: DMPK; (+) strand; PAM type: NRG; PAM sequence: AGG
ggggtttcaccgtgttagcc

SEQ ID NO: 12788 - DNA, 20 bp, Artificial Sequence
  Description of Artificial Sequence: Synthetic oligonucleotide
  Target: DMPK; (+) strand; PAM type: NRG; PAM sequence: TGG
tttcaccgtgttagccagga

SEQ ID NO: 12789 - DNA, 20 bp, Artificial Sequence
  Description of Artificial Sequence: Synthetic oligonucleotide
  Target: DMPK; (+) strand; PAM type: NRG; PAM sequence: TGG
acctcatgatccacctgcct

SEQ ID NO: 12790 - DNA, 20 bp, Artificial Sequence
  Description of Artificial Sequence: Synthetic oligonucleotide
  Target: DMPK; (+) strand; PAM type: NRG; PAM sequence: AAG
ccacctgccttggcctccca

SEQ ID NO: 12791 - DNA, 20 bp, Artificial Sequence
  Description of Artificial Sequence: Synthetic oligonucleotide
  Target: DMPK; (+) strand; PAM type: NRG; PAM sequence: TAG
gccttggcctcccaaagtgc

SEQ ID NO: 12792 - DNA, 20 bp, Artificial Sequence
  Description of Artificial Sequence: Synthetic oligonucleotide
  Target: DMPK; (+) strand; PAM type: NRG; PAM sequence: AGG
ccttggcctcccaaagtgct

SEQ ID NO: 12793 - DNA, 20 bp, Artificial Sequence
  Description of Artificial Sequence: Synthetic oligonucleotide
  Target: DMPK; (+) strand; PAM type: NRG; PAM sequence: CAG
ctcccaaagtgctaggatta

SEQ ID NO: 12794 - DNA, 20 bp, Artificial Sequence
  Description of Artificial Sequence: Synthetic oligonucleotide
  Target: DMPK; (+) strand; PAM type: NRG; PAM sequence: AGG
tcccaaagtgctaggattac

SEQ ID NO: 12795 - DNA, 20 bp, Artificial Sequence
  Description of Artificial Sequence: Synthetic oligonucleotide
  Target: DMPK; (+) strand; PAM type: NRG; PAM sequence: GAG
agtgctaggattacaggcgt

SEQ ID NO: 12796 - DNA, 20 bp, Artificial Sequence
  Description of Artificial Sequence: Synthetic oligonucleotide
  Target: DMPK; (+) strand; PAM type: NRG; PAM sequence: CGG
attacaggcgtgagccaccg

SEQ ID NO: 12797 - DNA, 20 bp, Artificial Sequence
  Description of Artificial Sequence: Synthetic oligonucleotide
  Target: DMPK; (+) strand; PAM type: NRG; PAM sequence: TGG
cctaaattaatacttttaaa

SEQ ID NO: 12798 - DNA, 20 bp, Artificial Sequence
  Description of Artificial Sequence: Synthetic oligonucleotide
  Target: DMPK; (+) strand; PAM type: NRG; PAM sequence: TGG
taaatggccttattgttata

SEQ ID NO: 12799 - DNA, 20 bp, Artificial Sequence
  Description of Artificial Sequence: Synthetic oligonucleotide
  Target: DMPK; (+) strand; PAM type: NRG; PAM sequence: AAG
attgttatatggctgattca

SEQ ID NO: 12800 - DNA, 20 bp, Artificial Sequence
  Description of Artificial Sequence: Synthetic oligonucleotide
  Target: DMPK; (+) strand; PAM type: NRG; PAM sequence: AAG
tcttttacaactgattgtaa

SEQ ID NO: 12801 - DNA, 20 bp, Artificial Sequence
  Description of Artificial Sequence: Synthetic oligonucleotide
  Target: DMPK; (+) strand; PAM type: NRG; PAM sequence: AAG
gtctaaacttcatattttcc

SEQ ID NO: 12802 - DNA, 20 bp, Artificial Sequence
  Description of Artificial Sequence: Synthetic oligonucleotide
  Target: DMPK; (+) strand; PAM type: NRG; PAM sequence: AAG
ttcatattttccaagttctg

SEQ ID NO: 12803 - DNA, 20 bp, Artificial Sequence
  Description of Artificial Sequence: Synthetic oligonucleotide
  Target: DMPK; (+) strand; PAM type: NRG; PAM sequence: TGG
ttccaagttctgaagtcctg

SEQ ID NO: 12804 - DNA, 20 bp, Artificial Sequence
  Description of Artificial Sequence: Synthetic oligonucleotide
  Target: DMPK; (+) strand; PAM type: NRG; PAM sequence: CAG
tcctgtggctctgtgtacta

SEQ ID NO: 12805 - DNA, 20 bp, Artificial Sequence
  Description of Artificial Sequence: Synthetic oligonucleotide
  Target: DMPK; (+) strand; PAM type: NRG; PAM sequence: AAG
tctgtgtactacagacgtaa

SEQ ID NO: 12806 - DNA, 20 bp, Artificial Sequence
  Description of Artificial Sequence: Synthetic oligonucleotide
  Target: DMPK; (+) strand; PAM type: NRG; PAM sequence: TGG
actacagacgtaaaagttaa

SEQ ID NO: 12807 - DNA, 20 bp, Artificial Sequence
  Description of Artificial Sequence: Synthetic oligonucleotide
  Target: DMPK; (+) strand; PAM type: NRG; PAM sequence: AAG
acgtaaaagttaatggttac

SEQ ID NO: 12808 - DNA, 20 bp, Artificial Sequence
  Description of Artificial Sequence: Synthetic oligonucleotide
  Target: DMPK; (+) strand; PAM type: NRG; PAM sequence: TGG
agttaatggttacaagattc

SEQ ID NO: 12809 - DNA, 20 bp, Artificial Sequence
  Description of Artificial Sequence: Synthetic oligonucleotide
  Target: DMPK; (+) strand; PAM type: NRG; PAM sequence: GGG
gttaatggttacaagattct

SEQ ID NO: 12810 - DNA, 20 bp, Artificial Sequence
  Description of Artificial Sequence: Synthetic oligonucleotide
  Target: DMPK; (+) strand; PAM type: NRG; PAM sequence: AAG
aatggttacaagattctggg

SEQ ID NO: 12811 - DNA, 20 bp, Artificial Sequence
  Description of Artificial Sequence: Synthetic oligonucleotide
  Target: DMPK; (+) strand; PAM type: NRG; PAM sequence: CAG
ttacaagattctgggaagcc

SEQ ID NO: 12812 - DNA, 20 bp, Artificial Sequence
  Description of Artificial Sequence: Synthetic oligonucleotide
  Target: DMPK; (+) strand; PAM type: NRG; PAM sequence: GAG
gaagcccagtctgtgactct

SEQ ID NO: 12813 - DNA, 20 bp, Artificial Sequence
  Description of Artificial Sequence: Synthetic oligonucleotide
  Target: DMPK; (+) strand; PAM type: NRG; PAM sequence: AGG
aagcccagtctgtgactctg

SEQ ID NO: 12814 - DNA, 20 bp, Artificial Sequence
  Description of Artificial Sequence: Synthetic oligonucleotide
  Target: DMPK; (+) strand; PAM type: NRG; PAM sequence: AAG
aaattcaatctaacattttg

SEQ ID NO: 12815 - DNA, 20 bp, Artificial Sequence
  Description of Artificial Sequence: Synthetic oligonucleotide
  Target: DMPK; (+) strand; PAM type: NRG; PAM sequence: TAG
atctaacattttgaagtaca

SEQ ID NO: 12816 - DNA, 20 bp, Artificial Sequence
  Description of Artificial Sequence: Synthetic oligonucleotide
  Target: DMPK; (+) strand; PAM type: NRG; PAM sequence: AAG
gtacatagatctgaaaattt

SEQ ID NO: 12817 - DNA, 20 bp, Artificial Sequence
  Description of Artificial Sequence: Synthetic oligonucleotide
  Target: DMPK; (+) strand; PAM type: NRG; PAM sequence: AGG
tacatagatctgaaaattta

SEQ ID NO: 12818 - DNA, 20 bp, Artificial Sequence
  Description of Artificial Sequence: Synthetic oligonucleotide
  Target: DMPK; (+) strand; PAM type: NRG; PAM sequence: TGG
aatttaaggtcctccaactc

SEQ ID NO: 12819 - DNA, 20 bp, Artificial Sequence
  Description of Artificial Sequence: Synthetic oligonucleotide
  Target: DMPK; (+) strand; PAM type: NRG; PAM sequence: TAG
gtcctccaactctggcctct

SEQ ID NO: 12820 - DNA, 20 bp, Artificial Sequence
  Description of Artificial Sequence: Synthetic oligonucleotide
  Target: DMPK; (+) strand; PAM type: NRG; PAM sequence: AGG
tcctccaactctggcctctt

SEQ ID NO: 12821 - DNA, 20 bp, Artificial Sequence
  Description of Artificial Sequence: Synthetic oligonucleotide
  Target: DMPK; (+) strand; PAM type: NRG; PAM sequence: GAG
ctccaactctggcctcttag

SEQ ID NO: 12822 - DNA, 20 bp, Artificial Sequence
  Description of Artificial Sequence: Synthetic oligonucleotide
  Target: DMPK; (+) strand; PAM type: NRG; PAM sequence: TGG
tctggcctcttaggagtctt

SEQ ID NO: 12823 - DNA, 20 bp, Artificial Sequence
  Description of Artificial Sequence: Synthetic oligonucleotide
  Target: DMPK; (+) strand; PAM type: NRG; PAM sequence: GGG
ctggcctcttaggagtcttt

SEQ ID NO: 12824 - DNA, 20 bp, Artificial Sequence
  Description of Artificial Sequence: Synthetic oligonucleotide
  Target: DMPK; (+) strand; PAM type: NRG; PAM sequence: CAG
aggagtctttgggcccaaaa

SEQ ID NO: 12825 - DNA, 20 bp, Artificial Sequence
  Description of Artificial Sequence: Synthetic oligonucleotide
  Target: DMPK; (+) strand; PAM type: NRG; PAM sequence: AAG
gtctttgggcccaaaacagt

SEQ ID NO: 12826 - DNA, 20 bp, Artificial Sequence
  Description of Artificial Sequence: Synthetic oligonucleotide
  Target: DMPK; (+) strand; PAM type: NRG; PAM sequence: AGG
tctttgggcccaaaacagta

SEQ ID NO: 12827 - DNA, 20 bp, Artificial Sequence
  Description of Artificial Sequence: Synthetic oligonucleotide
  Target: DMPK; (+) strand; PAM type: NRG; PAM sequence: AAG
gcccaaaacagtaaggttcc

SEQ ID NO: 12828 - DNA, 20 bp, Artificial Sequence
  Description of Artificial Sequence: Synthetic oligonucleotide
  Target: DMPK; (+) strand; PAM type: NRG; PAM sequence: TGG
gactgatcctgcaactccat

SEQ ID NO: 12829 - DNA, 20 bp, Artificial Sequence
  Description of Artificial Sequence: Synthetic oligonucleotide
  Target: DMPK; (+) strand; PAM type: NRG; PAM sequence: AAG
ctgcaactccattggctgcc

SEQ ID NO: 12830 - DNA, 20 bp, Artificial Sequence
  Description of Artificial Sequence: Synthetic oligonucleotide
  Target: DMPK; (+) strand; PAM type: NRG; PAM sequence: AGG
tgcaactccattggctgcca

SEQ ID NO: 12831 - DNA, 20 bp, Artificial Sequence
  Description of Artificial Sequence: Synthetic oligonucleotide
  Target: DMPK; (+) strand; PAM type: NRG; PAM sequence: GAG
caactccattggctgccaag

SEQ ID NO: 12832 - DNA, 20 bp, Artificial Sequence
  Description of Artificial Sequence: Synthetic oligonucleotide
  Target: DMPK; (+) strand; PAM type: NRG; PAM sequence: CAG
ctccattggctgccaaggag

SEQ ID NO: 12833 - DNA, 20 bp, Artificial Sequence
  Description of Artificial Sequence: Synthetic oligonucleotide
  Target: DMPK; (+) strand; PAM type: NRG; PAM sequence: AGG
tccattggctgccaaggagc

SEQ ID NO: 12834 - DNA, 20 bp, Artificial Sequence
  Description of Artificial Sequence: Synthetic oligonucleotide
  Target: DMPK; (+) strand; PAM type: NRG; PAM sequence: CAG
ggctgccaaggagcaggacc

SEQ ID NO: 12835 - DNA, 20 bp, Artificial Sequence
  Description of Artificial Sequence: Synthetic oligonucleotide
  Target: DMPK; (+) strand; PAM type: NRG; PAM sequence: AGG
gctgccaaggagcaggaccc

SEQ ID NO: 12836 - DNA, 20 bp, Artificial Sequence
  Description of Artificial Sequence: Synthetic oligonucleotide
  Target: DMPK; (+) strand; PAM type: NRG; PAM sequence: AAG
gccaaggagcaggacccagg

SEQ ID NO: 12837 - DNA, 20 bp, Artificial Sequence
  Description of Artificial Sequence: Synthetic oligonucleotide
  Target: DMPK; (+) strand; PAM type: NRG; PAM sequence: AAG
gagcaggacccaggaagctc

SEQ ID NO: 12838 - DNA, 20 bp, Artificial Sequence
  Description of Artificial Sequence: Synthetic oligonucleotide
  Target: DMPK; (+) strand; PAM type: NRG; PAM sequence: CAG
caggacccaggaagctcaag

SEQ ID NO: 12839 - DNA, 20 bp, Artificial Sequence
  Description of Artificial Sequence: Synthetic oligonucleotide
  Target: DMPK; (+) strand; PAM type: NRG; PAM sequence: TGG
aggaagctcaagcagcctcg

SEQ ID NO: 12840 - DNA, 20 bp, Artificial Sequence
  Description of Artificial Sequence: Synthetic oligonucleotide
  Target: DMPK; (+) strand; PAM type: NRG; PAM sequence: TGG
tcaagcagcctcgtggcccc

SEQ ID NO: 12841 - DNA, 20 bp, Artificial Sequence
  Description of Artificial Sequence: Synthetic oligonucleotide
  Target: DMPK; (+) strand; PAM type: NRG; PAM sequence: GAG
aagcagcctcgtggcccctg

SEQ ID NO: 12842 - DNA, 20 bp, Artificial Sequence
  Description of Artificial Sequence: Synthetic oligonucleotide
  Target: DMPK; (+) strand; PAM type: NRG; PAM sequence: AGG
agcagcctcgtggcccctgg

SEQ ID NO: 12843 - DNA, 20 bp, Artificial Sequence
  Description of Artificial Sequence: Synthetic oligonucleotide
  Target: DMPK; (+) strand; PAM type: NRG; PAM sequence: CAG
cgtggcccctggaggccgtc

SEQ ID NO: 12844 - DNA, 20 bp, Artificial Sequence
  Description of Artificial Sequence: Synthetic oligonucleotide
  Target: DMPK; (+) strand; PAM type: NRG; PAM sequence: AGG
gtggcccctggaggccgtcc

SEQ ID NO: 12845 - DNA, 20 bp, Artificial Sequence
  Description of Artificial Sequence: Synthetic oligonucleotide
  Target: DMPK; (+) strand; PAM type: NRG; PAM sequence: GGG
tggcccctggaggccgtcca

SEQ ID NO: 12846 - DNA, 20 bp, Artificial Sequence
  Description of Artificial Sequence: Synthetic oligonucleotide
  Target: DMPK; (+) strand; PAM type: NRG; PAM sequence: CAG
cccctggaggccgtccaggg

SEQ ID NO: 12847 - DNA, 20 bp, Artificial Sequence
  Description of Artificial Sequence: Synthetic oligonucleotide
  Target: DMPK; (+) strand; PAM type: NRG; PAM sequence: GAG
gtccagggcagtgcttacct

SEQ ID NO: 12848 - DNA, 20 bp, Artificial Sequence
  Description of Artificial Sequence: Synthetic oligonucleotide
  Target: DMPK; (+) strand; PAM type: NRG; PAM sequence: AGG
tccagggcagtgcttacctg

SEQ ID NO: 12849 - DNA, 20 bp, Artificial Sequence
  Description of Artificial Sequence: Synthetic oligonucleotide
  Target: DMPK; (+) strand; PAM type: NRG; PAM sequence: GGG
ccagggcagtgcttacctga

SEQ ID NO: 12850 - DNA, 20 bp, Artificial Sequence
  Description of Artificial Sequence: Synthetic oligonucleotide
  Target: DMPK; (+) strand; PAM type: NRG; PAM sequence: CAG
gtgcttacctgagggccatg

SEQ ID NO: 12851 - DNA, 20 bp, Artificial Sequence
  Description of Artificial Sequence: Synthetic oligonucleotide
  Target: DMPK; (+) strand; PAM type: NRG; PAM sequence: AGG
tgcttacctgagggccatgc

SEQ ID NO: 12852 - DNA, 20 bp, Artificial Sequence
  Description of Artificial Sequence: Synthetic oligonucleotide
  Target: DMPK; (+) strand; PAM type: NRG; PAM sequence: GAG
cttacctgagggccatgcag

SEQ ID NO: 12853 - DNA, 20 bp, Artificial Sequence
  Description of Artificial Sequence: Synthetic oligonucleotide
  Target: DMPK; (+) strand; PAM type: NRG; PAM sequence: TAG
acctgagggccatgcaggag

SEQ ID NO: 12854 - DNA, 20 bp, Artificial Sequence
  Description of Artificial Sequence: Synthetic oligonucleotide
  Target: DMPK; (+) strand; PAM type: NRG; PAM sequence: AGG
cctgagggccatgcaggagt

SEQ ID NO: 12855 - DNA, 20 bp, Artificial Sequence
  Description of Artificial Sequence: Synthetic oligonucleotide
  Target: DMPK; (+) strand; PAM type: NRG; PAM sequence: GAG
tgagggccatgcaggagtag

SEQ ID NO: 12856 - DNA, 20 bp, Artificial Sequence
  Description of Artificial Sequence: Synthetic oligonucleotide
  Target: DMPK; (+) strand; PAM type: NRG; PAM sequence: TAG
gggccatgcaggagtaggag

SEQ ID NO: 12857 - DNA, 20 bp, Artificial Sequence
  Description of Artificial Sequence: Synthetic oligonucleotide
  Target: DMPK; (+) strand; PAM type: NRG; PAM sequence: AAG
ggagtaggagtagcccacaa

SEQ ID NO: 12858 - DNA, 20 bp, Artificial Sequence
  Description of Artificial Sequence: Synthetic oligonucleotide
  Target: DMPK; (+) strand; PAM type: NRG; PAM sequence: AGG
gagtaggagtagcccacaaa

SEQ ID NO: 12859 - DNA, 20 bp, Artificial Sequence
  Description of Artificial Sequence: Synthetic oligonucleotide
  Target: DMPK; (+) strand; PAM type: NRG; PAM sequence: CAG
taggagtagcccacaaaagg

SEQ ID NO: 12860 - DNA, 20 bp, Artificial Sequence
  Description of Artificial Sequence: Synthetic oligonucleotide
  Target: DMPK; (+) strand; PAM type: NRG; PAM sequence: AGG
aggagtagcccacaaaaggc

SEQ ID NO: 12861 - DNA, 20 bp, Artificial Sequence
  Description of Artificial Sequence: Synthetic oligonucleotide
  Target: DMPK; (+) strand; PAM type: NRG; PAM sequence: TGG
agtagcccacaaaaggcagg

SEQ ID NO: 12862 - DNA, 20 bp, Artificial Sequence
  Description of Artificial Sequence: Synthetic oligonucleotide
  Target: DMPK; (+) strand; PAM type: NRG; PAM sequence: TAG
acaaaaggcaggtggacccc

SEQ ID NO: 12863 - DNA, 20 bp, Artificial Sequence
  Description of Artificial Sequence: Synthetic oligonucleotide
  Target: DMPK; (+) strand; PAM type: NRG; PAM sequence: CGG
aaaggcaggtggacccctag

SEQ ID NO: 12864 - DNA, 20 bp, Artificial Sequence
  Description of Artificial Sequence: Synthetic oligonucleotide
  Target: DMPK; (+) strand; PAM type: NRG; PAM sequence: CAG
gcaccttcccgaatgtccga

SEQ ID NO: 12865 - DNA, 20 bp, Artificial Sequence
  Description of Artificial Sequence: Synthetic oligonucleotide
  Target: DMPK; (+) strand; PAM type: NRG; PAM sequence: AAG
tccgacagtgtctcctgcgc

SEQ ID NO: 12866 - DNA, 20 bp, Artificial Sequence
  Description of Artificial Sequence: Synthetic oligonucleotide
  Target: DMPK; (+) strand; PAM type: NRG; PAM sequence: CAG
tgtctcctgcgcaagacaca

SEQ ID NO: 12867 - DNA, 20 bp, Artificial Sequence
  Description of Artificial Sequence: Synthetic oligonucleotide
  Target: DMPK; (+) strand; PAM type: NRG; PAM sequence: GAG
tgcgcaagacacacagatgt

SEQ ID NO: 12868 - DNA, 20 bp, Artificial Sequence
  Description of Artificial Sequence: Synthetic oligonucleotide
  Target: DMPK; (+) strand; PAM type: NRG; PAM sequence: CAG
gcaagacacacagatgtgag

SEQ ID NO: 12869 - DNA, 20 bp, Artificial Sequence
  Description of Artificial Sequence: Synthetic oligonucleotide
  Target: DMPK; (+) strand; PAM type: NRG; PAM sequence: CAG
agacacacagatgtgagcag

SEQ ID NO: 12870 - DNA, 20 bp, Artificial Sequence
  Description of Artificial Sequence: Synthetic oligonucleotide
  Target: DMPK; (+) strand; PAM type: NRG; PAM sequence: CAG
cagatgtgagcagcagtcgt

SEQ ID NO: 12871 - DNA, 20 bp, Artificial Sequence
  Description of Artificial Sequence: Synthetic oligonucleotide
  Target: DMPK; (+) strand; PAM type: NRG; PAM sequence: AGG
agatgtgagcagcagtcgtc

SEQ ID NO: 12872 - DNA, 20 bp, Artificial Sequence
  Description of Artificial Sequence: Synthetic oligonucleotide
  Target: DMPK; (+) strand; PAM type: NRG; PAM sequence: GGG
gatgtgagcagcagtcgtca

SEQ ID NO: 12873 - DNA, 20 bp, Artificial Sequence
  Description of Artificial Sequence: Synthetic oligonucleotide
  Target: DMPK; (+) strand; PAM type: NRG; PAM sequence: CGG
gtgagcagcagtcgtcaggg

SEQ ID NO: 12874 - DNA, 20 bp, Artificial Sequence
  Description of Artificial Sequence: Synthetic oligonucleotide
  Target: DMPK; (+) strand; PAM type: NRG; PAM sequence: GGG
tgagcagcagtcgtcagggc

SEQ ID NO: 12875 - DNA, 20 bp, Artificial Sequence
  Description of Artificial Sequence: Synthetic oligonucleotide
  Target: DMPK; (+) strand; PAM type: NRG; PAM sequence: TGG
ccctcactgctttttgatct

SEQ ID NO: 12876 - DNA, 20 bp, Artificial Sequence
  Description of Artificial Sequence: Synthetic oligonucleotide
  Target: DMPK; (+) strand; PAM type: NRG; PAM sequence: CAG
cttacatgttccccccaaac

SEQ ID NO: 12877 - DNA, 20 bp, Artificial Sequence
  Description of Artificial Sequence: Synthetic oligonucleotide
  Target: DMPK; (+) strand; PAM type: NRG; PAM sequence: CAG
cccccaaaccagccccaact

SEQ ID NO: 12878 - DNA, 20 bp, Artificial Sequence
  Description of Artificial Sequence: Synthetic oligonucleotide
  Target: DMPK; (+) strand; PAM type: NRG; PAM sequence: AGG
ccccaaaccagccccaactc

SEQ ID NO: 12879 - DNA, 20 bp, Artificial Sequence
  Description of Artificial Sequence: Synthetic oligonucleotide
  Target: DMPK; (+) strand; PAM type: NRG; PAM sequence: GGG
cccaaaccagccccaactca

SEQ ID NO: 12880 - DNA, 20 bp, Artificial Sequence
  Description of Artificial Sequence: Synthetic oligonucleotide
  Target: DMPK; (+) strand; PAM type: NRG; PAM sequence: AAG
cccaactcagggcttatcta

SEQ ID NO: 12881 - DNA, 20 bp, Artificial Sequence
  Description of Artificial Sequence: Synthetic oligonucleotide
  Target: DMPK; (+) strand; PAM type: NRG; PAM sequence: TGG
aactcagggcttatctaaag

SEQ ID NO: 12882 - DNA, 20 bp, Artificial Sequence
  Description of Artificial Sequence: Synthetic oligonucleotide
  Target: DMPK; (+) strand; PAM type: NRG; PAM sequence: CAG
cttatctaaagtggcccctc

SEQ ID NO: 12883 - DNA, 20 bp, Artificial Sequence
  Description of Artificial Sequence: Synthetic oligonucleotide
  Target: DMPK; (+) strand; PAM type: NRG; PAM sequence: CGG
ttttttctttttctttgata

SEQ ID NO: 12884 - DNA, 20 bp, Artificial Sequence
  Description of Artificial Sequence: Synthetic oligonucleotide
  Target: DMPK; (+) strand; PAM type: NRG; PAM sequence: GAG
ttttctttttctttgatacg

SEQ ID NO: 12885 - DNA, 20 bp, Artificial Sequence
  Description of Artificial Sequence: Synthetic oligonucleotide
  Target: DMPK; (+) strand; PAM type: NRG; PAM sequence: CAG
cggagtctcgctctgttacc

SEQ ID NO: 12886 - DNA, 20 bp, Artificial Sequence
  Description of Artificial Sequence: Synthetic oligonucleotide
  Target: DMPK; (+) strand; PAM type: NRG; PAM sequence: AGG
ggagtctcgctctgttaccc

SEQ ID NO: 12887 - DNA, 20 bp, Artificial Sequence
  Description of Artificial Sequence: Synthetic oligonucleotide
  Target: DMPK; (+) strand; PAM type: NRG; PAM sequence: TGG
tctcgctctgttacccaggc

SEQ ID NO: 12888 - DNA, 20 bp, Artificial Sequence
  Description of Artificial Sequence: Synthetic oligonucleotide
  Target: DMPK; (+) strand; PAM type: NRG; PAM sequence: GAG
tcgctctgttacccaggctg

SEQ ID NO: 12889 - DNA, 20 bp, Artificial Sequence
  Description of Artificial Sequence: Synthetic oligonucleotide
  Target: DMPK; (+) strand; PAM type: NRG; PAM sequence: CAG
ctgttacccaggctggagtg

SEQ ID NO: 12890 - DNA, 20 bp, Artificial Sequence
  Description of Artificial Sequence: Synthetic oligonucleotide
  Target: DMPK; (+) strand; PAM type: NRG; PAM sequence: TGG
ttacccaggctggagtgcag

SEQ ID NO: 12891 - DNA, 20 bp, Artificial Sequence
  Description of Artificial Sequence: Synthetic oligonucleotide
  Target: DMPK; (+) strand; PAM type: NRG; PAM sequence: CAG
ggagtgcagtggtgcaatct

SEQ ID NO: 12892 - DNA, 20 bp, Artificial Sequence
  Description of Artificial Sequence: Synthetic oligonucleotide
  Target: DMPK; (+) strand; PAM type: NRG; PAM sequence: CAG
tcactgcaacctccgcctcc

SEQ ID NO: 12893 - DNA, 20 bp, Artificial Sequence
  Description of Artificial Sequence: Synthetic oligonucleotide
  Target: DMPK; (+) strand; PAM type: NRG; PAM sequence: AGG
cactgcaacctccgcctccc

SEQ ID NO: 12894 - DNA, 20 bp, Artificial Sequence
  Description of Artificial Sequence: Synthetic oligonucleotide
  Target: DMPK; (+) strand; PAM type: NRG; PAM sequence: CAG
caacctccgcctcccaggtt

SEQ ID NO: 12895 - DNA, 20 bp, Artificial Sequence
  Description of Artificial Sequence: Synthetic oligonucleotide
  Target: DMPK; (+) strand; PAM type: NRG; PAM sequence: AGG
aacctccgcctcccaggttc

SEQ ID NO: 12896 - DNA, 20 bp, Artificial Sequence
  Description of Artificial Sequence: Synthetic oligonucleotide
  Target: DMPK; (+) strand; PAM type: NRG; PAM sequence: CAG
ttcaggcgattctcctgcct

SEQ ID NO: 12897 - DNA, 20 bp, Artificial Sequence
  Description of Artificial Sequence: Synthetic oligonucleotide
  Target: DMPK; (+) strand; PAM type: NRG; PAM sequence: GAG
ttctcctgcctcagcgtcct

SEQ ID NO: 12898 - DNA, 20 bp, Artificial Sequence
  Description of Artificial Sequence: Synthetic oligonucleotide
  Target: DMPK; (+) strand; PAM type: NRG; PAM sequence: TAG
tcctgcctcagcgtcctgag

SEQ ID NO: 12899 - DNA, 20 bp, Artificial Sequence
  Description of Artificial Sequence: Synthetic oligonucleotide
  Target: DMPK; (+) strand; PAM type: NRG; PAM sequence: GAG
cctcagcgtcctgagtagct

SEQ ID NO: 12900 - DNA, 20 bp, Artificial Sequence
  Description of Artificial Sequence: Synthetic oligonucleotide
  Target: DMPK; (+) strand; PAM type: NRG; PAM sequence: CAG
gtcctgagtagctgagatta

SEQ ID NO: 12901 - DNA, 20 bp, Artificial Sequence
  Description of Artificial Sequence: Synthetic oligonucleotide
  Target: DMPK; (+) strand; PAM type: NRG; PAM sequence: AGG
tcctgagtagctgagattac

SEQ ID NO: 12902 - DNA, 20 bp, Artificial Sequence
  Description of Artificial Sequence: Synthetic oligonucleotide
  Target: DMPK; (+) strand; PAM type: NRG; PAM sequence: TGG
caggcgccctctaccacgcc

SEQ ID NO: 12903 - DNA, 20 bp, Artificial Sequence
  Description of Artificial Sequence: Synthetic oligonucleotide
  Target: DMPK; (+) strand; PAM type: NRG; PAM sequence: TGG
tggctaattttttatatttt

SEQ ID NO: 12904 - DNA, 20 bp, Artificial Sequence
  Description of Artificial Sequence: Synthetic oligonucleotide
  Target: DMPK; (+) strand; PAM type: NRG; PAM sequence: TAG
ctaattttttatatttttgg

SEQ ID NO: 12905 - DNA, 20 bp, Artificial Sequence
  Description of Artificial Sequence: Synthetic oligonucleotide
  Target: DMPK; (+) strand; PAM type: NRG; PAM sequence: GAG
aattttttatatttttggta

SEQ ID NO: 12906 - DNA, 20 bp, Artificial Sequence
  Description of Artificial Sequence: Synthetic oligonucleotide
  Target: DMPK; (+) strand; PAM type: NRG; PAM sequence: CGG
ttttatatttttggtagaga

SEQ ID NO: 12907 - DNA, 20 bp, Artificial Sequence
  Description of Artificial Sequence: Synthetic oligonucleotide
  Target: DMPK; (+) strand; PAM type: NRG; PAM sequence: GGG
tttatatttttggtagagac

SEQ ID NO: 12908 - DNA, 20 bp, Artificial Sequence
  Description of Artificial Sequence: Synthetic oligonucleotide
  Target: DMPK; (+) strand; PAM type: NRG; PAM sequence: GGG
ttatatttttggtagagacg

SEQ ID NO: 12909 - DNA, 20 bp, Artificial Sequence
  Description of Artificial Sequence: Synthetic oligonucleotide
  Target: DMPK; (+) strand; PAM type: NRG; PAM sequence: TGG
gagacggggtttcgccacgc

SEQ ID NO: 12910 - DNA, 20 bp, Artificial Sequence
  Description of Artificial Sequence: Synthetic oligonucleotide
  Target: DMPK; (+) strand; PAM type: NRG; PAM sequence: CAG
cggggtttcgccacgctggc

SEQ ID NO: 12911 - DNA, 20 bp, Artificial Sequence
  Description of Artificial Sequence: Synthetic oligonucleotide
  Target: DMPK; (+) strand; PAM type: NRG; PAM sequence: AGG
ggggtttcgccacgctggcc

SEQ ID NO: 12912 - DNA, 20 bp, Artificial Sequence
  Description of Artificial Sequence: Synthetic oligonucleotide
  Target: DMPK; (+) strand; PAM type: NRG; PAM sequence: TGG
tttcgccacgctggccaggc

SEQ ID NO: 12913 - DNA, 20 bp, Artificial Sequence
  Description of Artificial Sequence: Synthetic oligonucleotide
  Target: DMPK; (+) strand; PAM type: NRG; PAM sequence: AAG
ggtctccatcttctgacctc

SEQ ID NO: 12914 - DNA, 20 bp, Artificial Sequence
  Description of Artificial Sequence: Synthetic oligonucleotide
  Target: DMPK; (+) strand; PAM type: NRG; PAM sequence: CAG
ctcaagtgatccgcctacct

SEQ ID NO: 12915 - DNA, 20 bp, Artificial Sequence
  Description of Artificial Sequence: Synthetic oligonucleotide
  Target: DMPK; (+) strand; PAM type: NRG; PAM sequence: TAG
tccgcctacctcagctgttg

SEQ ID NO: 12916 - DNA, 20 bp, Artificial Sequence
  Description of Artificial Sequence: Synthetic oligonucleotide
  Target: DMPK; (+) strand; PAM type: NRG; PAM sequence: TGG
gctgttgtagtcccaaactc

SEQ ID NO: 12917 - DNA, 20 bp, Artificial Sequence
  Description of Artificial Sequence: Synthetic oligonucleotide
  Target: DMPK; (+) strand; PAM type: NRG; PAM sequence: GGG
ctgttgtagtcccaaactct

SEQ ID NO: 12918 - DNA, 20 bp, Artificial Sequence
  Description of Artificial Sequence: Synthetic oligonucleotide
  Target: DMPK; (+) strand; PAM type: NRG; PAM sequence: AAG
tagtcccaaactctgggctc

SEQ ID NO: 12919 - DNA, 20 bp, Artificial Sequence
  Description of Artificial Sequence: Synthetic oligonucleotide
  Target: DMPK; (+) strand; PAM type: NRG; PAM sequence: CAG
tcccaaactctgggctcaag

SEQ ID NO: 12920 - DNA, 20 bp, Artificial Sequence
  Description of Artificial Sequence: Synthetic oligonucleotide
  Target: DMPK; (+) strand; PAM type: NRG; PAM sequence: CAG
ctcaagcagtcctccaacct

SEQ ID NO: 12921 - DNA, 20 bp, Artificial Sequence
  Description of Artificial Sequence: Synthetic oligonucleotide
  Target: DMPK; (+) strand; PAM type: NRG; PAM sequence: AAG
cctccaacctcagcctccca

SEQ ID NO: 12922 - DNA, 20 bp, Artificial Sequence
  Description of Artificial Sequence: Synthetic oligonucleotide
  Target: DMPK; (+) strand; PAM type: NRG; PAM sequence: TGG
acctcagcctcccaaagtgc

SEQ ID NO: 12923 - DNA, 20 bp, Artificial Sequence
  Description of Artificial Sequence: Synthetic oligonucleotide
  Target: DMPK; (+) strand; PAM type: NRG; PAM sequence: GGG
cctcagcctcccaaagtgct

SEQ ID NO: 12924 - DNA, 20 bp, Artificial Sequence
  Description of Artificial Sequence: Synthetic oligonucleotide
  Target: DMPK; (+) strand; PAM type: NRG; PAM sequence: AAG
agtgctgggattacaaatat

SEQ ID NO: 12925 - DNA, 20 bp, Artificial Sequence
  Description of Artificial Sequence: Synthetic oligonucleotide
  Target: DMPK; (+) strand; PAM type: NRG; PAM sequence: CAG
caaatataagccactgtgcc

SEQ ID NO: 12926 - DNA, 20 bp, Artificial Sequence
  Description of Artificial Sequence: Synthetic oligonucleotide
  Target: DMPK; (+) strand; PAM type: NRG; PAM sequence: CAG
ataagccactgtgcccagcc

SEQ ID NO: 12927 - DNA, 20 bp, Artificial Sequence
  Description of Artificial Sequence: Synthetic oligonucleotide
  Target: DMPK; (+) strand; PAM type: NRG; PAM sequence: TAG
ccagttctgttttttttttt

SEQ ID NO: 12928 - DNA, 20 bp, Artificial Sequence
  Description of Artificial Sequence: Synthetic oligonucleotide
  Target: DMPK; (+) strand; PAM type: NRG; PAM sequence: TGG
ttctgttttttttttttaga

SEQ ID NO: 12929 - DNA, 20 bp, Artificial Sequence
  Description of Artificial Sequence: Synthetic oligonucleotide
  Target: DMPK; (+) strand; PAM type: NRG; PAM sequence: GAG
ctgttttttttttttagatg

SEQ ID NO: 12930 - DNA, 20 bp, Artificial Sequence
  Description of Artificial Sequence: Synthetic oligonucleotide
  Target: DMPK; (+) strand; PAM type: NRG; PAM sequence: CAG
gatggagtcttgctgtctcc

SEQ ID NO: 12931 - DNA, 20 bp, Artificial Sequence
  Description of Artificial Sequence: Synthetic oligonucleotide
  Target: DMPK; (+) strand; PAM type: NRG; PAM sequence: TAG
agtcttgctgtctcccagcc

SEQ ID NO: 12932 - DNA, 20 bp, Artificial Sequence
  Description of Artificial Sequence: Synthetic oligonucleotide
  Target: DMPK; (+) strand; PAM type: NRG; PAM sequence: GAG
tcttgctgtctcccagccta

SEQ ID NO: 12933 - DNA, 20 bp, Artificial Sequence
  Description of Artificial Sequence: Synthetic oligonucleotide
  Target: DMPK; (+) strand; PAM type: NRG; PAM sequence: CAG
ctgtctcccagcctagagtg

SEQ ID NO: 12934 - DNA, 20 bp, Artificial Sequence
  Description of Artificial Sequence: Synthetic oligonucleotide
  Target: DMPK; (+) strand; PAM type: NRG; PAM sequence: TGG
tctcccagcctagagtgcag

SEQ ID NO: 12935 - DNA, 20 bp, Artificial Sequence
  Description of Artificial Sequence: Synthetic oligonucleotide
  Target: DMPK; (+) strand; PAM type: NRG; PAM sequence: CAG
agagtgcagtggcacaaccc

SEQ ID NO: 12936 - DNA, 20 bp, Artificial Sequence
  Description of Artificial Sequence: Synthetic oligonucleotide
  Target: DMPK; (+) strand; PAM type: NRG; PAM sequence: CAG
ccactgcaaactctgcctcc

SEQ ID NO: 12937 - DNA, 20 bp, Artificial Sequence
  Description of Artificial Sequence: Synthetic oligonucleotide
  Target: DMPK; (+) strand; PAM type: NRG; PAM sequence: AGG
cactgcaaactctgcctccc

SEQ ID NO: 12938 - DNA, 20 bp, Artificial Sequence
  Description of Artificial Sequence: Synthetic oligonucleotide
  Target: DMPK; (+) strand; PAM type: NRG; PAM sequence: AAG
tctgcctcccaggttcaatc

SEQ ID NO: 12939 - DNA, 20 bp, Artificial Sequence
  Description of Artificial Sequence: Synthetic oligonucleotide
  Target: DMPK; (+) strand; PAM type: NRG; PAM sequence: CAG
atcaagcgattctcctgcct

SEQ ID NO: 12940 - DNA, 20 bp, Artificial Sequence
  Description of Artificial Sequence: Synthetic oligonucleotide
  Target: DMPK; (+) strand; PAM type: NRG; PAM sequence: GAG
ttctcctgcctcagcctcct

SEQ ID NO: 12941 - DNA, 20 bp, Artificial Sequence
  Description of Artificial Sequence: Synthetic oligonucleotide
  Target: DMPK; (+) strand; PAM type: NRG; PAM sequence: TAG
tcctgcctcagcctcctgag

SEQ ID NO: 12942 - DNA, 20 bp, Artificial Sequence
  Description of Artificial Sequence: Synthetic oligonucleotide
  Target: DMPK; (+) strand; PAM type: NRG; PAM sequence: TGG
gcctcagcctcctgagtagc

SEQ ID NO: 12943 - DNA, 20 bp, Artificial Sequence
  Description of Artificial Sequence: Synthetic oligonucleotide
  Target: DMPK; (+) strand; PAM type: NRG; PAM sequence: CAG
ctcctgagtagctggcatta

SEQ ID NO: 12944 - DNA, 20 bp, Artificial Sequence
  Description of Artificial Sequence: Synthetic oligonucleotide
  Target: DMPK; (+) strand; PAM type: NRG; PAM sequence: AGG
tcctgagtagctggcattac

SEQ ID NO: 12945 - DNA, 20 bp, Artificial Sequence
  Description of Artificial Sequence: Synthetic oligonucleotide
  Target: DMPK; (+) strand; PAM type: NRG; PAM sequence: AAG
cattacaggcatacgccacc

SEQ ID NO: 12946 - DNA, 20 bp, Artificial Sequence
  Description of Artificial Sequence: Synthetic oligonucleotide
  Target: DMPK; (+) strand; PAM type: NRG; PAM sequence: TGG
caggcatacgccaccaagcc

SEQ ID NO: 12947 - DNA, 20 bp, Artificial Sequence
  Description of Artificial Sequence: Synthetic oligonucleotide
  Target: DMPK; (+) strand; PAM type: NRG; PAM sequence: TAG
ctggctaaattttgtatttt

SEQ ID NO: 12948 - DNA, 20 bp, Artificial Sequence
  Description of Artificial Sequence: Synthetic oligonucleotide
  Target: DMPK; (+) strand; PAM type: NRG; PAM sequence: TAG
gctaaattttgtatttttag

SEQ ID NO: 12949 - DNA, 20 bp, Artificial Sequence
  Description of Artificial Sequence: Synthetic oligonucleotide
  Target: DMPK; (+) strand; PAM type: NRG; PAM sequence: CAG
ttttgtatttttagtagaca

SEQ ID NO: 12950 - DNA, 20 bp, Artificial Sequence
  Description of Artificial Sequence: Synthetic oligonucleotide
  Target: DMPK; (+) strand; PAM type: NRG; PAM sequence: AGG
tttgtatttttagtagacac

SEQ ID NO: 12951 - DNA, 20 bp, Artificial Sequence
  Description of Artificial Sequence: Synthetic oligonucleotide
  Target: DMPK; (+) strand; PAM type: NRG; PAM sequence: GGG
ttgtatttttagtagacaca

SEQ ID NO: 12952 - DNA, 20 bp, Artificial Sequence
  Description of Artificial Sequence: Synthetic oligonucleotide
  Target: DMPK; (+) strand; PAM type: NRG; PAM sequence: TGG
gacacagggtttcaccatgt

SEQ ID NO: 12953 - DNA, 20 bp, Artificial Sequence
  Description of Artificial Sequence: Synthetic oligonucleotide
  Target: DMPK; (+) strand; PAM type: NRG; PAM sequence: CAG
cagggtttcaccatgttggc

SEQ ID NO: 12954 - DNA, 20 bp, Artificial Sequence
  Description of Artificial Sequence: Synthetic oligonucleotide
  Target: DMPK; (+) strand; PAM type: NRG; PAM sequence: AGG
agggtttcaccatgttggcc

SEQ ID NO: 12955 - DNA, 20 bp, Artificial Sequence
  Description of Artificial Sequence: Synthetic oligonucleotide
  Target: DMPK; (+) strand; PAM type: NRG; PAM sequence: TGG
tttcaccatgttggccaggc

SEQ ID NO: 12956 - DNA, 20 bp, Artificial Sequence
  Description of Artificial Sequence: Synthetic oligonucleotide
  Target: DMPK; (+) strand; PAM type: NRG; PAM sequence: CAG
ggtcttgaactcctgacttc

SEQ ID NO: 12957 - DNA, 20 bp, Artificial Sequence
  Description of Artificial Sequence: Synthetic oligonucleotide
  Target: DMPK; (+) strand; PAM type: NRG; PAM sequence: CAG
ttccagtgatctgcctgcct

SEQ ID NO: 12958 - DNA, 20 bp, Artificial Sequence
  Description of Artificial Sequence: Synthetic oligonucleotide
  Target: DMPK; (+) strand; PAM type: NRG; PAM sequence: AAG
ctgcctgcctcagcctccca

SEQ ID NO: 12959 - DNA, 20 bp, Artificial Sequence
  Description of Artificial Sequence: Synthetic oligonucleotide
  Target: DMPK; (+) strand; PAM type: NRG; PAM sequence: TGG
gcctcagcctcccaaagttc

SEQ ID NO: 12960 - DNA, 20 bp, Artificial Sequence
  Description of Artificial Sequence: Synthetic oligonucleotide
  Target: DMPK; (+) strand; PAM type: NRG; PAM sequence: GGG
cctcagcctcccaaagttct

SEQ ID NO: 12961 - DNA, 20 bp, Artificial Sequence
  Description of Artificial Sequence: Synthetic oligonucleotide
  Target: DMPK; (+) strand; PAM type: NRG; PAM sequence: CAG
ctcccaaagttctgggatta

SEQ ID NO: 12962 - DNA, 20 bp, Artificial Sequence
  Description of Artificial Sequence: Synthetic oligonucleotide
  Target: DMPK; (+) strand; PAM type: NRG; PAM sequence: AGG
tcccaaagttctgggattac

SEQ ID NO: 12963 - DNA, 20 bp, Artificial Sequence
  Description of Artificial Sequence: Synthetic oligonucleotide
  Target: DMPK; (+) strand; PAM type: NRG; PAM sequence: GAG
tttttttttttttttttttt

SEQ ID NO: 12964 - DNA, 20 bp, Artificial Sequence
  Description of Artificial Sequence: Synthetic oligonucleotide
  Target: DMPK; (+) strand; PAM type: NRG; PAM sequence: CAG
ttttttttttttttttgaga

SEQ ID NO: 12965 - DNA, 20 bp, Artificial Sequence
  Description of Artificial Sequence: Synthetic oligonucleotide
  Target: DMPK; (+) strand; PAM type: NRG; PAM sequence: GAG
ttttttttttttttgagaca

SEQ ID NO: 12966 - DNA, 20 bp, Artificial Sequence
  Description of Artificial Sequence: Synthetic oligonucleotide
  Target: DMPK; (+) strand; PAM type: NRG; PAM sequence: CAG
cagagtctcactctgtcacc

SEQ ID NO: 12967 - DNA, 20 bp, Artificial Sequence
  Description of Artificial Sequence: Synthetic oligonucleotide
  Target: DMPK; (+) strand; PAM type: NRG; PAM sequence: TGG
tctcactctgtcacccagac

SEQ ID NO: 12968 - DNA, 20 bp, Artificial Sequence
  Description of Artificial Sequence: Synthetic oligonucleotide
  Target: DMPK; (+) strand; PAM type: NRG; PAM sequence: GAG
tcactctgtcacccagactg

SEQ ID NO: 12969 - DNA, 20 bp, Artificial Sequence
  Description of Artificial Sequence: Synthetic oligonucleotide
  Target: DMPK; (+) strand; PAM type: NRG; PAM sequence: TAG
ctgtcacccagactggagtg

SEQ ID NO: 12970 - DNA, 20 bp, Artificial Sequence
  Description of Artificial Sequence: Synthetic oligonucleotide
  Target: DMPK; (+) strand; PAM type: NRG; PAM sequence: TGG
tcacccagactggagtgtag

SEQ ID NO: 12971 - DNA, 20 bp, Artificial Sequence
  Description of Artificial Sequence: Synthetic oligonucleotide
  Target: DMPK; (+) strand; PAM type: NRG; PAM sequence: TGG
ggagtgtagtggcatgatct

SEQ ID NO: 12972 - DNA, 20 bp, Artificial Sequence
  Description of Artificial Sequence: Synthetic oligonucleotide
  Target: DMPK; (+) strand; PAM type: NRG; PAM sequence: CAG
tcactgcaaactctgcctcc

SEQ ID NO: 12973 - DNA, 20 bp, Artificial Sequence
  Description of Artificial Sequence: Synthetic oligonucleotide
  Target: DMPK; (+) strand; PAM type: NRG; PAM sequence: AGG
cactgcaaactctgcctccc

SEQ ID NO: 12974 - DNA, 20 bp, Artificial Sequence
  Description of Artificial Sequence: Synthetic oligonucleotide
  Target: DMPK; (+) strand; PAM type: NRG; PAM sequence: AAG
aaactctgcctcccaggttc

SEQ ID NO: 12975 - DNA, 20 bp, Artificial Sequence
  Description of Artificial Sequence: Synthetic oligonucleotide
  Target: DMPK; (+) strand; PAM type: NRG; PAM sequence: CAG
ttcaagcaattctcctgcct

SEQ ID NO: 12976 - DNA, 20 bp, Artificial Sequence
  Description of Artificial Sequence: Synthetic oligonucleotide
  Target: DMPK; (+) strand; PAM type: NRG; PAM sequence: CAG
ttctcctgcctcagcttccc

SEQ ID NO: 12977 - DNA, 20 bp, Artificial Sequence
  Description of Artificial Sequence: Synthetic oligonucleotide
  Target: DMPK; (+) strand; PAM type: NRG; PAM sequence: TGG
gcctcagcttccccagtaac

SEQ ID NO: 12978 - DNA, 20 bp, Artificial Sequence
  Description of Artificial Sequence: Synthetic oligonucleotide
  Target: DMPK; (+) strand; PAM type: NRG; PAM sequence: CAG
ttccccagtaactggaatta

SEQ ID NO: 12979 - DNA, 20 bp, Artificial Sequence
  Description of Artificial Sequence: Synthetic oligonucleotide
  Target: DMPK; (+) strand; PAM type: NRG; PAM sequence: AGG
tccccagtaactggaattac

SEQ ID NO: 12980 - DNA, 20 bp, Artificial Sequence
  Description of Artificial Sequence: Synthetic oligonucleotide
  Target: DMPK; (+) strand; PAM type: NRG; PAM sequence: GAG
aactggaattacaggcaccc

SEQ ID NO: 12981 - DNA, 20 bp, Artificial Sequence
  Description of Artificial Sequence: Synthetic oligonucleotide
  Target: DMPK; (+) strand; PAM type: NRG; PAM sequence: CAG
caggcacccgagaccacacc

SEQ ID NO: 12982 - DNA, 20 bp, Artificial Sequence
  Description of Artificial Sequence: Synthetic oligonucleotide
  Target: DMPK; (+) strand; PAM type: NRG; PAM sequence: TAG
agctaattttcttgtatttt

SEQ ID NO: 12983 - DNA, 20 bp, Artificial Sequence
  Description of Artificial Sequence: Synthetic oligonucleotide
  Target: DMPK; (+) strand; PAM type: NRG; PAM sequence: TAG
taattttcttgtatttttag

SEQ ID NO: 12984 - DNA, 20 bp, Artificial Sequence
  Description of Artificial Sequence: Synthetic oligonucleotide
  Target: DMPK; (+) strand; PAM type: NRG; PAM sequence: GAG
attttcttgtatttttagta

SEQ ID NO: 12985 - DNA, 20 bp, Artificial Sequence
  Description of Artificial Sequence: Synthetic oligonucleotide
  Target: DMPK; (+) strand; PAM type: NRG; PAM sequence: CGG
tcttgtatttttagtagaga

SEQ ID NO: 12986 - DNA, 20 bp, Artificial Sequence
  Description of Artificial Sequence: Synthetic oligonucleotide
  Target: DMPK; (+) strand; PAM type: NRG; PAM sequence: GGG
cttgtatttttagtagagac

SEQ ID NO: 12987 - DNA, 20 bp, Artificial Sequence
  Description of Artificial Sequence: Synthetic oligonucleotide
  Target: DMPK; (+) strand; PAM type: NRG; PAM sequence: GGG
ttgtatttttagtagagacg

SEQ ID NO: 12988 - DNA, 20 bp, Artificial Sequence
  Description of Artificial Sequence: Synthetic oligonucleotide
  Target: DMPK; (+) strand; PAM type: NRG; PAM sequence: TGG
gagacggggtttcaccgtgt

SEQ ID NO: 12989 - DNA, 20 bp, Artificial Sequence
  Description of Artificial Sequence: Synthetic oligonucleotide
  Target: DMPK; (+) strand; PAM type: NRG; PAM sequence: CAG
cggggtttcaccgtgttggc

SEQ ID NO: 12990 - DNA, 20 bp, Artificial Sequence
  Description of Artificial Sequence: Synthetic oligonucleotide
  Target: DMPK; (+) strand; PAM type: NRG; PAM sequence: TAG
tttcaccgtgttggccagcc

SEQ ID NO: 12991 - DNA, 20 bp, Artificial Sequence
  Description of Artificial Sequence: Synthetic oligonucleotide
  Target: DMPK; (+) strand; PAM type: NRG; PAM sequence: CGG
ctcctgatctcatgacccac

SEQ ID NO: 12992 - DNA, 20 bp, Artificial Sequence
  Description of Artificial Sequence: Synthetic oligonucleotide
  Target: DMPK; (+) strand; PAM type: NRG; PAM sequence: TGG
atctcatgacccaccggcct

SEQ ID NO: 12993 - DNA, 20 bp, Artificial Sequence
  Description of Artificial Sequence: Synthetic oligonucleotide
  Target: DMPK; (+) strand; PAM type: NRG; PAM sequence: AAG
ccaccggccttggactccca

SEQ ID NO: 12994 - DNA, 20 bp, Artificial Sequence
  Description of Artificial Sequence: Synthetic oligonucleotide
  Target: DMPK; (+) strand; PAM type: NRG; PAM sequence: TGG
gccttggactcccaaagtgc

SEQ ID NO: 12995 - DNA, 20 bp, Artificial Sequence
  Description of Artificial Sequence: Synthetic oligonucleotide
  Target: DMPK; (+) strand; PAM type: NRG; PAM sequence: GGG
ccttggactcccaaagtgct

SEQ ID NO: 12996 - DNA, 20 bp, Artificial Sequence
  Description of Artificial Sequence: Synthetic oligonucleotide
  Target: DMPK; (+) strand; PAM type: NRG; PAM sequence: CAG
ctcccaaagtgctgggatta

SEQ ID NO: 12997 - DNA, 20 bp, Artificial Sequence
  Description of Artificial Sequence: Synthetic oligonucleotide
  Target: DMPK; (+) strand; PAM type: NRG; PAM sequence: AGG
tcccaaagtgctgggattac

SEQ ID NO: 12998 - DNA, 20 bp, Artificial Sequence
  Description of Artificial Sequence: Synthetic oligonucleotide
  Target: DMPK; (+) strand; PAM type: NRG; PAM sequence: GAG
agtgctgggattacaggcat

SEQ ID NO: 12999 - DNA, 20 bp, Artificial Sequence
  Description of Artificial Sequence: Synthetic oligonucleotide
  Target: DMPK; (+) strand; PAM type: NRG; PAM sequence: CAG
gggattacaggcatgagcca

SEQ ID NO: 13000 - DNA, 20 bp, Artificial Sequence
  Description of Artificial Sequence: Synthetic oligonucleotide
  Target: DMPK; (+) strand; PAM type: NRG; PAM sequence: CGG
caggcatgagccacagcgcc

SEQ ID NO: 13001 - DNA, 20 bp, Artificial Sequence
  Description of Artificial Sequence: Synthetic oligonucleotide
  Target: DMPK; (+) strand; PAM type: NRG; PAM sequence: CGG
tgagccacagcgcccggccg

SEQ ID NO: 13002 - DNA, 20 bp, Artificial Sequence
  Description of Artificial Sequence: Synthetic oligonucleotide
  Target: DMPK; (+) strand; PAM type: NRG; PAM sequence: CAG
cacagcgcccggccgcggtc

SEQ ID NO: 13003 - DNA, 20 bp, Artificial Sequence
  Description of Artificial Sequence: Synthetic oligonucleotide
  Target: DMPK; (+) strand; PAM type: NRG; PAM sequence: GAG
ttttttttttttttttttct

SEQ ID NO: 13004 - DNA, 20 bp, Artificial Sequence
  Description of Artificial Sequence: Synthetic oligonucleotide
  Target: DMPK; (+) strand; PAM type: NRG; PAM sequence: CAG
ttttttttttttttctgaga

SEQ ID NO: 13005 - DNA, 20 bp, Artificial Sequence
  Description of Artificial Sequence: Synthetic oligonucleotide
  Target: DMPK; (+) strand; PAM type: NRG; PAM sequence: GAG
ttttttttttttctgagaca

SEQ ID NO: 13006 - DNA, 20 bp, Artificial Sequence
  Description of Artificial Sequence: Synthetic oligonucleotide
  Target: DMPK; (+) strand; PAM type: NRG; PAM sequence: CAG
cagagtctcgctctgtcgcc

SEQ ID NO: 13007 - DNA, 20 bp, Artificial Sequence
  Description of Artificial Sequence: Synthetic oligonucleotide
  Target: DMPK; (+) strand; PAM type: NRG; PAM sequence: AGG
agagtctcgctctgtcgccc

SEQ ID NO: 13008 - DNA, 20 bp, Artificial Sequence
  Description of Artificial Sequence: Synthetic oligonucleotide
  Target: DMPK; (+) strand; PAM type: NRG; PAM sequence: TGG
tctcgctctgtcgcccaggc

SEQ ID NO: 13009 - DNA, 20 bp, Artificial Sequence
  Description of Artificial Sequence: Synthetic oligonucleotide
  Target: DMPK; (+) strand; PAM type: NRG; PAM sequence: GAG
tcgctctgtcgcccaggctg

SEQ ID NO: 13010 - DNA, 20 bp, Artificial Sequence
  Description of Artificial Sequence: Synthetic oligonucleotide
  Target: DMPK; (+) strand; PAM type: NRG; PAM sequence: CAG
ctgtcgcccaggctggagtg

SEQ ID NO: 13011 - DNA, 20 bp, Artificial Sequence
  Description of Artificial Sequence: Synthetic oligonucleotide
  Target: DMPK; (+) strand; PAM type: NRG; PAM sequence: TGG
tcgcccaggctggagtgcag

SEQ ID NO: 13012 - DNA, 20 bp, Artificial Sequence
  Description of Artificial Sequence: Synthetic oligonucleotide
  Target: DMPK; (+) strand; PAM type: NRG; PAM sequence: CGG
ggagtgcagtggcacgatct

SEQ ID NO: 13013 - DNA, 20 bp, Artificial Sequence
  Description of Artificial Sequence: Synthetic oligonucleotide
  Target: DMPK; (+) strand; PAM type: NRG; PAM sequence: CGG
tcactgcaaactctgcctcc

SEQ ID NO: 13014 - DNA, 20 bp, Artificial Sequence
  Description of Artificial Sequence: Synthetic oligonucleotide
  Target: DMPK; (+) strand; PAM type: NRG; PAM sequence: GGG
cactgcaaactctgcctccc

SEQ ID NO: 13015 - DNA, 20 bp, Artificial Sequence
  Description of Artificial Sequence: Synthetic oligonucleotide
  Target: DMPK; (+) strand; PAM type: NRG; PAM sequence: CAG
ttcacgccattctcctgcct

SEQ ID NO: 13016 - DNA, 20 bp, Artificial Sequence
  Description of Artificial Sequence: Synthetic oligonucleotide
  Target: DMPK; (+) strand; PAM type: NRG; PAM sequence: GAG
ttctcctgcctcagcctcct

SEQ ID NO: 13017 - DNA, 20 bp, Artificial Sequence
  Description of Artificial Sequence: Synthetic oligonucleotide
  Target: DMPK; (+) strand; PAM type: NRG; PAM sequence: TAG
tcctgcctcagcctcctgag

SEQ ID NO: 13018 - DNA, 20 bp, Artificial Sequence
  Description of Artificial Sequence: Synthetic oligonucleotide
  Target: DMPK; (+) strand; PAM type: NRG; PAM sequence: TGG
gcctcagcctcctgagtagc

SEQ ID NO: 13019 - DNA, 20 bp, Artificial Sequence
  Description of Artificial Sequence: Synthetic oligonucleotide
  Target: DMPK; (+) strand; PAM type: NRG; PAM sequence: GGG
cctcagcctcctgagtagct

SEQ ID NO: 13020 - DNA, 20 bp, Artificial Sequence
  Description of Artificial Sequence: Synthetic oligonucleotide
  Target: DMPK; (+) strand; PAM type: NRG; PAM sequence: CAG
ctcctgagtagctgggacta

SEQ ID NO: 13021 - DNA, 20 bp, Artificial Sequence
  Description of Artificial Sequence: Synthetic oligonucleotide
  Target: DMPK; (+) strand; PAM type: NRG; PAM sequence: AGG
tcctgagtagctgggactac

SEQ ID NO: 13022 - DNA, 20 bp, Artificial Sequence
  Description of Artificial Sequence: Synthetic oligonucleotide
  Target: DMPK; (+) strand; PAM type: NRG; PAM sequence: TGG
caggcgcccgccaccacgcc

SEQ ID NO: 13023 - DNA, 20 bp, Artificial Sequence
  Description of Artificial Sequence: Synthetic oligonucleotide
  Target: DMPK; (+) strand; PAM type: NRG; PAM sequence: TAG
tggctaattttttgtatttt

SEQ ID NO: 13024 - DNA, 20 bp, Artificial Sequence
  Description of Artificial Sequence: Synthetic oligonucleotide
  Target: DMPK; (+) strand; PAM type: NRG; PAM sequence: AGG
ggctaattttttgtattttt

SEQ ID NO: 13025 - DNA, 20 bp, Artificial Sequence
  Description of Artificial Sequence: Synthetic oligonucleotide
  Target: DMPK; (+) strand; PAM type: NRG; PAM sequence: GAG
ctaattttttgtatttttag

SEQ ID NO: 13026 - DNA, 20 bp, Artificial Sequence
  Description of Artificial Sequence: Synthetic oligonucleotide
  Target: DMPK; (+) strand; PAM type: NRG; PAM sequence: GAG
aattttttgtatttttagga

SEQ ID NO: 13027 - DNA, 20 bp, Artificial Sequence
  Description of Artificial Sequence: Synthetic oligonucleotide
  Target: DMPK; (+) strand; PAM type: NRG; PAM sequence: TGG
ttttgtatttttaggagaga

SEQ ID NO: 13028 - DNA, 20 bp, Artificial Sequence
  Description of Artificial Sequence: Synthetic oligonucleotide
  Target: DMPK; (+) strand; PAM type: NRG; PAM sequence: GGG
tttgtatttttaggagagat

SEQ ID NO: 13029 - DNA, 20 bp, Artificial Sequence
  Description of Artificial Sequence: Synthetic oligonucleotide
  Target: DMPK; (+) strand; PAM type: NRG; PAM sequence: GGG
ttgtatttttaggagagatg

SEQ ID NO: 13030 - DNA, 20 bp, Artificial Sequence
  Description of Artificial Sequence: Synthetic oligonucleotide
  Target: DMPK; (+) strand; PAM type: NRG; PAM sequence: TAG
gagatggggtttcaccgtgt

SEQ ID NO: 13031 - DNA, 20 bp, Artificial Sequence
  Description of Artificial Sequence: Synthetic oligonucleotide
  Target: DMPK; (+) strand; PAM type: NRG; PAM sequence: AAG
ggggtttcaccgtgttagcc

SEQ ID NO: 13032 - DNA, 20 bp, Artificial Sequence
  Description of Artificial Sequence: Synthetic oligonucleotide
  Target: DMPK; (+) strand; PAM type: NRG; PAM sequence: TGG
tttcaccgtgttagccaaga

SEQ ID NO: 13033 - DNA, 20 bp, Artificial Sequence
  Description of Artificial Sequence: Synthetic oligonucleotide
  Target: DMPK; (+) strand; PAM type: NRG; PAM sequence: CGG
acctcgtgatccacccgcct

SEQ ID NO: 13034 - DNA, 20 bp, Artificial Sequence
  Description of Artificial Sequence: Synthetic oligonucleotide
  Target: DMPK; (+) strand; PAM type: NRG; PAM sequence: AAG
ccacccgcctcggcctccca

SEQ ID NO: 13035 - DNA, 20 bp, Artificial Sequence
  Description of Artificial Sequence: Synthetic oligonucleotide
  Target: DMPK; (+) strand; PAM type: NRG; PAM sequence: GAG
cctcggcctcccaaagtgct

SEQ ID NO: 13036 - DNA, 20 bp, Artificial Sequence
  Description of Artificial Sequence: Synthetic oligonucleotide
  Target: DMPK; (+) strand; PAM type: NRG; PAM sequence: CAG
ctcccaaagtgctgagatta

SEQ ID NO: 13037 - DNA, 20 bp, Artificial Sequence
  Description of Artificial Sequence: Synthetic oligonucleotide
  Target: DMPK; (+) strand; PAM type: NRG; PAM sequence: AGG
tcccaaagtgctgagattac

SEQ ID NO: 13038 - DNA, 20 bp, Artificial Sequence
  Description of Artificial Sequence: Synthetic oligonucleotide
  Target: DMPK; (+) strand; PAM type: NRG; PAM sequence: GAG
agtgctgagattacaggcgt

SEQ ID NO: 13039 - DNA, 20 bp, Artificial Sequence
  Description of Artificial Sequence: Synthetic oligonucleotide
  Target: DMPK; (+) strand; PAM type: NRG; PAM sequence: CGG
caggcgtgagccaccacgcc

SEQ ID NO: 13040 - DNA, 20 bp, Artificial Sequence
  Description of Artificial Sequence: Synthetic oligonucleotide
  Target: DMPK; (+) strand; PAM type: NRG; PAM sequence: CAG
cgtgagccaccacgcccggc

SEQ ID NO: 13041 - DNA, 20 bp, Artificial Sequence
  Description of Artificial Sequence: Synthetic oligonucleotide
  Target: DMPK; (+) strand; PAM type: NRG; PAM sequence: CAG
gccaccacgcccggccagcc

SEQ ID NO: 13042 - DNA, 20 bp, Artificial Sequence
  Description of Artificial Sequence: Synthetic oligonucleotide
  Target: DMPK; (+) strand; PAM type: NRG; PAM sequence: CAG
cccagcctattttttaattt

SEQ ID NO: 13043 - DNA, 20 bp, Artificial Sequence
  Description of Artificial Sequence: Synthetic oligonucleotide
  Target: DMPK; (+) strand; PAM type: NRG; PAM sequence: GAG
tttcagtttatcttattttt

SEQ ID NO: 13044 - DNA, 20 bp, Artificial Sequence
  Description of Artificial Sequence: Synthetic oligonucleotide
  Target: DMPK; (+) strand; PAM type: NRG; PAM sequence: CAG
agtttatcttatttttgaga

SEQ ID NO: 13045 - DNA, 20 bp, Artificial Sequence
  Description of Artificial Sequence: Synthetic oligonucleotide
  Target: DMPK; (+) strand; PAM type: NRG; PAM sequence: GAG
tttatcttatttttgagaca

SEQ ID NO: 13046 - DNA, 20 bp, Artificial Sequence
  Description of Artificial Sequence: Synthetic oligonucleotide
  Target: DMPK; (+) strand; PAM type: NRG; PAM sequence: CAG
cagagtctctctccgttgcc

SEQ ID NO: 13047 - DNA, 20 bp, Artificial Sequence
  Description of Artificial Sequence: Synthetic oligonucleotide
  Target: DMPK; (+) strand; PAM type: NRG; PAM sequence: AGG
agagtctctctccgttgccc

SEQ ID NO: 13048 - DNA, 20 bp, Artificial Sequence
  Description of Artificial Sequence: Synthetic oligonucleotide
  Target: DMPK; (+) strand; PAM type: NRG; PAM sequence: TGG
tctctctccgttgcccaggc

SEQ ID NO: 13049 - DNA, 20 bp, Artificial Sequence
  Description of Artificial Sequence: Synthetic oligonucleotide
  Target: DMPK; (+) strand; PAM type: NRG; PAM sequence: GAG
tctctccgttgcccaggctg

SEQ ID NO: 13050 - DNA, 20 bp, Artificial Sequence
  Description of Artificial Sequence: Synthetic oligonucleotide
  Target: DMPK; (+) strand; PAM type: NRG; PAM sequence: CAG
ccgttgcccaggctggagtg

SEQ ID NO: 13051 - DNA, 20 bp, Artificial Sequence
  Description of Artificial Sequence: Synthetic oligonucleotide
  Target: DMPK; (+) strand; PAM type: NRG; PAM sequence: TGG
ttgcccaggctggagtgcag

SEQ ID NO: 13052 - DNA, 20 bp, Artificial Sequence
  Description of Artificial Sequence: Synthetic oligonucleotide
  Target: DMPK; (+) strand; PAM type: NRG; PAM sequence: CAG
ggagtgcagtggcacaatca

SEQ ID NO: 13053 - DNA, 20 bp, Artificial Sequence
  Description of Artificial Sequence: Synthetic oligonucleotide
  Target: DMPK; (+) strand; PAM type: NRG; PAM sequence: CAG
ggcacaatcacagctcactg

SEQ ID NO: 13054 - DNA, 20 bp, Artificial Sequence
  Description of Artificial Sequence: Synthetic oligonucleotide
  Target: DMPK; (+) strand; PAM type: NRG; PAM sequence: TGG
tcactgcagccttgacctcc

SEQ ID NO: 13055 - DNA, 20 bp, Artificial Sequence
  Description of Artificial Sequence: Synthetic oligonucleotide
  Target: DMPK; (+) strand; PAM type: NRG; PAM sequence: GGG
cactgcagccttgacctcct

SEQ ID NO: 13056 - DNA, 20 bp, Artificial Sequence
  Description of Artificial Sequence: Synthetic oligonucleotide
  Target: DMPK; (+) strand; PAM type: NRG; PAM sequence: AAG
agccttgacctcctgggctc

SEQ ID NO: 13057 - DNA, 20 bp, Artificial Sequence
  Description of Artificial Sequence: Synthetic oligonucleotide
  Target: DMPK; (+) strand; PAM type: NRG; PAM sequence: CGG
tcctgggctcaagcccacgt

SEQ ID NO: 13058 - DNA, 20 bp, Artificial Sequence
  Description of Artificial Sequence: Synthetic oligonucleotide
  Target: DMPK; (+) strand; PAM type: NRG; PAM sequence: TAG
caagcccacgtcggccaccc

SEQ ID NO: 13059 - DNA, 20 bp, Artificial Sequence
  Description of Artificial Sequence: Synthetic oligonucleotide
  Target: DMPK; (+) strand; PAM type: NRG; PAM sequence: TAG
gcccacgtcggccaccctag

SEQ ID NO: 13060 - DNA, 20 bp, Artificial Sequence
  Description of Artificial Sequence: Synthetic oligonucleotide
  Target: DMPK; (+) strand; PAM type: NRG; PAM sequence: GAG
cgtcggccaccctagtagct

SEQ ID NO: 13061 - DNA, 20 bp, Artificial Sequence
  Description of Artificial Sequence: Synthetic oligonucleotide
  Target: DMPK; (+) strand; PAM type: NRG; PAM sequence: CAG
caccctagtagctgagtata

SEQ ID NO: 13062 - DNA, 20 bp, Artificial Sequence
  Description of Artificial Sequence: Synthetic oligonucleotide
  Target: DMPK; (+) strand; PAM type: NRG; PAM sequence: AGG
accctagtagctgagtatac

SEQ ID NO: 13063 - DNA, 20 bp, Artificial Sequence
  Description of Artificial Sequence: Synthetic oligonucleotide
  Target: DMPK; (+) strand; PAM type: NRG; PAM sequence: TAG
caatttttaaaacatttttg

SEQ ID NO: 13064 - DNA, 20 bp, Artificial Sequence
  Description of Artificial Sequence: Synthetic oligonucleotide
  Target: DMPK; (+) strand; PAM type: NRG; PAM sequence: GAG
atttttaaaacatttttgta

SEQ ID NO: 13065 - DNA, 20 bp, Artificial Sequence
  Description of Artificial Sequence: Synthetic oligonucleotide
  Target: DMPK; (+) strand; PAM type: NRG; PAM sequence: CGG
ttaaaacatttttgtagaga

SEQ ID NO: 13066 - DNA, 20 bp, Artificial Sequence
  Description of Artificial Sequence: Synthetic oligonucleotide
  Target: DMPK; (+) strand; PAM type: NRG; PAM sequence: GGG
taaaacatttttgtagagac

SEQ ID NO: 13067 - DNA, 20 bp, Artificial Sequence
  Description of Artificial Sequence: Synthetic oligonucleotide
  Target: DMPK; (+) strand; PAM type: NRG; PAM sequence: GGG
aaaacatttttgtagagacg

SEQ ID NO: 13068 - DNA, 20 bp, Artificial Sequence
  Description of Artificial Sequence: Synthetic oligonucleotide
  Target: DMPK; (+) strand; PAM type: NRG; PAM sequence: GGG
aaacatttttgtagagacgg

SEQ ID NO: 13069 - DNA, 20 bp, Artificial Sequence
  Description of Artificial Sequence: Synthetic oligonucleotide
  Target: DMPK; (+) strand; PAM type: NRG; PAM sequence: CAG
gggggtctcaccacattgcc

SEQ ID NO: 13070 - DNA, 20 bp, Artificial Sequence
  Description of Artificial Sequence: Synthetic oligonucleotide
  Target: DMPK; (+) strand; PAM type: NRG; PAM sequence: AGG
ggggtctcaccacattgccc

SEQ ID NO: 13071 - DNA, 20 bp, Artificial Sequence
  Description of Artificial Sequence: Synthetic oligonucleotide
  Target: DMPK; (+) strand; PAM type: NRG; PAM sequence: TGG
tctcaccacattgcccaggc

SEQ ID NO: 13072 - DNA, 20 bp, Artificial Sequence
  Description of Artificial Sequence: Synthetic oligonucleotide
  Target: DMPK; (+) strand; PAM type: NRG; PAM sequence: TGG
ccaggctggtctcgaactcc

SEQ ID NO: 13073 - DNA, 20 bp, Artificial Sequence
  Description of Artificial Sequence: Synthetic oligonucleotide
  Target: DMPK; (+) strand; PAM type: NRG; PAM sequence: GGG
caggctggtctcgaactcct

SEQ ID NO: 13074 - DNA, 20 bp, Artificial Sequence
  Description of Artificial Sequence: Synthetic oligonucleotide
  Target: DMPK; (+) strand; PAM type: NRG; PAM sequence: AAG
ggtctcgaactcctgggctc

SEQ ID NO: 13075 - DNA, 20 bp, Artificial Sequence
  Description of Artificial Sequence: Synthetic oligonucleotide
  Target: DMPK; (+) strand; PAM type: NRG; PAM sequence: CGG
ctcaagcaatccacccactt

SEQ ID NO: 13076 - DNA, 20 bp, Artificial Sequence
  Description of Artificial Sequence: Synthetic oligonucleotide
  Target: DMPK; (+) strand; PAM type: NRG; PAM sequence: TGG
acttcggcctgccaaattgc

SEQ ID NO: 13077 - DNA, 20 bp, Artificial Sequence
  Description of Artificial Sequence: Synthetic oligonucleotide
  Target: DMPK; (+) strand; PAM type: NRG; PAM sequence: GGG
cttcggcctgccaaattgct

SEQ ID NO: 13078 - DNA, 20 bp, Artificial Sequence
  Description of Artificial Sequence: Synthetic oligonucleotide
  Target: DMPK; (+) strand; PAM type: NRG; PAM sequence: GGG
ttcggcctgccaaattgctg

SEQ ID NO: 13079 - DNA, 20 bp, Artificial Sequence
  Description of Artificial Sequence: Synthetic oligonucleotide
  Target: DMPK; (+) strand; PAM type: NRG; PAM sequence: CAG
ctgccaaattgctggggtta

SEQ ID NO: 13080 - DNA, 20 bp, Artificial Sequence
  Description of Artificial Sequence: Synthetic oligonucleotide
  Target: DMPK; (+) strand; PAM type: NRG; PAM sequence: AGG
tgccaaattgctggggttac

SEQ ID NO: 13081 - DNA, 20 bp, Artificial Sequence
  Description of Artificial Sequence: Synthetic oligonucleotide
  Target: DMPK; (+) strand; PAM type: NRG; PAM sequence: GAG
attgctggggttacaggcgt

SEQ ID NO: 13082 - DNA, 20 bp, Artificial Sequence
  Description of Artificial Sequence: Synthetic oligonucleotide
  Target: DMPK; (+) strand; PAM type: NRG; PAM sequence: TGG
caggcgtgagccaccgtgcc

SEQ ID NO: 13083 - DNA, 20 bp, Artificial Sequence
  Description of Artificial Sequence: Synthetic oligonucleotide
  Target: DMPK; (+) strand; PAM type: NRG; PAM sequence: CAG
tgtatcctgttgcttccctt

SEQ ID NO: 13084 - DNA, 20 bp, Artificial Sequence
  Description of Artificial Sequence: Synthetic oligonucleotide
  Target: DMPK; (+) strand; PAM type: NRG; PAM sequence: AGG
gtatcctgttgcttcccttc

SEQ ID NO: 13085 - DNA, 20 bp, Artificial Sequence
  Description of Artificial Sequence: Synthetic oligonucleotide
  Target: DMPK; (+) strand; PAM type: NRG; PAM sequence: GGG
tatcctgttgcttcccttca

SEQ ID NO: 13086 - DNA, 20 bp, Artificial Sequence
  Description of Artificial Sequence: Synthetic oligonucleotide
  Target: DMPK; (+) strand; PAM type: NRG; PAM sequence: TAG
tccataattctctaattctc

SEQ ID NO: 13087 - DNA, 20 bp, Artificial Sequence
  Description of Artificial Sequence: Synthetic oligonucleotide
  Target: DMPK; (+) strand; PAM type: NRG; PAM sequence: TGG
ctaattctctagactgcaac

SEQ ID NO: 13088 - DNA, 20 bp, Artificial Sequence
  Description of Artificial Sequence: Synthetic oligonucleotide
  Target: DMPK; (+) strand; PAM type: NRG; PAM sequence: GAG
tctctagactgcaactggat

SEQ ID NO: 13089 - DNA, 20 bp, Artificial Sequence
  Description of Artificial Sequence: Synthetic oligonucleotide
  Target: DMPK; (+) strand; PAM type: NRG; PAM sequence: AGG
ctctagactgcaactggatg

SEQ ID NO: 13090 - DNA, 20 bp, Artificial Sequence
  Description of Artificial Sequence: Synthetic oligonucleotide
  Target: DMPK; (+) strand; PAM type: NRG; PAM sequence: GGG
tctagactgcaactggatga

SEQ ID NO: 13091 - DNA, 20 bp, Artificial Sequence
  Description of Artificial Sequence: Synthetic oligonucleotide
  Target: DMPK; (+) strand; PAM type: NRG; PAM sequence: CAG
agactgcaactggatgaggg

SEQ ID NO: 13092 - DNA, 20 bp, Artificial Sequence
  Description of Artificial Sequence: Synthetic oligonucleotide
  Target: DMPK; (+) strand; PAM type: NRG; PAM sequence: AGG
gactgcaactggatgagggc

SEQ ID NO: 13093 - DNA, 20 bp, Artificial Sequence
  Description of Artificial Sequence: Synthetic oligonucleotide
  Target: DMPK; (+) strand; PAM type: NRG; PAM sequence: GGG
actgcaactggatgagggca

SEQ ID NO: 13094 - DNA, 20 bp, Artificial Sequence
  Description of Artificial Sequence: Synthetic oligonucleotide
  Target: DMPK; (+) strand; PAM type: NRG; PAM sequence: CAG
aactggatgagggcagggac

SEQ ID NO: 13095 - DNA, 20 bp, Artificial Sequence
  Description of Artificial Sequence: Synthetic oligonucleotide
  Target: DMPK; (+) strand; PAM type: NRG; PAM sequence: GAG
ctggatgagggcagggacca

SEQ ID NO: 13096 - DNA, 20 bp, Artificial Sequence
  Description of Artificial Sequence: Synthetic oligonucleotide
  Target: DMPK; (+) strand; PAM type: NRG; PAM sequence: TGG
ggcagggaccagagctcatc

SEQ ID NO: 13097 - DNA, 20 bp, Artificial Sequence
  Description of Artificial Sequence: Synthetic oligonucleotide
  Target: DMPK; (+) strand; PAM type: NRG; PAM sequence: TGG
agagctcatctggtccgtgc

SEQ ID NO: 13098 - DNA, 20 bp, Artificial Sequence
  Description of Artificial Sequence: Synthetic oligonucleotide
  Target: DMPK; (+) strand; PAM type: NRG; PAM sequence: CAG
tctggtccgtgctggatccc

SEQ ID NO: 13099 - DNA, 20 bp, Artificial Sequence
  Description of Artificial Sequence: Synthetic oligonucleotide
  Target: DMPK; (+) strand; PAM type: NRG; PAM sequence: CAG
gctggatccccagtattgtt

SEQ ID NO: 13100 - DNA, 20 bp, Artificial Sequence
  Description of Artificial Sequence: Synthetic oligonucleotide
  Target: DMPK; (+) strand; PAM type: NRG; PAM sequence: AAG
tccccagtattgttcagcaa

SEQ ID NO: 13101 - DNA, 20 bp, Artificial Sequence
  Description of Artificial Sequence: Synthetic oligonucleotide
  Target: DMPK; (+) strand; PAM type: NRG; PAM sequence: AGG
ccccagtattgttcagcaaa

SEQ ID NO: 13102 - DNA, 20 bp, Artificial Sequence
  Description of Artificial Sequence: Synthetic oligonucleotide
  Target: DMPK; (+) strand; PAM type: NRG; PAM sequence: GGG
cccagtattgttcagcaaaa

SEQ ID NO: 13103 - DNA, 20 bp, Artificial Sequence
  Description of Artificial Sequence: Synthetic oligonucleotide
  Target: DMPK; (+) strand; PAM type: NRG; PAM sequence: CAG
ttgttcagcaaaagggcacc

SEQ ID NO: 13104 - DNA, 20 bp, Artificial Sequence
  Description of Artificial Sequence: Synthetic oligonucleotide
  Target: DMPK; (+) strand; PAM type: NRG; PAM sequence: GAG
gttcagcaaaagggcaccca

SEQ ID NO: 13105 - DNA, 20 bp, Artificial Sequence
  Description of Artificial Sequence: Synthetic oligonucleotide
  Target: DMPK; (+) strand; PAM type: NRG; PAM sequence: GAG
gcaaaagggcacccagagcc

SEQ ID NO: 13106 - DNA, 20 bp, Artificial Sequence
  Description of Artificial Sequence: Synthetic oligonucleotide
  Target: DMPK; (+) strand; PAM type: NRG; PAM sequence: AAG
aagggcacccagagccgagc

SEQ ID NO: 13107 - DNA, 20 bp, Artificial Sequence
  Description of Artificial Sequence: Synthetic oligonucleotide
  Target: DMPK; (+) strand; PAM type: NRG; PAM sequence: CAG
gccgagcaagcatgccatga

SEQ ID NO: 13108 - DNA, 20 bp, Artificial Sequence
  Description of Artificial Sequence: Synthetic oligonucleotide
  Target: DMPK; (+) strand; PAM type: NRG; PAM sequence: CGG
tgccatgacagcttgttaca

SEQ ID NO: 13109 - DNA, 20 bp, Artificial Sequence
  Description of Artificial Sequence: Synthetic oligonucleotide
  Target: DMPK; (+) strand; PAM type: NRG; PAM sequence: AAG
tgacagcttgttacacggtg

SEQ ID NO: 13110 - DNA, 20 bp, Artificial Sequence
  Description of Artificial Sequence: Synthetic oligonucleotide
  Target: DMPK; (+) strand; PAM type: NRG; PAM sequence: GAG
acagcttgttacacggtgaa

SEQ ID NO: 13111 - DNA, 20 bp, Artificial Sequence
  Description of Artificial Sequence: Synthetic oligonucleotide
  Target: DMPK; (+) strand; PAM type: NRG; PAM sequence: GAG
agcttgttacacggtgaaga

SEQ ID NO: 13112 - DNA, 20 bp, Artificial Sequence
  Description of Artificial Sequence: Synthetic oligonucleotide
  Target: DMPK; (+) strand; PAM type: NRG; PAM sequence: CGG
tgttacacggtgaagagaga

SEQ ID NO: 13113 - DNA, 20 bp, Artificial Sequence
  Description of Artificial Sequence: Synthetic oligonucleotide
  Target: DMPK; (+) strand; PAM type: NRG; PAM sequence: AAG
acggtgaagagagacggcct

SEQ ID NO: 13114 - DNA, 20 bp, Artificial Sequence
  Description of Artificial Sequence: Synthetic oligonucleotide
  Target: DMPK; (+) strand; PAM type: NRG; PAM sequence: AGG
cggtgaagagagacggccta

SEQ ID NO: 13115 - DNA, 20 bp, Artificial Sequence
  Description of Artificial Sequence: Synthetic oligonucleotide
  Target: DMPK; (+) strand; PAM type: NRG; PAM sequence: GGG
ggtgaagagagacggcctaa

SEQ ID NO: 13116 - DNA, 20 bp, Artificial Sequence
  Description of Artificial Sequence: Synthetic oligonucleotide
  Target: DMPK; (+) strand; PAM type: NRG; PAM sequence: GAG
tgaagagagacggcctaagg

SEQ ID NO: 13117 - DNA, 20 bp, Artificial Sequence
  Description of Artificial Sequence: Synthetic oligonucleotide
  Target: DMPK; (+) strand; PAM type: NRG; PAM sequence: AGG
gaagagagacggcctaaggg

SEQ ID NO: 13118 - DNA, 20 bp, Artificial Sequence
  Description of Artificial Sequence: Synthetic oligonucleotide
  Target: DMPK; (+) strand; PAM type: NRG; PAM sequence: GAG
agagagacggcctaagggag

SEQ ID NO: 13119 - DNA, 20 bp, Artificial Sequence
  Description of Artificial Sequence: Synthetic oligonucleotide
  Target: DMPK; (+) strand; PAM type: NRG; PAM sequence: AGG
gagagacggcctaagggagg

SEQ ID NO: 13120 - DNA, 20 bp, Artificial Sequence
  Description of Artificial Sequence: Synthetic oligonucleotide
  Target: DMPK; (+) strand; PAM type: NRG; PAM sequence: GAG
gagacggcctaagggaggag

SEQ ID NO: 13121 - DNA, 20 bp, Artificial Sequence
  Description of Artificial Sequence: Synthetic oligonucleotide
  Target: DMPK; (+) strand; PAM type: NRG; PAM sequence: AAG
ctcctgcttctcatccctcc

SEQ ID NO: 13122 - DNA, 20 bp, Artificial Sequence
  Description of Artificial Sequence: Synthetic oligonucleotide
  Target: DMPK; (+) strand; PAM type: NRG; PAM sequence: CAG
cttctcatccctccaagtct

SEQ ID NO: 13123 - DNA, 20 bp, Artificial Sequence
  Description of Artificial Sequence: Synthetic oligonucleotide
  Target: DMPK; (+) strand; PAM type: NRG; PAM sequence: CAG
catccctccaagtctcagct

SEQ ID NO: 13124 - DNA, 20 bp, Artificial Sequence
  Description of Artificial Sequence: Synthetic oligonucleotide
  Target: DMPK; (+) strand; PAM type: NRG; PAM sequence: TAG
cctccaagtctcagctcaga

SEQ ID NO: 13125 - DNA, 20 bp, Artificial Sequence
  Description of Artificial Sequence: Synthetic oligonucleotide
  Target: DMPK; (+) strand; PAM type: NRG; PAM sequence: CAG
gctcagatagctccccactc

SEQ ID NO: 13126 - DNA, 20 bp, Artificial Sequence
  Description of Artificial Sequence: Synthetic oligonucleotide
  Target: DMPK; (+) strand; PAM type: NRG; PAM sequence: AAG
agatagctccccactccaga

SEQ ID NO: 13127 - DNA, 20 bp, Artificial Sequence
  Description of Artificial Sequence: Synthetic oligonucleotide
  Target: DMPK; (+) strand; PAM type: NRG; PAM sequence: CAG
ccccactccagaaagccctc

SEQ ID NO: 13128 - DNA, 20 bp, Artificial Sequence
  Description of Artificial Sequence: Synthetic oligonucleotide
  Target: DMPK; (+) strand; PAM type: NRG; PAM sequence: AGG
cccactccagaaagccctcc

SEQ ID NO: 13129 - DNA, 20 bp, Artificial Sequence
  Description of Artificial Sequence: Synthetic oligonucleotide
  Target: DMPK; (+) strand; PAM type: NRG; PAM sequence: GAG
cctccaggaccttccttgct

SEQ ID NO: 13130 - DNA, 20 bp, Artificial Sequence
  Description of Artificial Sequence: Synthetic oligonucleotide
  Target: DMPK; (+) strand; PAM type: NRG; PAM sequence: CAG
caggaccttccttgctgagt

SEQ ID NO: 13131 - DNA, 20 bp, Artificial Sequence
  Description of Artificial Sequence: Synthetic oligonucleotide
  Target: DMPK; (+) strand; PAM type: NRG; PAM sequence: AGG
aggaccttccttgctgagtc

SEQ ID NO: 13132 - DNA, 20 bp, Artificial Sequence
  Description of Artificial Sequence: Synthetic oligonucleotide
  Target: DMPK; (+) strand; PAM type: NRG; PAM sequence: GAG
gaccttccttgctgagtcag

SEQ ID NO: 13133 - DNA, 20 bp, Artificial Sequence
  Description of Artificial Sequence: Synthetic oligonucleotide
  Target: DMPK; (+) strand; PAM type: NRG; PAM sequence: CAG
ccccctgcactccattgtct

SEQ ID NO: 13134 - DNA, 20 bp, Artificial Sequence
  Description of Artificial Sequence: Synthetic oligonucleotide
  Target: DMPK; (+) strand; PAM type: NRG; PAM sequence: TGG
tgtctcagccctgatcactc

SEQ ID NO: 13135 - DNA, 20 bp, Artificial Sequence
  Description of Artificial Sequence: Synthetic oligonucleotide
  Target: DMPK; (+) strand; PAM type: NRG; PAM sequence: GGG
gtctcagccctgatcactct

SEQ ID NO: 13136 - DNA, 20 bp, Artificial Sequence
  Description of Artificial Sequence: Synthetic oligonucleotide
  Target: DMPK; (+) strand; PAM type: NRG; PAM sequence: GGG
tctcagccctgatcactctg

SEQ ID NO: 13137 - DNA, 20 bp, Artificial Sequence
  Description of Artificial Sequence: Synthetic oligonucleotide
  Target: DMPK; (+) strand; PAM type: NRG; PAM sequence: AAG
ctctggggccttactgtctg

SEQ ID NO: 13138 - DNA, 20 bp, Artificial Sequence
  Description of Artificial Sequence: Synthetic oligonucleotide
  Target: DMPK; (+) strand; PAM type: NRG; PAM sequence: TGG
actgctctgtgttcccccac

SEQ ID NO: 13139 - DNA, 20 bp, Artificial Sequence
  Description of Artificial Sequence: Synthetic oligonucleotide
  Target: DMPK; (+) strand; PAM type: NRG; PAM sequence: AAG
gtgttcccccactggactgt

SEQ ID NO: 13140 - DNA, 20 bp, Artificial Sequence
  Description of Artificial Sequence: Synthetic oligonucleotide
  Target: DMPK; (+) strand; PAM type: NRG; PAM sequence: TAG
cccccactggactgtaagtc

SEQ ID NO: 13141 - DNA, 20 bp, Artificial Sequence
  Description of Artificial Sequence: Synthetic oligonucleotide
  Target: DMPK; (+) strand; PAM type: NRG; PAM sequence: AGG
ccccactggactgtaagtct

SEQ ID NO: 13142 - DNA, 20 bp, Artificial Sequence
  Description of Artificial Sequence: Synthetic oligonucleotide
  Target: DMPK; (+) strand; PAM type: NRG; PAM sequence: TGG
ctgtaagtctaggtcactgc

SEQ ID NO: 13143 - DNA, 20 bp, Artificial Sequence
  Description of Artificial Sequence: Synthetic oligonucleotide
  Target: DMPK; (+) strand; PAM type: NRG; PAM sequence: GGG
tgtaagtctaggtcactgct

SEQ ID NO: 13144 - DNA, 20 bp, Artificial Sequence
  Description of Artificial Sequence: Synthetic oligonucleotide
  Target: DMPK; (+) strand; PAM type: NRG; PAM sequence: CAG
ctaggtcactgctgggtcct

SEQ ID NO: 13145 - DNA, 20 bp, Artificial Sequence
  Description of Artificial Sequence: Synthetic oligonucleotide
  Target: DMPK; (+) strand; PAM type: NRG; PAM sequence: TAG
ggtcactgctgggtcctcag

SEQ ID NO: 13146 - DNA, 20 bp, Artificial Sequence
  Description of Artificial Sequence: Synthetic oligonucleotide
  Target: DMPK; (+) strand; PAM type: NRG; PAM sequence: TAG
cactgctgggtcctcagtag

SEQ ID NO: 13147 - DNA, 20 bp, Artificial Sequence
  Description of Artificial Sequence: Synthetic oligonucleotide
  Target: DMPK; (+) strand; PAM type: NRG; PAM sequence: TGG
gctgggtcctcagtagtaga

SEQ ID NO: 13148 - DNA, 20 bp, Artificial Sequence
  Description of Artificial Sequence: Synthetic oligonucleotide
  Target: DMPK; (+) strand; PAM type: NRG; PAM sequence: GGG
ctgggtcctcagtagtagat

SEQ ID NO: 13149 - DNA, 20 bp, Artificial Sequence
  Description of Artificial Sequence: Synthetic oligonucleotide
  Target: DMPK; (+) strand; PAM type: NRG; PAM sequence: CAG
tcctcagtagtagatgggca

SEQ ID NO: 13150 - DNA, 20 bp, Artificial Sequence
  Description of Artificial Sequence: Synthetic oligonucleotide
  Target: DMPK; (+) strand; PAM type: NRG; PAM sequence: GAG
ctcagtagtagatgggcaca

SEQ ID NO: 13151 - DNA, 20 bp, Artificial Sequence
  Description of Artificial Sequence: Synthetic oligonucleotide
  Target: DMPK; (+) strand; PAM type: NRG; PAM sequence: CAG
agtagtagatgggcacagag

SEQ ID NO: 13152 - DNA, 20 bp, Artificial Sequence
  Description of Artificial Sequence: Synthetic oligonucleotide
  Target: DMPK; (+) strand; PAM type: NRG; PAM sequence: AGG
gtagtagatgggcacagagc

SEQ ID NO: 13153 - DNA, 20 bp, Artificial Sequence
  Description of Artificial Sequence: Synthetic oligonucleotide
  Target: DMPK; (+) strand; PAM type: NRG; PAM sequence: TGG
tgggcacagagcaggtgctc

SEQ ID NO: 13154 - DNA, 20 bp, Artificial Sequence
  Description of Artificial Sequence: Synthetic oligonucleotide
  Target: DMPK; (+) strand; PAM type: NRG; PAM sequence: GGG
gggcacagagcaggtgctct

SEQ ID NO: 13155 - DNA, 20 bp, Artificial Sequence
  Description of Artificial Sequence: Synthetic oligonucleotide
  Target: DMPK; (+) strand; PAM type: NRG; PAM sequence: GGG
ggcacagagcaggtgctctg

SEQ ID NO: 13156 - DNA, 20 bp, Artificial Sequence
  Description of Artificial Sequence: Synthetic oligonucleotide
  Target: DMPK; (+) strand; PAM type: NRG; PAM sequence: GAG
gagcaggtgctctggggaat

SEQ ID NO: 13157 - DNA, 20 bp, Artificial Sequence
  Description of Artificial Sequence: Synthetic oligonucleotide
  Target: DMPK; (+) strand; PAM type: NRG; PAM sequence: CAG
gctctggggaatgagtgatt

SEQ ID NO: 13158 - DNA, 20 bp, Artificial Sequence
  Description of Artificial Sequence: Synthetic oligonucleotide
  Target: DMPK; (+) strand; PAM type: NRG; PAM sequence: AGG
ctctggggaatgagtgattc

SEQ ID NO: 13159 - DNA, 20 bp, Artificial Sequence
  Description of Artificial Sequence: Synthetic oligonucleotide
  Target: DMPK; (+) strand; PAM type: NRG; PAM sequence: CAG
gaatgagtgattcaggaccc

SEQ ID NO: 13160 - DNA, 20 bp, Artificial Sequence
  Description of Artificial Sequence: Synthetic oligonucleotide
  Target: DMPK; (+) strand; PAM type: NRG; PAM sequence: AAG
tgagtgattcaggaccccag

SEQ ID NO: 13161 - DNA, 20 bp, Artificial Sequence
  Description of Artificial Sequence: Synthetic oligonucleotide
  Target: DMPK; (+) strand; PAM type: NRG; PAM sequence: AGG
gagtgattcaggaccccaga

SEQ ID NO: 13162 - DNA, 20 bp, Artificial Sequence
  Description of Artificial Sequence: Synthetic oligonucleotide
  Target: DMPK; (+) strand; PAM type: NRG; PAM sequence: TAG
tgattcaggaccccagaagg

SEQ ID NO: 13163 - DNA, 20 bp, Artificial Sequence
  Description of Artificial Sequence: Synthetic oligonucleotide
  Target: DMPK; (+) strand; PAM type: NRG; PAM sequence: AGG
gattcaggaccccagaaggt

SEQ ID NO: 13164 - DNA, 20 bp, Artificial Sequence
  Description of Artificial Sequence: Synthetic oligonucleotide
  Target: DMPK; (+) strand; PAM type: NRG; PAM sequence: TGG
ctgtccttactccaacttta

SEQ ID NO: 13165 - DNA, 20 bp, Artificial Sequence
  Description of Artificial Sequence: Synthetic oligonucleotide
  Target: DMPK; (+) strand; PAM type: NRG; PAM sequence: GAG
gtccttactccaactttatg

SEQ ID NO: 13166 - DNA, 20 bp, Artificial Sequence
  Description of Artificial Sequence: Synthetic oligonucleotide
  Target: DMPK; (+) strand; PAM type: NRG; PAM sequence: AGG
tccttactccaactttatgg

SEQ ID NO: 13167 - DNA, 20 bp, Artificial Sequence
  Description of Artificial Sequence: Synthetic oligonucleotide
  Target: DMPK; (+) strand; PAM type: NRG; PAM sequence: GGG
ccttactccaactttatgga

SEQ ID NO: 13168 - DNA, 20 bp, Artificial Sequence
  Description of Artificial Sequence: Synthetic oligonucleotide
  Target: DMPK; (+) strand; PAM type: NRG; PAM sequence: GAG
ttactccaactttatggagg

SEQ ID NO: 13169 - DNA, 20 bp, Artificial Sequence
  Description of Artificial Sequence: Synthetic oligonucleotide
  Target: DMPK; (+) strand; PAM type: NRG; PAM sequence: TGG
ccaactttatggagggagca

SEQ ID NO: 13170 - DNA, 20 bp, Artificial Sequence
  Description of Artificial Sequence: Synthetic oligonucleotide
  Target: DMPK; (+) strand; PAM type: NRG; PAM sequence: GGG
caactttatggagggagcat

SEQ ID NO: 13171 - DNA, 20 bp, Artificial Sequence
  Description of Artificial Sequence: Synthetic oligonucleotide
  Target: DMPK; (+) strand; PAM type: NRG; PAM sequence: GGG
aactttatggagggagcatg

SEQ ID NO: 13172 - DNA, 20 bp, Artificial Sequence
  Description of Artificial Sequence: Synthetic oligonucleotide
  Target: DMPK; (+) strand; PAM type: NRG; PAM sequence: GAG
ctttatggagggagcatggg

SEQ ID NO: 13173 - DNA, 20 bp, Artificial Sequence
  Description of Artificial Sequence: Synthetic oligonucleotide
  Target: DMPK; (+) strand; PAM type: NRG; PAM sequence: AGG
tttatggagggagcatgggg

SEQ ID NO: 13174 - DNA, 20 bp, Artificial Sequence
  Description of Artificial Sequence: Synthetic oligonucleotide
  Target: DMPK; (+) strand; PAM type: NRG; PAM sequence: CAG
ggagcatggggaggttcccg

SEQ ID NO: 13175 - DNA, 20 bp, Artificial Sequence
  Description of Artificial Sequence: Synthetic oligonucleotide
  Target: DMPK; (+) strand; PAM type: NRG; PAM sequence: GAG
atggggaggttcccgcagcc

SEQ ID NO: 13176 - DNA, 20 bp, Artificial Sequence
  Description of Artificial Sequence: Synthetic oligonucleotide
  Target: DMPK; (+) strand; PAM type: NRG; PAM sequence: CAG
gggaggttcccgcagccgag

SEQ ID NO: 13177 - DNA, 20 bp, Artificial Sequence
  Description of Artificial Sequence: Synthetic oligonucleotide
  Target: DMPK; (+) strand; PAM type: NRG; PAM sequence: AGG
ggaggttcccgcagccgagc

SEQ ID NO: 13178 - DNA, 20 bp, Artificial Sequence
  Description of Artificial Sequence: Synthetic oligonucleotide
  Target: DMPK; (+) strand; PAM type: NRG; PAM sequence: GGG
gaggttcccgcagccgagca

SEQ ID NO: 13179 - DNA, 20 bp, Artificial Sequence
  Description of Artificial Sequence: Synthetic oligonucleotide
  Target: DMPK; (+) strand; PAM type: NRG; PAM sequence: GGG
aggttcccgcagccgagcag

SEQ ID NO: 13180 - DNA, 20 bp, Artificial Sequence
  Description of Artificial Sequence: Synthetic oligonucleotide
  Target: DMPK; (+) strand; PAM type: NRG; PAM sequence: CAG
ccgcagccgagcaggggcca

SEQ ID NO: 13181 - DNA, 20 bp, Artificial Sequence
  Description of Artificial Sequence: Synthetic oligonucleotide
  Target: DMPK; (+) strand; PAM type: NRG; PAM sequence: AGG
cgcagccgagcaggggccac

SEQ ID NO: 13182 - DNA, 20 bp, Artificial Sequence
  Description of Artificial Sequence: Synthetic oligonucleotide
  Target: DMPK; (+) strand; PAM type: NRG; PAM sequence: TGG
taccccgcccccgctcacca

SEQ ID NO: 13183 - DNA, 20 bp, Artificial Sequence
  Description of Artificial Sequence: Synthetic oligonucleotide
  Target: DMPK; (+) strand; PAM type: NRG; PAM sequence: CAG
cccgcccccgctcaccatgg

SEQ ID NO: 13184 - DNA, 20 bp, Artificial Sequence
  Description of Artificial Sequence: Synthetic oligonucleotide
  Target: DMPK; (+) strand; PAM type: NRG; PAM sequence: GAG
cccccgctcaccatggcagt

SEQ ID NO: 13185 - DNA, 20 bp, Artificial Sequence
  Description of Artificial Sequence: Synthetic oligonucleotide
  Target: DMPK; (+) strand; PAM type: NRG; PAM sequence: AAG
cagtgagcccgtcctccacc

SEQ ID NO: 13186 - DNA, 20 bp, Artificial Sequence
  Description of Artificial Sequence: Synthetic oligonucleotide
  Target: DMPK; (+) strand; PAM type: NRG; PAM sequence: AAG
gcccgtcctccaccaagtcg

SEQ ID NO: 13187 - DNA, 20 bp, Artificial Sequence
  Description of Artificial Sequence: Synthetic oligonucleotide
  Target: DMPK; (+) strand; PAM type: NRG; PAM sequence: CGG
caagtcgaagttgcatgtgt

SEQ ID NO: 13188 - DNA, 20 bp, Artificial Sequence
  Description of Artificial Sequence: Synthetic oligonucleotide
  Target: DMPK; (+) strand; PAM type: NRG; PAM sequence: TGG
gtcgaagttgcatgtgtcgg

SEQ ID NO: 13189 - DNA, 20 bp, Artificial Sequence
  Description of Artificial Sequence: Synthetic oligonucleotide
  Target: DMPK; (+) strand; PAM type: NRG; PAM sequence: CGG
tcggtggcaccttcgaaatc

SEQ ID NO: 13190 - DNA, 20 bp, Artificial Sequence
  Description of Artificial Sequence: Synthetic oligonucleotide
  Target: DMPK; (+) strand; PAM type: NRG; PAM sequence: AAG
caccttcgaaatccggtgta

SEQ ID NO: 13191 - DNA, 20 bp, Artificial Sequence
  Description of Artificial Sequence: Synthetic oligonucleotide
  Target: DMPK; (+) strand; PAM type: NRG; PAM sequence: AGG
accttcgaaatccggtgtaa

SEQ ID NO: 13192 - DNA, 20 bp, Artificial Sequence
  Description of Artificial Sequence: Synthetic oligonucleotide
  Target: DMPK; (+) strand; PAM type: NRG; PAM sequence: GGG
ccttcgaaatccggtgtaaa

SEQ ID NO: 13193 - DNA, 20 bp, Artificial Sequence
  Description of Artificial Sequence: Synthetic oligonucleotide
  Target: DMPK; (+) strand; PAM type: NRG; PAM sequence: GGG
cttcgaaatccggtgtaaag

SEQ ID NO: 13194 - DNA, 20 bp, Artificial Sequence
  Description of Artificial Sequence: Synthetic oligonucleotide
  Target: DMPK; (+) strand; PAM type: NRG; PAM sequence: GGG
ttcgaaatccggtgtaaagg

SEQ ID NO: 13195 - DNA, 20 bp, Artificial Sequence
  Description of Artificial Sequence: Synthetic oligonucleotide
  Target: DMPK; (+) strand; PAM type: NRG; PAM sequence: GGG
tcgaaatccggtgtaaaggg

SEQ ID NO: 13196 - DNA, 20 bp, Artificial Sequence
  Description of Artificial Sequence: Synthetic oligonucleotide
  Target: DMPK; (+) strand; PAM type: NRG; PAM sequence: CGG
taaaggggggcacgctgtcc

SEQ ID NO: 13197 - DNA, 20 bp, Artificial Sequence
  Description of Artificial Sequence: Synthetic oligonucleotide
  Target: DMPK; (+) strand; PAM type: NRG; PAM sequence: GAG
aaggggggcacgctgtcccg

SEQ ID NO: 13198 - DNA, 20 bp, Artificial Sequence
  Description of Artificial Sequence: Synthetic oligonucleotide
  Target: DMPK; (+) strand; PAM type: NRG; PAM sequence: CAG
cgctgtcccggagaccatcc

SEQ ID NO: 13199 - DNA, 20 bp, Artificial Sequence
  Description of Artificial Sequence: Synthetic oligonucleotide
  Target: DMPK; (+) strand; PAM type: NRG; PAM sequence: GAG
tcccggagaccatcccagtc

SEQ ID NO: 13200 - DNA, 20 bp, Artificial Sequence
  Description of Artificial Sequence: Synthetic oligonucleotide
  Target: DMPK; (+) strand; PAM type: NRG; PAM sequence: AGG
cccggagaccatcccagtcg

SEQ ID NO: 13201 - DNA, 20 bp, Artificial Sequence
  Description of Artificial Sequence: Synthetic oligonucleotide
  Target: DMPK; (+) strand; PAM type: NRG; PAM sequence: AAG
gaccatcccagtcgaggcca

SEQ ID NO: 13202 - DNA, 20 bp, Artificial Sequence
  Description of Artificial Sequence: Synthetic oligonucleotide
  Target: DMPK; (+) strand; PAM type: NRG; PAM sequence: AAG
catcccagtcgaggccaaag

SEQ ID NO: 13203 - DNA, 20 bp, Artificial Sequence
  Description of Artificial Sequence: Synthetic oligonucleotide
  Target: DMPK; (+) strand; PAM type: NRG; PAM sequence: AAG
cccagtcgaggccaaagaag

SEQ ID NO: 13204 - DNA, 20 bp, Artificial Sequence
  Description of Artificial Sequence: Synthetic oligonucleotide
  Target: DMPK; (+) strand; PAM type: NRG; PAM sequence: AGG
ccagtcgaggccaaagaaga

SEQ ID NO: 13205 - DNA, 20 bp, Artificial Sequence
  Description of Artificial Sequence: Synthetic oligonucleotide
  Target: DMPK; (+) strand; PAM type: NRG; PAM sequence: GGG
cagtcgaggccaaagaagaa

SEQ ID NO: 13206 - DNA, 20 bp, Artificial Sequence
  Description of Artificial Sequence: Synthetic oligonucleotide
  Target: DMPK; (+) strand; PAM type: NRG; PAM sequence: CGG
caaagaagaagggatgtgtc

SEQ ID NO: 13207 - DNA, 20 bp, Artificial Sequence
  Description of Artificial Sequence: Synthetic oligonucleotide
  Target: DMPK; (+) strand; PAM type: NRG; PAM sequence: AAG
agaagaagggatgtgtccgg

SEQ ID NO: 13208 - DNA, 20 bp, Artificial Sequence
  Description of Artificial Sequence: Synthetic oligonucleotide
  Target: DMPK; (+) strand; PAM type: NRG; PAM sequence: CGG
ggaagtcgcctgctccaccc

SEQ ID NO: 13209 - DNA, 20 bp, Artificial Sequence
  Description of Artificial Sequence: Synthetic oligonucleotide
  Target: DMPK; (+) strand; PAM type: NRG; PAM sequence: CAG
tcgcctgctccaccccggcc

SEQ ID NO: 13210 - DNA, 20 bp, Artificial Sequence
  Description of Artificial Sequence: Synthetic oligonucleotide
  Target: DMPK; (+) strand; PAM type: NRG; PAM sequence: CGG
ccccggcccagccgtgtctc

SEQ ID NO: 13211 - DNA, 20 bp, Artificial Sequence
  Description of Artificial Sequence: Synthetic oligonucleotide
  Target: DMPK; (+) strand; PAM type: NRG; PAM sequence: GGG
cccggcccagccgtgtctcc

SEQ ID NO: 13212 - DNA, 20 bp, Artificial Sequence
  Description of Artificial Sequence: Synthetic oligonucleotide
  Target: DMPK; (+) strand; PAM type: NRG; PAM sequence: GGG
ccggcccagccgtgtctccg

SEQ ID NO: 13213 - DNA, 20 bp, Artificial Sequence
  Description of Artificial Sequence: Synthetic oligonucleotide
  Target: DMPK; (+) strand; PAM type: NRG; PAM sequence: GGG
cggcccagccgtgtctccgg

SEQ ID NO: 13214 - DNA, 20 bp, Artificial Sequence
  Description of Artificial Sequence: Synthetic oligonucleotide
  Target: DMPK; (+) strand; PAM type: NRG; PAM sequence: CAG
agccgtgtctccgggggaca

SEQ ID NO: 13215 - DNA, 20 bp, Artificial Sequence
  Description of Artificial Sequence: Synthetic oligonucleotide
  Target: DMPK; (+) strand; PAM type: NRG; PAM sequence: AAG
gacacagcaaccgctgaatg

SEQ ID NO: 13216 - DNA, 20 bp, Artificial Sequence
  Description of Artificial Sequence: Synthetic oligonucleotide
  Target: DMPK; (+) strand; PAM type: NRG; PAM sequence: GAG
caaccgctgaatgaagtctc

SEQ ID NO: 13217 - DNA, 20 bp, Artificial Sequence
  Description of Artificial Sequence: Synthetic oligonucleotide
  Target: DMPK; (+) strand; PAM type: NRG; PAM sequence: CAG
aatgaagtctcgagcctcct

SEQ ID NO: 13218 - DNA, 20 bp, Artificial Sequence
  Description of Artificial Sequence: Synthetic oligonucleotide
  Target: DMPK; (+) strand; PAM type: NRG; PAM sequence: AGG
atgaagtctcgagcctcctc

SEQ ID NO: 13219 - DNA, 20 bp, Artificial Sequence
  Description of Artificial Sequence: Synthetic oligonucleotide
  Target: DMPK; (+) strand; PAM type: NRG; PAM sequence: GGG
tgaagtctcgagcctcctca

SEQ ID NO: 13220 - DNA, 20 bp, Artificial Sequence
  Description of Artificial Sequence: Synthetic oligonucleotide
  Target: DMPK; (+) strand; PAM type: NRG; PAM sequence: CAG
tcagggaccccttcgtccac

SEQ ID NO: 13221 - DNA, 20 bp, Artificial Sequence
  Description of Artificial Sequence: Synthetic oligonucleotide
  Target: DMPK; (+) strand; PAM type: NRG; PAM sequence: CGG
gggaccccttcgtccaccag

SEQ ID NO: 13222 - DNA, 20 bp, Artificial Sequence
  Description of Artificial Sequence: Synthetic oligonucleotide
  Target: DMPK; (+) strand; PAM type: NRG; PAM sequence: CAG
accccttcgtccaccagcgg

SEQ ID NO: 13223 - DNA, 20 bp, Artificial Sequence
  Description of Artificial Sequence: Synthetic oligonucleotide
  Target: DMPK; (+) strand; PAM type: NRG; PAM sequence: GAG
cccttcgtccaccagcggca

SEQ ID NO: 13224 - DNA, 20 bp, Artificial Sequence
  Description of Artificial Sequence: Synthetic oligonucleotide
  Target: DMPK; (+) strand; PAM type: NRG; PAM sequence: GAG
cttcgtccaccagcggcaga

SEQ ID NO: 13225 - DNA, 20 bp, Artificial Sequence
  Description of Artificial Sequence: Synthetic oligonucleotide
  Target: DMPK; (+) strand; PAM type: NRG; PAM sequence: GAG
tcgtccaccagcggcagaga

SEQ ID NO: 13226 - DNA, 20 bp, Artificial Sequence
  Description of Artificial Sequence: Synthetic oligonucleotide
  Target: DMPK; (+) strand; PAM type: NRG; PAM sequence: AGG
cgtccaccagcggcagagag

SEQ ID NO: 13227 - DNA, 20 bp, Artificial Sequence
  Description of Artificial Sequence: Synthetic oligonucleotide
  Target: DMPK; (+) strand; PAM type: NRG; PAM sequence: CAG
cagagagaggtgctcctgct

SEQ ID NO: 13228 - DNA, 20 bp, Artificial Sequence
  Description of Artificial Sequence: Synthetic oligonucleotide
  Target: DMPK; (+) strand; PAM type: NRG; PAM sequence: GAG
gagagaggtgctcctgctca

SEQ ID NO: 13229 - DNA, 20 bp, Artificial Sequence
  Description of Artificial Sequence: Synthetic oligonucleotide
  Target: DMPK; (+) strand; PAM type: NRG; PAM sequence: AGG
agagaggtgctcctgctcag

SEQ ID NO: 13230 - DNA, 20 bp, Artificial Sequence
  Description of Artificial Sequence: Synthetic oligonucleotide
  Target: DMPK; (+) strand; PAM type: NRG; PAM sequence: GGG
gagaggtgctcctgctcaga

SEQ ID NO: 13231 - DNA, 20 bp, Artificial Sequence
  Description of Artificial Sequence: Synthetic oligonucleotide
  Target: DMPK; (+) strand; PAM type: NRG; PAM sequence: GAG
gaggtgctcctgctcagagg

SEQ ID NO: 13232 - DNA, 20 bp, Artificial Sequence
  Description of Artificial Sequence: Synthetic oligonucleotide
  Target: DMPK; (+) strand; PAM type: NRG; PAM sequence: GAG
ggtgctcctgctcagaggga

SEQ ID NO: 13233 - DNA, 20 bp, Artificial Sequence
  Description of Artificial Sequence: Synthetic oligonucleotide
  Target: DMPK; (+) strand; PAM type: NRG; PAM sequence: AGG
gtgctcctgctcagagggag

SEQ ID NO: 13234 - DNA, 20 bp, Artificial Sequence
  Description of Artificial Sequence: Synthetic oligonucleotide
  Target: DMPK; (+) strand; PAM type: NRG; PAM sequence: GAG
gctcctgctcagagggagag

SEQ ID NO: 13235 - DNA, 20 bp, Artificial Sequence
  Description of Artificial Sequence: Synthetic oligonucleotide
  Target: DMPK; (+) strand; PAM type: NRG; PAM sequence: AGG
ctcctgctcagagggagagg

SEQ ID NO: 13236 - DNA, 20 bp, Artificial Sequence
  Description of Artificial Sequence: Synthetic oligonucleotide
  Target: DMPK; (+) strand; PAM type: NRG; PAM sequence: TAG
ctcagagggagaggaggcga

SEQ ID NO: 13237 - DNA, 20 bp, Artificial Sequence
  Description of Artificial Sequence: Synthetic oligonucleotide
  Target: DMPK; (+) strand; PAM type: NRG; PAM sequence: TGG
agggagaggaggcgatagcc

SEQ ID NO: 13238 - DNA, 20 bp, Artificial Sequence
  Description of Artificial Sequence: Synthetic oligonucleotide
  Target: DMPK; (+) strand; PAM type: NRG; PAM sequence: GGG
gggagaggaggcgatagcct

SEQ ID NO: 13239 - DNA, 20 bp, Artificial Sequence
  Description of Artificial Sequence: Synthetic oligonucleotide
  Target: DMPK; (+) strand; PAM type: NRG; PAM sequence: GAG
gagaggaggcgatagcctgg

SEQ ID NO: 13240 - DNA, 20 bp, Artificial Sequence
  Description of Artificial Sequence: Synthetic oligonucleotide
  Target: DMPK; (+) strand; PAM type: NRG; PAM sequence: CGG
gatagcctgggagcgcctac

SEQ ID NO: 13241 - DNA, 20 bp, Artificial Sequence
  Description of Artificial Sequence: Synthetic oligonucleotide
  Target: DMPK; (+) strand; PAM type: NRG; PAM sequence: GGG
atagcctgggagcgcctacc

SEQ ID NO: 13242 - DNA, 20 bp, Artificial Sequence
  Description of Artificial Sequence: Synthetic oligonucleotide
  Target: DMPK; (+) strand; PAM type: NRG; PAM sequence: GAG
agcctgggagcgcctaccgg

SEQ ID NO: 13243 - DNA, 20 bp, Artificial Sequence
  Description of Artificial Sequence: Synthetic oligonucleotide
  Target: DMPK; (+) strand; PAM type: NRG; PAM sequence: GAG
cctgggagcgcctaccggga

SEQ ID NO: 13244 - DNA, 20 bp, Artificial Sequence
  Description of Artificial Sequence: Synthetic oligonucleotide
  Target: DMPK; (+) strand; PAM type: NRG; PAM sequence: AGG
ctgggagcgcctaccgggag

SEQ ID NO: 13245 - DNA, 20 bp, Artificial Sequence
  Description of Artificial Sequence: Synthetic oligonucleotide
  Target: DMPK; (+) strand; PAM type: NRG; PAM sequence: CAG
gagcgcctaccgggagaggc

SEQ ID NO: 13246 - DNA, 20 bp, Artificial Sequence
  Description of Artificial Sequence: Synthetic oligonucleotide
  Target: DMPK; (+) strand; PAM type: NRG; PAM sequence: AGG
agcgcctaccgggagaggcc

SEQ ID NO: 13247 - DNA, 20 bp, Artificial Sequence
  Description of Artificial Sequence: Synthetic oligonucleotide
  Target: DMPK; (+) strand; PAM type: NRG; PAM sequence: CGG
ggagaggccaggtctccctg

SEQ ID NO: 13248 - DNA, 20 bp, Artificial Sequence
  Description of Artificial Sequence: Synthetic oligonucleotide
  Target: DMPK; (+) strand; PAM type: NRG; PAM sequence: TAG
ctgcggccgtgctcaccttg

SEQ ID NO: 13249 - DNA, 20 bp, Artificial Sequence
  Description of Artificial Sequence: Synthetic oligonucleotide
  Target: DMPK; (+) strand; PAM type: NRG; PAM sequence: TGG
cggccgtgctcaccttgtag

SEQ ID NO: 13250 - DNA, 20 bp, Artificial Sequence
  Description of Artificial Sequence: Synthetic oligonucleotide
  Target: DMPK; (+) strand; PAM type: NRG; PAM sequence: TAG
tgtagtggacgatcttgcca

SEQ ID NO: 13251 - DNA, 20 bp, Artificial Sequence
  Description of Artificial Sequence: Synthetic oligonucleotide
  Target: DMPK; (+) strand; PAM type: NRG; PAM sequence: AGG
gtagtggacgatcttgccat

SEQ ID NO: 13252 - DNA, 20 bp, Artificial Sequence
  Description of Artificial Sequence: Synthetic oligonucleotide
  Target: DMPK; (+) strand; PAM type: NRG; PAM sequence: TGG
cttgccataggtctccgccg

SEQ ID NO: 13253 - DNA, 20 bp, Artificial Sequence
  Description of Artificial Sequence: Synthetic oligonucleotide
  Target: DMPK; (+) strand; PAM type: NRG; PAM sequence: TAG
tctccgccgtggaatccgcg

SEQ ID NO: 13254 - DNA, 20 bp, Artificial Sequence
  Description of Artificial Sequence: Synthetic oligonucleotide
  Target: DMPK; (+) strand; PAM type: NRG; PAM sequence: AAG
ccgccgtggaatccgcgtag

SEQ ID NO: 13255 - DNA, 20 bp, Artificial Sequence
  Description of Artificial Sequence: Synthetic oligonucleotide
  Target: DMPK; (+) strand; PAM type: NRG; PAM sequence: AGG
cgccgtggaatccgcgtaga

SEQ ID NO: 13256 - DNA, 20 bp, Artificial Sequence
  Description of Artificial Sequence: Synthetic oligonucleotide
  Target: DMPK; (+) strand; PAM type: NRG; PAM sequence: GGG
gccgtggaatccgcgtagaa

SEQ ID NO: 13257 - DNA, 20 bp, Artificial Sequence
  Description of Artificial Sequence: Synthetic oligonucleotide
  Target: DMPK; (+) strand; PAM type: NRG; PAM sequence: TAG
cgtagaagggcgtctgccca

SEQ ID NO: 13258 - DNA, 20 bp, Artificial Sequence
  Description of Artificial Sequence: Synthetic oligonucleotide
  Target: DMPK; (+) strand; PAM type: NRG; PAM sequence: TAG
tctgcccatagaacatttca

SEQ ID NO: 13259 - DNA, 20 bp, Artificial Sequence
  Description of Artificial Sequence: Synthetic oligonucleotide
  Target: DMPK; (+) strand; PAM type: NRG; PAM sequence: AGG
ctgcccatagaacatttcat

SEQ ID NO: 13260 - DNA, 20 bp, Artificial Sequence
  Description of Artificial Sequence: Synthetic oligonucleotide
  Target: DMPK; (+) strand; PAM type: NRG; PAM sequence: CAG
atttcataggcgaatacacc

SEQ ID NO: 13261 - DNA, 20 bp, Artificial Sequence
  Description of Artificial Sequence: Synthetic oligonucleotide
  Target: DMPK; (+) strand; PAM type: NRG; PAM sequence: CAG
cgaatacacccagcgcccac

SEQ ID NO: 13262 - DNA, 20 bp, Artificial Sequence
  Description of Artificial Sequence: Synthetic oligonucleotide
  Target: DMPK; (+) strand; PAM type: NRG; PAM sequence: CGG
cagcgcccaccagtcacact

SEQ ID NO: 13263 - DNA, 20 bp, Artificial Sequence
  Description of Artificial Sequence: Synthetic oligonucleotide
  Target: DMPK; (+) strand; PAM type: NRG; PAM sequence: GGG
agcgcccaccagtcacactc

SEQ ID NO: 13264 - DNA, 20 bp, Artificial Sequence
  Description of Artificial Sequence: Synthetic oligonucleotide
  Target: DMPK; (+) strand; PAM type: NRG; PAM sequence: TAG
accagtcacactcgggcccg

SEQ ID NO: 13265 - DNA, 20 bp, Artificial Sequence
  Description of Artificial Sequence: Synthetic oligonucleotide
  Target: DMPK; (+) strand; PAM type: NRG; PAM sequence: CAG
gggcccgtagctgcctgtcc

SEQ ID NO: 13266 - DNA, 20 bp, Artificial Sequence
  Description of Artificial Sequence: Synthetic oligonucleotide
  Target: DMPK; (+) strand; PAM type: NRG; PAM sequence: AGG
ggcccgtagctgcctgtccc

SEQ ID NO: 13267 - DNA, 20 bp, Artificial Sequence
  Description of Artificial Sequence: Synthetic oligonucleotide
  Target: DMPK; (+) strand; PAM type: NRG; PAM sequence: CAG
tgtcccaggcccaccgccca

SEQ ID NO: 13268 - DNA, 20 bp, Artificial Sequence
  Description of Artificial Sequence: Synthetic oligonucleotide
  Target: DMPK; (+) strand; PAM type: NRG; PAM sequence: CAG
ggcccaccgcccacagcctg

SEQ ID NO: 13269 - DNA, 20 bp, Artificial Sequence
  Description of Artificial Sequence: Synthetic oligonucleotide
  Target: DMPK; (+) strand; PAM type: NRG; PAM sequence: AGG
gcccaccgcccacagcctgc

SEQ ID NO: 13270 - DNA, 20 bp, Artificial Sequence
  Description of Artificial Sequence: Synthetic oligonucleotide
  Target: DMPK; (+) strand; PAM type: NRG; PAM sequence: CGG
gcccacagcctgcaggatct

SEQ ID NO: 13271 - DNA, 20 bp, Artificial Sequence
  Description of Artificial Sequence: Synthetic oligonucleotide
  Target: DMPK; (+) strand; PAM type: NRG; PAM sequence: GGG
cccacagcctgcaggatctc

SEQ ID NO: 13272 - DNA, 20 bp, Artificial Sequence
  Description of Artificial Sequence: Synthetic oligonucleotide
  Target: DMPK; (+) strand; PAM type: NRG; PAM sequence: GGG
ccacagcctgcaggatctcg

SEQ ID NO: 13273 - DNA, 20 bp, Artificial Sequence
  Description of Artificial Sequence: Synthetic oligonucleotide
  Target: DMPK; (+) strand; PAM type: NRG; PAM sequence: GGG
cacagcctgcaggatctcgg

SEQ ID NO: 13274 - DNA, 20 bp, Artificial Sequence
  Description of Artificial Sequence: Synthetic oligonucleotide
  Target: DMPK; (+) strand; PAM type: NRG; PAM sequence: CAG
gcctgcaggatctcggggga

SEQ ID NO: 13275 - DNA, 20 bp, Artificial Sequence
  Description of Artificial Sequence: Synthetic oligonucleotide
  Target: DMPK; (+) strand; PAM type: NRG; PAM sequence: AGG
cctgcaggatctcgggggac

SEQ ID NO: 13276 - DNA, 20 bp, Artificial Sequence
  Description of Artificial Sequence: Synthetic oligonucleotide
  Target: DMPK; (+) strand; PAM type: NRG; PAM sequence: TAG
gcaggatctcgggggacagg

SEQ ID NO: 13277 - DNA, 20 bp, Artificial Sequence
  Description of Artificial Sequence: Synthetic oligonucleotide
  Target: DMPK; (+) strand; PAM type: NRG; PAM sequence: TGG
atctcgggggacaggtagtc

SEQ ID NO: 13278 - DNA, 20 bp, Artificial Sequence
  Description of Artificial Sequence: Synthetic oligonucleotide
  Target: DMPK; (+) strand; PAM type: NRG; PAM sequence: GGG
tctcgggggacaggtagtct

SEQ ID NO: 13279 - DNA, 20 bp, Artificial Sequence
  Description of Artificial Sequence: Synthetic oligonucleotide
  Target: DMPK; (+) strand; PAM type: NRG; PAM sequence: GGG
ctcgggggacaggtagtctg

SEQ ID NO: 13280 - DNA, 20 bp, Artificial Sequence
  Description of Artificial Sequence: Synthetic oligonucleotide
  Target: DMPK; (+) strand; PAM type: NRG; PAM sequence: CAG
caggtagtctggggtgccca

SEQ ID NO: 13281 - DNA, 20 bp, Artificial Sequence
  Description of Artificial Sequence: Synthetic oligonucleotide
  Target: DMPK; (+) strand; PAM type: NRG; PAM sequence: CAG
tctggggtgcccacagccac

SEQ ID NO: 13282 - DNA, 20 bp, Artificial Sequence
  Description of Artificial Sequence: Synthetic oligonucleotide
  Target: DMPK; (+) strand; PAM type: NRG; PAM sequence: TGG
cagccaccagcgaccgcacc

SEQ ID NO: 13283 - DNA, 20 bp, Artificial Sequence
  Description of Artificial Sequence: Synthetic oligonucleotide
  Target: DMPK; (+) strand; PAM type: NRG; PAM sequence: AAG
agcgaccgcacctggaccaa

SEQ ID NO: 13284 - DNA, 20 bp, Artificial Sequence
  Description of Artificial Sequence: Synthetic oligonucleotide
  Target: DMPK; (+) strand; PAM type: NRG; PAM sequence: AGG
gcgaccgcacctggaccaaa

SEQ ID NO: 13285 - DNA, 20 bp, Artificial Sequence
  Description of Artificial Sequence: Synthetic oligonucleotide
  Target: DMPK; (+) strand; PAM type: NRG; PAM sequence: GAG
gaccgcacctggaccaaaag

SEQ ID NO: 13286 - DNA, 20 bp, Artificial Sequence
  Description of Artificial Sequence: Synthetic oligonucleotide
  Target: DMPK; (+) strand; PAM type: NRG; PAM sequence: CAG
cgcacctggaccaaaaggag

SEQ ID NO: 13287 - DNA, 20 bp, Artificial Sequence
  Description of Artificial Sequence: Synthetic oligonucleotide
  Target: DMPK; (+) strand; PAM type: NRG; PAM sequence: GAG
cacctggaccaaaaggagca

SEQ ID NO: 13288 - DNA, 20 bp, Artificial Sequence
  Description of Artificial Sequence: Synthetic oligonucleotide
  Target: DMPK; (+) strand; PAM type: NRG; PAM sequence: GAG
tggaccaaaaggagcagagc

SEQ ID NO: 13289 - DNA, 20 bp, Artificial Sequence
  Description of Artificial Sequence: Synthetic oligonucleotide
  Target: DMPK; (+) strand; PAM type: NRG; PAM sequence: AGG
ggaccaaaaggagcagagcg

SEQ ID NO: 13290 - DNA, 20 bp, Artificial Sequence
  Description of Artificial Sequence: Synthetic oligonucleotide
  Target: DMPK; (+) strand; PAM type: NRG; PAM sequence: TGG
aaaaggagcagagcgaggct

SEQ ID NO: 13291 - DNA, 20 bp, Artificial Sequence
  Description of Artificial Sequence: Synthetic oligonucleotide
  Target: DMPK; (+) strand; PAM type: NRG; PAM sequence: GGG
aaaggagcagagcgaggctt

SEQ ID NO: 13292 - DNA, 20 bp, Artificial Sequence
  Description of Artificial Sequence: Synthetic oligonucleotide
  Target: DMPK; (+) strand; PAM type: NRG; PAM sequence: TGG
gaggcttgggcccacccctc

SEQ ID NO: 13293 - DNA, 20 bp, Artificial Sequence
  Description of Artificial Sequence: Synthetic oligonucleotide
  Target: DMPK; (+) strand; PAM type: NRG; PAM sequence: GGG
aggcttgggcccacccctct

SEQ ID NO: 13294 - DNA, 20 bp, Artificial Sequence
  Description of Artificial Sequence: Synthetic oligonucleotide
  Target: DMPK; (+) strand; PAM type: NRG; PAM sequence: CAG
gcccacccctctgggcccac

SEQ ID NO: 13295 - DNA, 20 bp, Artificial Sequence
  Description of Artificial Sequence: Synthetic oligonucleotide
  Target: DMPK; (+) strand; PAM type: NRG; PAM sequence: TGG
ccctctgggcccaccagctc

SEQ ID NO: 13296 - DNA, 20 bp, Artificial Sequence
  Description of Artificial Sequence: Synthetic oligonucleotide
  Target: DMPK; (+) strand; PAM type: NRG; PAM sequence: GGG
cctctgggcccaccagctct

SEQ ID NO: 13297 - DNA, 20 bp, Artificial Sequence
  Description of Artificial Sequence: Synthetic oligonucleotide
  Target: DMPK; (+) strand; PAM type: NRG; PAM sequence: TAG
ccaaccactccccaaatgct

SEQ ID NO: 13298 - DNA, 20 bp, Artificial Sequence
  Description of Artificial Sequence: Synthetic oligonucleotide
  Target: DMPK; (+) strand; PAM type: NRG; PAM sequence: TGG
gcttagcccctccctctgcc

SEQ ID NO: 13299 - DNA, 20 bp, Artificial Sequence
  Description of Artificial Sequence: Synthetic oligonucleotide
  Target: DMPK; (+) strand; PAM type: NRG; PAM sequence: CAG
tggtctaatactccgccaca

SEQ ID NO: 13300 - DNA, 20 bp, Artificial Sequence
  Description of Artificial Sequence: Synthetic oligonucleotide
  Target: DMPK; (+) strand; PAM type: NRG; PAM sequence: AAG
cgccacacagatgcacactt

SEQ ID NO: 13301 - DNA, 20 bp, Artificial Sequence
  Description of Artificial Sequence: Synthetic oligonucleotide
  Target: DMPK; (+) strand; PAM type: NRG; PAM sequence: TGG
cacagatgcacacttaagcc

SEQ ID NO: 13302 - DNA, 20 bp, Artificial Sequence
  Description of Artificial Sequence: Synthetic oligonucleotide
  Target: DMPK; (+) strand; PAM type: NRG; PAM sequence: GGG
acagatgcacacttaagcct

SEQ ID NO: 13303 - DNA, 20 bp, Artificial Sequence
  Description of Artificial Sequence: Synthetic oligonucleotide
  Target: DMPK; (+) strand; PAM type: NRG; PAM sequence: CAG
cctcttttcccctccaaatc

SEQ ID NO: 13304 - DNA, 20 bp, Artificial Sequence
  Description of Artificial Sequence: Synthetic oligonucleotide
  Target: DMPK; (+) strand; PAM type: NRG; PAM sequence: CAG
ctgtgccttccatccctcat

SEQ ID NO: 13305 - DNA, 20 bp, Artificial Sequence
  Description of Artificial Sequence: Synthetic oligonucleotide
  Target: DMPK; (+) strand; PAM type: NRG; PAM sequence: CAG
tgccttccatccctcatcag

SEQ ID NO: 13306 - DNA, 20 bp, Artificial Sequence
  Description of Artificial Sequence: Synthetic oligonucleotide
  Target: DMPK; (+) strand; PAM type: NRG; PAM sequence: CAG
ccatccctcatcagcagccc

SEQ ID NO: 13307 - DNA, 20 bp, Artificial Sequence
  Description of Artificial Sequence: Synthetic oligonucleotide
  Target: DMPK; (+) strand; PAM type: NRG; PAM sequence: TGG
cagcagccccagttgctctg

SEQ ID NO: 13308 - DNA, 20 bp, Artificial Sequence
  Description of Artificial Sequence: Synthetic oligonucleotide
  Target: DMPK; (+) strand; PAM type: NRG; PAM sequence: CAG
agccccagttgctctgtggc

SEQ ID NO: 13309 - DNA, 20 bp, Artificial Sequence
  Description of Artificial Sequence: Synthetic oligonucleotide
  Target: DMPK; (+) strand; PAM type: NRG; PAM sequence: AGG
gccccagttgctctgtggcc

SEQ ID NO: 13310 - DNA, 20 bp, Artificial Sequence
  Description of Artificial Sequence: Synthetic oligonucleotide
  Target: DMPK; (+) strand; PAM type: NRG; PAM sequence: GGG
ccccagttgctctgtggcca

SEQ ID NO: 13311 - DNA, 20 bp, Artificial Sequence
  Description of Artificial Sequence: Synthetic oligonucleotide
  Target: DMPK; (+) strand; PAM type: NRG; PAM sequence: TGG
ttgctctgtggccagggcac

SEQ ID NO: 13312 - DNA, 20 bp, Artificial Sequence
  Description of Artificial Sequence: Synthetic oligonucleotide
  Target: DMPK; (+) strand; PAM type: NRG; PAM sequence: CAG
ctcaccgttccatctgcccg

SEQ ID NO: 13313 - DNA, 20 bp, Artificial Sequence
  Description of Artificial Sequence: Synthetic oligonucleotide
  Target: DMPK; (+) strand; PAM type: NRG; PAM sequence: GAG
gttccatctgcccgcagctt

SEQ ID NO: 13314 - DNA, 20 bp, Artificial Sequence
  Description of Artificial Sequence: Synthetic oligonucleotide
  Target: DMPK; (+) strand; PAM type: NRG; PAM sequence: AGG
ttccatctgcccgcagcttg

SEQ ID NO: 13315 - DNA, 20 bp, Artificial Sequence
  Description of Artificial Sequence: Synthetic oligonucleotide
  Target: DMPK; (+) strand; PAM type: NRG; PAM sequence: AAG
atctgcccgcagcttgaggc

SEQ ID NO: 13316 - DNA, 20 bp, Artificial Sequence
  Description of Artificial Sequence: Synthetic oligonucleotide
  Target: DMPK; (+) strand; PAM type: NRG; PAM sequence: GAG
ctgcccgcagcttgaggcaa

SEQ ID NO: 13317 - DNA, 20 bp, Artificial Sequence
  Description of Artificial Sequence: Synthetic oligonucleotide
  Target: DMPK; (+) strand; PAM type: NRG; PAM sequence: AAG
gcagcttgaggcaagagccg

SEQ ID NO: 13318 - DNA, 20 bp, Artificial Sequence
  Description of Artificial Sequence: Synthetic oligonucleotide
  Target: DMPK; (+) strand; PAM type: NRG; PAM sequence: CGG
cttgaggcaagagccgaagt

SEQ ID NO: 13319 - DNA, 20 bp, Artificial Sequence
  Description of Artificial Sequence: Synthetic oligonucleotide
  Target: DMPK; (+) strand; PAM type: NRG; PAM sequence: CAG
aggcaagagccgaagtcggc

SEQ ID NO: 13320 - DNA, 20 bp, Artificial Sequence
  Description of Artificial Sequence: Synthetic oligonucleotide
  Target: DMPK; (+) strand; PAM type: NRG; PAM sequence: AGG
ggcaagagccgaagtcggcc

SEQ ID NO: 13321 - DNA, 20 bp, Artificial Sequence
  Description of Artificial Sequence: Synthetic oligonucleotide
  Target: DMPK; (+) strand; PAM type: NRG; PAM sequence: CGG
aagagccgaagtcggccagg

SEQ ID NO: 13322 - DNA, 20 bp, Artificial Sequence
  Description of Artificial Sequence: Synthetic oligonucleotide
  Target: DMPK; (+) strand; PAM type: NRG; PAM sequence: TGG
cgaagtcggccaggcggatg

SEQ ID NO: 13323 - DNA, 20 bp, Artificial Sequence
  Description of Artificial Sequence: Synthetic oligonucleotide
  Target: DMPK; (+) strand; PAM type: NRG; PAM sequence: CAG
cggccaggcggatgtggcca

SEQ ID NO: 13324 - DNA, 20 bp, Artificial Sequence
  Description of Artificial Sequence: Synthetic oligonucleotide
  Target: DMPK; (+) strand; PAM type: NRG; PAM sequence: CGG
ccaggcggatgtggccacag

SEQ ID NO: 13325 - DNA, 20 bp, Artificial Sequence
  Description of Artificial Sequence: Synthetic oligonucleotide
  Target: DMPK; (+) strand; PAM type: NRG; PAM sequence: CAG
cggatgtggccacagcggtc

SEQ ID NO: 13326 - DNA, 20 bp, Artificial Sequence
  Description of Artificial Sequence: Synthetic oligonucleotide
  Target: DMPK; (+) strand; PAM type: NRG; PAM sequence: CAG
atgtggccacagcggtccag

SEQ ID NO: 13327 - DNA, 20 bp, Artificial Sequence
  Description of Artificial Sequence: Synthetic oligonucleotide
  Target: DMPK; (+) strand; PAM type: NRG; PAM sequence: AGG
tgtggccacagcggtccagc

SEQ ID NO: 13328 - DNA, 20 bp, Artificial Sequence
  Description of Artificial Sequence: Synthetic oligonucleotide
  Target: DMPK; (+) strand; PAM type: NRG; PAM sequence: CGG
gcggtccagcaggatgttgt

SEQ ID NO: 13329 - DNA, 20 bp, Artificial Sequence
  Description of Artificial Sequence: Synthetic oligonucleotide
  Target: DMPK; (+) strand; PAM type: NRG; PAM sequence: GGG
cggtccagcaggatgttgtc

SEQ ID NO: 13330 - DNA, 20 bp, Artificial Sequence
  Description of Artificial Sequence: Synthetic oligonucleotide
  Target: DMPK; (+) strand; PAM type: NRG; PAM sequence: CGG
tcgggtttgatgtccctgca

SEQ ID NO: 13331 - DNA, 20 bp, Artificial Sequence
  Description of Artificial Sequence: Synthetic oligonucleotide
  Target: DMPK; (+) strand; PAM type: NRG; PAM sequence: GAG
gggtttgatgtccctgcacg

SEQ ID NO: 13332 - DNA, 20 bp, Artificial Sequence
  Description of Artificial Sequence: Synthetic oligonucleotide
  Target: DMPK; (+) strand; PAM type: NRG; PAM sequence: AGG
ggtttgatgtccctgcacgg

SEQ ID NO: 13333 - DNA, 20 bp, Artificial Sequence
  Description of Artificial Sequence: Synthetic oligonucleotide
  Target: DMPK; (+) strand; PAM type: NRG; PAM sequence: AAG
gatgtccctgcacggaggaa

SEQ ID NO: 13334 - DNA, 20 bp, Artificial Sequence
  Description of Artificial Sequence: Synthetic oligonucleotide
  Target: DMPK; (+) strand; PAM type: NRG; PAM sequence: GAG
tgtccctgcacggaggaaaa

SEQ ID NO: 13335 - DNA, 20 bp, Artificial Sequence
  Description of Artificial Sequence: Synthetic oligonucleotide
  Target: DMPK; (+) strand; PAM type: NRG; PAM sequence: AAG
ccctgcacggaggaaaagag

SEQ ID NO: 13336 - DNA, 20 bp, Artificial Sequence
  Description of Artificial Sequence: Synthetic oligonucleotide
  Target: DMPK; (+) strand; PAM type: NRG; PAM sequence: AGG
cctgcacggaggaaaagaga

SEQ ID NO: 13337 - DNA, 20 bp, Artificial Sequence
  Description of Artificial Sequence: Synthetic oligonucleotide
  Target: DMPK; (+) strand; PAM type: NRG; PAM sequence: GGG
ctgcacggaggaaaagagaa

SEQ ID NO: 13338 - DNA, 20 bp, Artificial Sequence
  Description of Artificial Sequence: Synthetic oligonucleotide
  Target: DMPK; (+) strand; PAM type: NRG; PAM sequence: TGG
cacggaggaaaagagaaggg

SEQ ID NO: 13339 - DNA, 20 bp, Artificial Sequence
  Description of Artificial Sequence: Synthetic oligonucleotide
  Target: DMPK; (+) strand; PAM type: NRG; PAM sequence: GGG
acggaggaaaagagaagggt

SEQ ID NO: 13340 - DNA, 20 bp, Artificial Sequence
  Description of Artificial Sequence: Synthetic oligonucleotide
  Target: DMPK; (+) strand; PAM type: NRG; PAM sequence: TGG
ataaatgaacctcccttctg

SEQ ID NO: 13341 - DNA, 20 bp, Artificial Sequence
  Description of Artificial Sequence: Synthetic oligonucleotide
  Target: DMPK; (+) strand; PAM type: NRG; PAM sequence: CAG
cctcccttctgtggtcccac

SEQ ID NO: 13342 - DNA, 20 bp, Artificial Sequence
  Description of Artificial Sequence: Synthetic oligonucleotide
  Target: DMPK; (+) strand; PAM type: NRG; PAM sequence: AGG
ctcccttctgtggtcccacc

SEQ ID NO: 13343 - DNA, 20 bp, Artificial Sequence
  Description of Artificial Sequence: Synthetic oligonucleotide
  Target: DMPK; (+) strand; PAM type: NRG; PAM sequence: CGG
cccaccaggctccgcccctc

SEQ ID NO: 13344 - DNA, 20 bp, Artificial Sequence
  Description of Artificial Sequence: Synthetic oligonucleotide
  Target: DMPK; (+) strand; PAM type: NRG; PAM sequence: GGG
ccaccaggctccgcccctcc

SEQ ID NO: 13345 - DNA, 20 bp, Artificial Sequence
  Description of Artificial Sequence: Synthetic oligonucleotide
  Target: DMPK; (+) strand; PAM type: NRG; PAM sequence: CAG
ccaggctccgcccctccggg

SEQ ID NO: 13346 - DNA, 20 bp, Artificial Sequence
  Description of Artificial Sequence: Synthetic oligonucleotide
  Target: DMPK; (+) strand; PAM type: NRG; PAM sequence: TGG
cccctccgggcagtgccacc

SEQ ID NO: 13347 - DNA, 20 bp, Artificial Sequence
  Description of Artificial Sequence: Synthetic oligonucleotide
  Target: DMPK; (+) strand; PAM type: NRG; PAM sequence: GGG
ccctccgggcagtgccacct

SEQ ID NO: 13348 - DNA, 20 bp, Artificial Sequence
  Description of Artificial Sequence: Synthetic oligonucleotide
  Target: DMPK; (+) strand; PAM type: NRG; PAM sequence: CGG
cacctgggaccccacttcct

SEQ ID NO: 13349 - DNA, 20 bp, Artificial Sequence
  Description of Artificial Sequence: Synthetic oligonucleotide
  Target: DMPK; (+) strand; PAM type: NRG; PAM sequence: GGG
acctgggaccccacttcctc

SEQ ID NO: 13350 - DNA, 20 bp, Artificial Sequence
  Description of Artificial Sequence: Synthetic oligonucleotide
  Target: DMPK; (+) strand; PAM type: NRG; PAM sequence: TAG
ttcctcgggttccgcccctg

SEQ ID NO: 13351 - DNA, 20 bp, Artificial Sequence
  Description of Artificial Sequence: Synthetic oligonucleotide
  Target: DMPK; (+) strand; PAM type: NRG; PAM sequence: AGG
tcctcgggttccgcccctgt

SEQ ID NO: 13352 - DNA, 20 bp, Artificial Sequence
  Description of Artificial Sequence: Synthetic oligonucleotide
  Target: DMPK; (+) strand; PAM type: NRG; PAM sequence: GGG
cctcgggttccgcccctgta

SEQ ID NO: 13353 - DNA, 20 bp, Artificial Sequence
  Description of Artificial Sequence: Synthetic oligonucleotide
  Target: DMPK; (+) strand; PAM type: NRG; PAM sequence: CAG
ccgcccctgtagggcttcta

SEQ ID NO: 13354 - DNA, 20 bp, Artificial Sequence
  Description of Artificial Sequence: Synthetic oligonucleotide
  Target: DMPK; (+) strand; PAM type: NRG; PAM sequence: CAG
acagttctgacccctactcc

SEQ ID NO: 13355 - DNA, 20 bp, Artificial Sequence
  Description of Artificial Sequence: Synthetic oligonucleotide
  Target: DMPK; (+) strand; PAM type: NRG; PAM sequence: AGG
cagttctgacccctactccc

SEQ ID NO: 13356 - DNA, 20 bp, Artificial Sequence
  Description of Artificial Sequence: Synthetic oligonucleotide
  Target: DMPK; (+) strand; PAM type: NRG; PAM sequence: CGG
ccctactcccaggcaccccc

SEQ ID NO: 13357 - DNA, 20 bp, Artificial Sequence
  Description of Artificial Sequence: Synthetic oligonucleotide
  Target: DMPK; (+) strand; PAM type: NRG; PAM sequence: TGG
tactcccaggcaccccccgg

SEQ ID NO: 13358 - DNA, 20 bp, Artificial Sequence
  Description of Artificial Sequence: Synthetic oligonucleotide
  Target: DMPK; (+) strand; PAM type: NRG; PAM sequence: GGG
actcccaggcaccccccggt

SEQ ID NO: 13359 - DNA, 20 bp, Artificial Sequence
  Description of Artificial Sequence: Synthetic oligonucleotide
  Target: DMPK; (+) strand; PAM type: NRG; PAM sequence: AAG
ccccccggtgggccccaacc

SEQ ID NO: 13360 - DNA, 20 bp, Artificial Sequence
  Description of Artificial Sequence: Synthetic oligonucleotide
  Target: DMPK; (+) strand; PAM type: NRG; PAM sequence: AAG
cccggtgggccccaaccaag

SEQ ID NO: 13361 - DNA, 20 bp, Artificial Sequence
  Description of Artificial Sequence: Synthetic oligonucleotide
  Target: DMPK; (+) strand; PAM type: NRG; PAM sequence: AGG
ccggtgggccccaaccaaga

SEQ ID NO: 13362 - DNA, 20 bp, Artificial Sequence
  Description of Artificial Sequence: Synthetic oligonucleotide
  Target: DMPK; (+) strand; PAM type: NRG; PAM sequence: CAG
caaccaagaaggtccctctc

SEQ ID NO: 13363 - DNA, 20 bp, Artificial Sequence
  Description of Artificial Sequence: Synthetic oligonucleotide
  Target: DMPK; (+) strand; PAM type: NRG; PAM sequence: AGG
aaccaagaaggtccctctcc

SEQ ID NO: 13364 - DNA, 20 bp, Artificial Sequence
  Description of Artificial Sequence: Synthetic oligonucleotide
  Target: DMPK; (+) strand; PAM type: NRG; PAM sequence: TGG
gaaggtccctctccaggccc

SEQ ID NO: 13365 - DNA, 20 bp, Artificial Sequence
  Description of Artificial Sequence: Synthetic oligonucleotide
  Target: DMPK; (+) strand; PAM type: NRG; PAM sequence: TGG
tctccaggccctggcctctc

SEQ ID NO: 13366 - DNA, 20 bp, Artificial Sequence
  Description of Artificial Sequence: Synthetic oligonucleotide
  Target: DMPK; (+) strand; PAM type: NRG; PAM sequence: GGG
ctccaggccctggcctctct

SEQ ID NO: 13367 - DNA, 20 bp, Artificial Sequence
  Description of Artificial Sequence: Synthetic oligonucleotide
  Target: DMPK; (+) strand; PAM type: NRG; PAM sequence: AAG
tctctgggctctgaccttcc

SEQ ID NO: 13368 - DNA, 20 bp, Artificial Sequence
  Description of Artificial Sequence: Synthetic oligonucleotide
  Target: DMPK; (+) strand; PAM type: NRG; PAM sequence: CGG
gctctgaccttccaagaacc

SEQ ID NO: 13369 - DNA, 20 bp, Artificial Sequence
  Description of Artificial Sequence: Synthetic oligonucleotide
  Target: DMPK; (+) strand; PAM type: NRG; PAM sequence: CAG
tgaccttccaagaacccggc

SEQ ID NO: 13370 - DNA, 20 bp, Artificial Sequence
  Description of Artificial Sequence: Synthetic oligonucleotide
  Target: DMPK; (+) strand; PAM type: NRG; PAM sequence: AGG
gaccttccaagaacccggcc

SEQ ID NO: 13371 - DNA, 20 bp, Artificial Sequence
  Description of Artificial Sequence: Synthetic oligonucleotide
  Target: DMPK; (+) strand; PAM type: NRG; PAM sequence: GGG
accttccaagaacccggcca

SEQ ID NO: 13372 - DNA, 20 bp, Artificial Sequence
  Description of Artificial Sequence: Synthetic oligonucleotide
  Target: DMPK; (+) strand; PAM type: NRG; PAM sequence: AAG
caagaacccggccagggaac

SEQ ID NO: 13373 - DNA, 20 bp, Artificial Sequence
  Description of Artificial Sequence: Synthetic oligonucleotide
  Target: DMPK; (+) strand; PAM type: NRG; PAM sequence: CGG
gaacaagcttgctatcccct

SEQ ID NO: 13374 - DNA, 20 bp, Artificial Sequence
  Description of Artificial Sequence: Synthetic oligonucleotide
  Target: DMPK; (+) strand; PAM type: NRG; PAM sequence: TAG
gctgcacccacctgtgcacg

SEQ ID NO: 13375 - DNA, 20 bp, Artificial Sequence
  Description of Artificial Sequence: Synthetic oligonucleotide
  Target: DMPK; (+) strand; PAM type: NRG; PAM sequence: AAG
acccacctgtgcacgtagcc

SEQ ID NO: 13376 - DNA, 20 bp, Artificial Sequence
  Description of Artificial Sequence: Synthetic oligonucleotide
  Target: DMPK; (+) strand; PAM type: NRG; PAM sequence: CGG
acctgtgcacgtagccaagc

SEQ ID NO: 13377 - DNA, 20 bp, Artificial Sequence
  Description of Artificial Sequence: Synthetic oligonucleotide
  Target: DMPK; (+) strand; PAM type: NRG; PAM sequence: GAG
cgtagccaagccggtgcacc

SEQ ID NO: 13378 - DNA, 20 bp, Artificial Sequence
  Description of Artificial Sequence: Synthetic oligonucleotide
  Target: DMPK; (+) strand; PAM type: NRG; PAM sequence: TGG
aagccggtgcaccgagtcta

SEQ ID NO: 13379 - DNA, 20 bp, Artificial Sequence
  Description of Artificial Sequence: Synthetic oligonucleotide
  Target: DMPK; (+) strand; PAM type: NRG; PAM sequence: CAG
atggccatgacaatctccgc

SEQ ID NO: 13380 - DNA, 20 bp, Artificial Sequence
  Description of Artificial Sequence: Synthetic oligonucleotide
  Target: DMPK; (+) strand; PAM type: NRG; PAM sequence: AGG
tggccatgacaatctccgcc

SEQ ID NO: 13381 - DNA, 20 bp, Artificial Sequence
  Description of Artificial Sequence: Synthetic oligonucleotide
  Target: DMPK; (+) strand; PAM type: NRG; PAM sequence: TAG
ccatgacaatctccgccagg

SEQ ID NO: 13382 - DNA, 20 bp, Artificial Sequence
  Description of Artificial Sequence: Synthetic oligonucleotide
  Target: DMPK; (+) strand; PAM type: NRG; PAM sequence: AAG
tgacaatctccgccaggtag

SEQ ID NO: 13383 - DNA, 20 bp, Artificial Sequence
  Description of Artificial Sequence: Synthetic oligonucleotide
  Target: DMPK; (+) strand; PAM type: NRG; PAM sequence: CGG
caggtagaagcgcgccatct

SEQ ID NO: 13384 - DNA, 20 bp, Artificial Sequence
  Description of Artificial Sequence: Synthetic oligonucleotide
  Target: DMPK; (+) strand; PAM type: NRG; PAM sequence: CGG
tagaagcgcgccatctcggc

SEQ ID NO: 13385 - DNA, 20 bp, Artificial Sequence
  Description of Artificial Sequence: Synthetic oligonucleotide
  Target: DMPK; (+) strand; PAM type: NRG; PAM sequence: CAG
atccgctccccaaacttgct

SEQ ID NO: 13386 - DNA, 20 bp, Artificial Sequence
  Description of Artificial Sequence: Synthetic oligonucleotide
  Target: DMPK; (+) strand; PAM type: NRG; PAM sequence: CAG
cgctccccaaacttgctcag

SEQ ID NO: 13387 - DNA, 20 bp, Artificial Sequence
  Description of Artificial Sequence: Synthetic oligonucleotide
  Target: DMPK; (+) strand; PAM type: NRG; PAM sequence: CAG
ccaaacttgctcagcagtgt

SEQ ID NO: 13388 - DNA, 20 bp, Artificial Sequence
  Description of Artificial Sequence: Synthetic oligonucleotide
  Target: DMPK; (+) strand; PAM type: NRG; PAM sequence: CAG
aacttgctcagcagtgtcag

SEQ ID NO: 13389 - DNA, 20 bp, Artificial Sequence
  Description of Artificial Sequence: Synthetic oligonucleotide
  Target: DMPK; (+) strand; PAM type: NRG; PAM sequence: AGG
acttgctcagcagtgtcagc

SEQ ID NO: 13390 - DNA, 20 bp, Artificial Sequence
  Description of Artificial Sequence: Synthetic oligonucleotide
  Target: DMPK; (+) strand; PAM type: NRG; PAM sequence: CAG
cccacgtaatactccatgac

SEQ ID NO: 13391 - DNA, 20 bp, Artificial Sequence
  Description of Artificial Sequence: Synthetic oligonucleotide
  Target: DMPK; (+) strand; PAM type: NRG; PAM sequence: AGG
ccacgtaatactccatgacc

SEQ ID NO: 13392 - DNA, 20 bp, Artificial Sequence
  Description of Artificial Sequence: Synthetic oligonucleotide
  Target: DMPK; (+) strand; PAM type: NRG; PAM sequence: GAG
atactccatgaccaggtact

SEQ ID NO: 13393 - DNA, 20 bp, Artificial Sequence
  Description of Artificial Sequence: Synthetic oligonucleotide
  Target: DMPK; (+) strand; PAM type: NRG; PAM sequence: AAG
ctccatgaccaggtactgag

SEQ ID NO: 13394 - DNA, 20 bp, Artificial Sequence
  Description of Artificial Sequence: Synthetic oligonucleotide
  Target: DMPK; (+) strand; PAM type: NRG; PAM sequence: AGG
tccatgaccaggtactgaga

SEQ ID NO: 13395 - DNA, 20 bp, Artificial Sequence
  Description of Artificial Sequence: Synthetic oligonucleotide
  Target: DMPK; (+) strand; PAM type: NRG; PAM sequence: GGG
ccatgaccaggtactgagaa

SEQ ID NO: 13396 - DNA, 20 bp, Artificial Sequence
  Description of Artificial Sequence: Synthetic oligonucleotide
  Target: DMPK; (+) strand; PAM type: NRG; PAM sequence: GGG
catgaccaggtactgagaag

SEQ ID NO: 13397 - DNA, 20 bp, Artificial Sequence
  Description of Artificial Sequence: Synthetic oligonucleotide
  Target: DMPK; (+) strand; PAM type: NRG; PAM sequence: TGG
tactgagaaggggttcgtca

SEQ ID NO: 13398 - DNA, 20 bp, Artificial Sequence
  Description of Artificial Sequence: Synthetic oligonucleotide
  Target: DMPK; (+) strand; PAM type: NRG; PAM sequence: GGG
actgagaaggggttcgtcat

SEQ ID NO: 13399 - DNA, 20 bp, Artificial Sequence
  Description of Artificial Sequence: Synthetic oligonucleotide
  Target: DMPK; (+) strand; PAM type: NRG; PAM sequence: TGG
gagaaggggttcgtcatggg

SEQ ID NO: 13400 - DNA, 20 bp, Artificial Sequence
  Description of Artificial Sequence: Synthetic oligonucleotide
  Target: DMPK; (+) strand; PAM type: NRG; PAM sequence: TGG
aggggttcgtcatgggtggt

SEQ ID NO: 13401 - DNA, 20 bp, Artificial Sequence
  Description of Artificial Sequence: Synthetic oligonucleotide
  Target: DMPK; (+) strand; PAM type: NRG; PAM sequence: TAG
ggttcgtcatgggtggttgg

SEQ ID NO: 13402 - DNA, 20 bp, Artificial Sequence
  Description of Artificial Sequence: Synthetic oligonucleotide
  Target: DMPK; (+) strand; PAM type: NRG; PAM sequence: GAG
tgggtggttggtagtcccct

SEQ ID NO: 13403 - DNA, 20 bp, Artificial Sequence
  Description of Artificial Sequence: Synthetic oligonucleotide
  Target: DMPK; (+) strand; PAM type: NRG; PAM sequence: AGG
gggtggttggtagtcccctg

SEQ ID NO: 13404 - DNA, 20 bp, Artificial Sequence
  Description of Artificial Sequence: Synthetic oligonucleotide
  Target: DMPK; (+) strand; PAM type: NRG; PAM sequence: CGG
cctgaggccctgatccatca

SEQ ID NO: 13405 - DNA, 20 bp, Artificial Sequence
  Description of Artificial Sequence: Synthetic oligonucleotide
  Target: DMPK; (+) strand; PAM type: NRG; PAM sequence: TGG
aggccctgatccatcacgga

SEQ ID NO: 13406 - DNA, 20 bp, Artificial Sequence
  Description of Artificial Sequence: Synthetic oligonucleotide
  Target: DMPK; (+) strand; PAM type: NRG; PAM sequence: TGG
cctgatccatcacggatggc

SEQ ID NO: 13407 - DNA, 20 bp, Artificial Sequence
  Description of Artificial Sequence: Synthetic oligonucleotide
  Target: DMPK; (+) strand; PAM type: NRG; PAM sequence: GGG
ctgatccatcacggatggct

SEQ ID NO: 13408 - DNA, 20 bp, Artificial Sequence
  Description of Artificial Sequence: Synthetic oligonucleotide
  Target: DMPK; (+) strand; PAM type: NRG; PAM sequence: CAG
atggctgggacaacccctcc

SEQ ID NO: 13409 - DNA, 20 bp, Artificial Sequence
  Description of Artificial Sequence: Synthetic oligonucleotide
  Target: DMPK; (+) strand; PAM type: NRG; PAM sequence: GAG
ggctgggacaacccctccca

SEQ ID NO: 13410 - DNA, 20 bp, Artificial Sequence
  Description of Artificial Sequence: Synthetic oligonucleotide
  Target: DMPK; (+) strand; PAM type: NRG; PAM sequence: TGG
tcccagagacaccccatcct

SEQ ID NO: 13411 - DNA, 20 bp, Artificial Sequence
  Description of Artificial Sequence: Synthetic oligonucleotide
  Target: DMPK; (+) strand; PAM type: NRG; PAM sequence: GGG
cccagagacaccccatcctt

SEQ ID NO: 13412 - DNA, 20 bp, Artificial Sequence
  Description of Artificial Sequence: Synthetic oligonucleotide
  Target: DMPK; (+) strand; PAM type: NRG; PAM sequence: CAG
agagacaccccatccttggg

SEQ ID NO: 13413 - DNA, 20 bp, Artificial Sequence
  Description of Artificial Sequence: Synthetic oligonucleotide
  Target: DMPK; (+) strand; PAM type: NRG; PAM sequence: GAG
agacaccccatccttgggca

SEQ ID NO: 13414 - DNA, 20 bp, Artificial Sequence
  Description of Artificial Sequence: Synthetic oligonucleotide
  Target: DMPK; (+) strand; PAM type: NRG; PAM sequence: CAG
catccttgggcagagacctg

SEQ ID NO: 13415 - DNA, 20 bp, Artificial Sequence
  Description of Artificial Sequence: Synthetic oligonucleotide
  Target: DMPK; (+) strand; PAM type: NRG; PAM sequence: CAG
tgggcagagacctgcagccc

SEQ ID NO: 13416 - DNA, 20 bp, Artificial Sequence
  Description of Artificial Sequence: Synthetic oligonucleotide
  Target: DMPK; (+) strand; PAM type: NRG; PAM sequence: CAG
agagacctgcagccccagcc

SEQ ID NO: 13417 - DNA, 20 bp, Artificial Sequence
  Description of Artificial Sequence: Synthetic oligonucleotide
  Target: DMPK; (+) strand; PAM type: NRG; PAM sequence: GAG
agacctgcagccccagccca

SEQ ID NO: 13418 - DNA, 20 bp, Artificial Sequence
  Description of Artificial Sequence: Synthetic oligonucleotide
  Target: DMPK; (+) strand; PAM type: NRG; PAM sequence: TAG
ccccagcccagagataacca

SEQ ID NO: 13419 - DNA, 20 bp, Artificial Sequence
  Description of Artificial Sequence: Synthetic oligonucleotide
  Target: DMPK; (+) strand; PAM type: NRG; PAM sequence: GAG
ccagcccagagataaccata

SEQ ID NO: 13420 - DNA, 20 bp, Artificial Sequence
  Description of Artificial Sequence: Synthetic oligonucleotide
  Target: DMPK; (+) strand; PAM type: NRG; PAM sequence: CGG
agataaccatagagatctgc

SEQ ID NO: 13421 - DNA, 20 bp, Artificial Sequence
  Description of Artificial Sequence: Synthetic oligonucleotide
  Target: DMPK; (+) strand; PAM type: NRG; PAM sequence: GGG
gataaccatagagatctgcc

SEQ ID NO: 13422 - DNA, 20 bp, Artificial Sequence
  Description of Artificial Sequence: Synthetic oligonucleotide
  Target: DMPK; (+) strand; PAM type: NRG; PAM sequence: CAG
agagatctgccgggccaaat

SEQ ID NO: 13423 - DNA, 20 bp, Artificial Sequence
  Description of Artificial Sequence: Synthetic oligonucleotide
  Target: DMPK; (+) strand; PAM type: NRG; PAM sequence: GAG
agatctgccgggccaaatca

SEQ ID NO: 13424 - DNA, 20 bp, Artificial Sequence
  Description of Artificial Sequence: Synthetic oligonucleotide
  Target: DMPK; (+) strand; PAM type: NRG; PAM sequence: CGG
gccaaatcagagaccacctg

SEQ ID NO: 13425 - DNA, 20 bp, Artificial Sequence
  Description of Artificial Sequence: Synthetic oligonucleotide
  Target: DMPK; (+) strand; PAM type: NRG; PAM sequence: TGG
cacaaacaaaaaaactttcc

SEQ ID NO: 13426 - DNA, 20 bp, Artificial Sequence
  Description of Artificial Sequence: Synthetic oligonucleotide
  Target: DMPK; (+) strand; PAM type: NRG; PAM sequence: GGG
acaaacaaaaaaactttcct

SEQ ID NO: 13427 - DNA, 20 bp, Artificial Sequence
  Description of Artificial Sequence: Synthetic oligonucleotide
  Target: DMPK; (+) strand; PAM type: NRG; PAM sequence: TGG
aaactttcctgggatgtcac

SEQ ID NO: 13428 - DNA, 20 bp, Artificial Sequence
  Description of Artificial Sequence: Synthetic oligonucleotide
  Target: DMPK; (+) strand; PAM type: NRG; PAM sequence: GGG
aactttcctgggatgtcact

SEQ ID NO: 13429 - DNA, 20 bp, Artificial Sequence
  Description of Artificial Sequence: Synthetic oligonucleotide
  Target: DMPK; (+) strand; PAM type: NRG; PAM sequence: CAG
tttcctgggatgtcactggg

SEQ ID NO: 13430 - DNA, 20 bp, Artificial Sequence
  Description of Artificial Sequence: Synthetic oligonucleotide
  Target: DMPK; (+) strand; PAM type: NRG; PAM sequence: GAG
tgggcagattcactccccct

SEQ ID NO: 13431 - DNA, 20 bp, Artificial Sequence
  Description of Artificial Sequence: Synthetic oligonucleotide
  Target: DMPK; (+) strand; PAM type: NRG; PAM sequence: TGG
tcactccccctgagatgttc

SEQ ID NO: 13432 - DNA, 20 bp, Artificial Sequence
  Description of Artificial Sequence: Synthetic oligonucleotide
  Target: DMPK; (+) strand; PAM type: NRG; PAM sequence: GGG
cactccccctgagatgttct

SEQ ID NO: 13433 - DNA, 20 bp, Artificial Sequence
  Description of Artificial Sequence: Synthetic oligonucleotide
  Target: DMPK; (+) strand; PAM type: NRG; PAM sequence: AAG
ccccctgagatgttctggga

SEQ ID NO: 13434 - DNA, 20 bp, Artificial Sequence
  Description of Artificial Sequence: Synthetic oligonucleotide
  Target: DMPK; (+) strand; PAM type: NRG; PAM sequence: GAG
ccctgagatgttctgggaaa

SEQ ID NO: 13435 - DNA, 20 bp, Artificial Sequence
  Description of Artificial Sequence: Synthetic oligonucleotide
  Target: DMPK; (+) strand; PAM type: NRG; PAM sequence: CAG
atgttctgggaaagagaacc

SEQ ID NO: 13436 - DNA, 20 bp, Artificial Sequence
  Description of Artificial Sequence: Synthetic oligonucleotide
  Target: DMPK; (+) strand; PAM type: NRG; PAM sequence: GAG
gttctgggaaagagaaccca

SEQ ID NO: 13437 - DNA, 20 bp, Artificial Sequence
  Description of Artificial Sequence: Synthetic oligonucleotide
  Target: DMPK; (+) strand; PAM type: NRG; PAM sequence: AGG
ttctgggaaagagaacccag

SEQ ID NO: 13438 - DNA, 20 bp, Artificial Sequence
  Description of Artificial Sequence: Synthetic oligonucleotide
  Target: DMPK; (+) strand; PAM type: NRG; PAM sequence: CAG
cccagaggccacccaacacc

SEQ ID NO: 13439 - DNA, 20 bp, Artificial Sequence
  Description of Artificial Sequence: Synthetic oligonucleotide
  Target: DMPK; (+) strand; PAM type: NRG; PAM sequence: GAG
cagaggccacccaacaccca

SEQ ID NO: 13440 - DNA, 20 bp, Artificial Sequence
  Description of Artificial Sequence: Synthetic oligonucleotide
  Target: DMPK; (+) strand; PAM type: NRG; PAM sequence: TAG
gccacccaacacccagagaa

SEQ ID NO: 13441 - DNA, 20 bp, Artificial Sequence
  Description of Artificial Sequence: Synthetic oligonucleotide
  Target: DMPK; (+) strand; PAM type: NRG; PAM sequence: AGG
ccacccaacacccagagaat

SEQ ID NO: 13442 - DNA, 20 bp, Artificial Sequence
  Description of Artificial Sequence: Synthetic oligonucleotide
  Target: DMPK; (+) strand; PAM type: NRG; PAM sequence: CAG
aacacccagagaataggtcc

SEQ ID NO: 13443 - DNA, 20 bp, Artificial Sequence
  Description of Artificial Sequence: Synthetic oligonucleotide
  Target: DMPK; (+) strand; PAM type: NRG; PAM sequence: TAG
ggtcccagacactccttccc

SEQ ID NO: 13444 - DNA, 20 bp, Artificial Sequence
  Description of Artificial Sequence: Synthetic oligonucleotide
  Target: DMPK; (+) strand; PAM type: NRG; PAM sequence: AGG
gtcccagacactccttccct

SEQ ID NO: 13445 - DNA, 20 bp, Artificial Sequence
  Description of Artificial Sequence: Synthetic oligonucleotide
  Target: DMPK; (+) strand; PAM type: NRG; PAM sequence: CAG
ccagacactccttccctagg

SEQ ID NO: 13446 - DNA, 20 bp, Artificial Sequence
  Description of Artificial Sequence: Synthetic oligonucleotide
  Target: DMPK; (+) strand; PAM type: NRG; PAM sequence: TGG
gacactccttccctaggcag

SEQ ID NO: 13447 - DNA, 20 bp, Artificial Sequence
  Description of Artificial Sequence: Synthetic oligonucleotide
  Target: DMPK; (+) strand; PAM type: NRG; PAM sequence: TAG
tccctaggcagtggccccgt

SEQ ID NO: 13448 - DNA, 20 bp, Artificial Sequence
  Description of Artificial Sequence: Synthetic oligonucleotide
  Target: DMPK; (+) strand; PAM type: NRG; PAM sequence: AAG
tggccccgttagaattcctg

SEQ ID NO: 13449 - DNA, 20 bp, Artificial Sequence
  Description of Artificial Sequence: Synthetic oligonucleotide
  Target: DMPK; (+) strand; PAM type: NRG; PAM sequence: CAG
cctgaagacctatcccattc

SEQ ID NO: 13450 - DNA, 20 bp, Artificial Sequence
  Description of Artificial Sequence: Synthetic oligonucleotide
  Target: DMPK; (+) strand; PAM type: NRG; PAM sequence: AGG
ctgaagacctatcccattcc

SEQ ID NO: 13451 - DNA, 20 bp, Artificial Sequence
  Description of Artificial Sequence: Synthetic oligonucleotide
  Target: DMPK; (+) strand; PAM type: NRG; PAM sequence: AAG
agacctatcccattccaggt

SEQ ID NO: 13452 - DNA, 20 bp, Artificial Sequence
  Description of Artificial Sequence: Synthetic oligonucleotide
  Target: DMPK; (+) strand; PAM type: NRG; PAM sequence: GAG
acctatcccattccaggtaa

SEQ ID NO: 13453 - DNA, 20 bp, Artificial Sequence
  Description of Artificial Sequence: Synthetic oligonucleotide
  Target: DMPK; (+) strand; PAM type: NRG; PAM sequence: CAG
aggtaagagaccccccgcaa

SEQ ID NO: 13454 - DNA, 20 bp, Artificial Sequence
  Description of Artificial Sequence: Synthetic oligonucleotide
  Target: DMPK; (+) strand; PAM type: NRG; PAM sequence: GAG
gtaagagaccccccgcaaca

SEQ ID NO: 13455 - DNA, 20 bp, Artificial Sequence
  Description of Artificial Sequence: Synthetic oligonucleotide
  Target: DMPK; (+) strand; PAM type: NRG; PAM sequence: AAG
cgcaacagagacatctttat

SEQ ID NO: 13456 - DNA, 20 bp, Artificial Sequence
  Description of Artificial Sequence: Synthetic oligonucleotide
  Target: DMPK; (+) strand; PAM type: NRG; PAM sequence: GAG
caacagagacatctttataa

SEQ ID NO: 13457 - DNA, 20 bp, Artificial Sequence
  Description of Artificial Sequence: Synthetic oligonucleotide
  Target: DMPK; (+) strand; PAM type: NRG; PAM sequence: CAG
acatctttataagagtcccc

SEQ ID NO: 13458 - DNA, 20 bp, Artificial Sequence
  Description of Artificial Sequence: Synthetic oligonucleotide
  Target: DMPK; (+) strand; PAM type: NRG; PAM sequence: CAG
aagagtcccccagatcaccc

SEQ ID NO: 13459 - DNA, 20 bp, Artificial Sequence
  Description of Artificial Sequence: Synthetic oligonucleotide
  Target: DMPK; (+) strand; PAM type: NRG; PAM sequence: CGG
cccccagatcaccccagaaa

SEQ ID NO: 13460 - DNA, 20 bp, Artificial Sequence
  Description of Artificial Sequence: Synthetic oligonucleotide
  Target: DMPK; (+) strand; PAM type: NRG; PAM sequence: GGG
ccccagatcaccccagaaac

SEQ ID NO: 13461 - DNA, 20 bp, Artificial Sequence
  Description of Artificial Sequence: Synthetic oligonucleotide
  Target: DMPK; (+) strand; PAM type: NRG; PAM sequence: CAG
cagatcaccccagaaacggg

SEQ ID NO: 13462 - DNA, 20 bp, Artificial Sequence
  Description of Artificial Sequence: Synthetic oligonucleotide
  Target: DMPK; (+) strand; PAM type: NRG; PAM sequence: AAG
caccccagaaacgggcagtg

SEQ ID NO: 13463 - DNA, 20 bp, Artificial Sequence
  Description of Artificial Sequence: Synthetic oligonucleotide
  Target: DMPK; (+) strand; PAM type: NRG; PAM sequence: AGG
accccagaaacgggcagtga

SEQ ID NO: 13464 - DNA, 20 bp, Artificial Sequence
  Description of Artificial Sequence: Synthetic oligonucleotide
  Target: DMPK; (+) strand; PAM type: NRG; PAM sequence: CAG
gaaggacaccatccccgtct

SEQ ID NO: 13465 - DNA, 20 bp, Artificial Sequence
  Description of Artificial Sequence: Synthetic oligonucleotide
  Target: DMPK; (+) strand; PAM type: NRG; PAM sequence: TAG
gacaccatccccgtctcaga

SEQ ID NO: 13466 - DNA, 20 bp, Artificial Sequence
  Description of Artificial Sequence: Synthetic oligonucleotide
  Target: DMPK; (+) strand; PAM type: NRG; PAM sequence: AGG
acaccatccccgtctcagat

SEQ ID NO: 13467 - DNA, 20 bp, Artificial Sequence
  Description of Artificial Sequence: Synthetic oligonucleotide
  Target: DMPK; (+) strand; PAM type: NRG; PAM sequence: GGG
caccatccccgtctcagata

SEQ ID NO: 13468 - DNA, 20 bp, Artificial Sequence
  Description of Artificial Sequence: Synthetic oligonucleotide
  Target: DMPK; (+) strand; PAM type: NRG; PAM sequence: AAG
catccccgtctcagataggg

SEQ ID NO: 13469 - DNA, 20 bp, Artificial Sequence
  Description of Artificial Sequence: Synthetic oligonucleotide
  Target: DMPK; (+) strand; PAM type: NRG; PAM sequence: AGG
atccccgtctcagataggga

SEQ ID NO: 13470 - DNA, 20 bp, Artificial Sequence
  Description of Artificial Sequence: Synthetic oligonucleotide
  Target: DMPK; (+) strand; PAM type: NRG; PAM sequence: CAG
acacaccctcttaccgcaca

SEQ ID NO: 13471 - DNA, 20 bp, Artificial Sequence
  Description of Artificial Sequence: Synthetic oligonucleotide
  Target: DMPK; (+) strand; PAM type: NRG; PAM sequence: CAG
accgcacacagactttccca

SEQ ID NO: 13472 - DNA, 20 bp, Artificial Sequence
  Description of Artificial Sequence: Synthetic oligonucleotide
  Target: DMPK; (+) strand; PAM type: NRG; PAM sequence: CGG
gactttcccacagacgtttc

SEQ ID NO: 13473 - DNA, 20 bp, Artificial Sequence
  Description of Artificial Sequence: Synthetic oligonucleotide
  Target: DMPK; (+) strand; PAM type: NRG; PAM sequence: GGG
actttcccacagacgtttcc

SEQ ID NO: 13474 - DNA, 20 bp, Artificial Sequence
  Description of Artificial Sequence: Synthetic oligonucleotide
  Target: DMPK; (+) strand; PAM type: NRG; PAM sequence: CAG
ttcccacagacgtttccggg

SEQ ID NO: 13475 - DNA, 20 bp, Artificial Sequence
  Description of Artificial Sequence: Synthetic oligonucleotide
  Target: DMPK; (+) strand; PAM type: NRG; PAM sequence: TAG
ccgggcagcacccccaatcc

SEQ ID NO: 13476 - DNA, 20 bp, Artificial Sequence
  Description of Artificial Sequence: Synthetic oligonucleotide
  Target: DMPK; (+) strand; PAM type: NRG; PAM sequence: GAG
gggcagcacccccaatccta

SEQ ID NO: 13477 - DNA, 20 bp, Artificial Sequence
  Description of Artificial Sequence: Synthetic oligonucleotide
  Target: DMPK; (+) strand; PAM type: NRG; PAM sequence: CAG
cctctccccacctcctcgtc

SEQ ID NO: 13478 - DNA, 20 bp, Artificial Sequence
  Description of Artificial Sequence: Synthetic oligonucleotide
  Target: DMPK; (+) strand; PAM type: NRG; PAM sequence: CAG
cccacctcctcgtccagtga

SEQ ID NO: 13479 - DNA, 20 bp, Artificial Sequence
  Description of Artificial Sequence: Synthetic oligonucleotide
  Target: DMPK; (+) strand; PAM type: NRG; PAM sequence: CGG
ctcctcgtccagtgacagca

SEQ ID NO: 13480 - DNA, 20 bp, Artificial Sequence
  Description of Artificial Sequence: Synthetic oligonucleotide
  Target: DMPK; (+) strand; PAM type: NRG; PAM sequence: GGG
tcctcgtccagtgacagcac

SEQ ID NO: 13481 - DNA, 20 bp, Artificial Sequence
  Description of Artificial Sequence: Synthetic oligonucleotide
  Target: DMPK; (+) strand; PAM type: NRG; PAM sequence: TAG
cgggctcttgtccctcttcc

SEQ ID NO: 13482 - DNA, 20 bp, Artificial Sequence
  Description of Artificial Sequence: Synthetic oligonucleotide
  Target: DMPK; (+) strand; PAM type: NRG; PAM sequence: CGG
gtccctcttcctagtcaccc

SEQ ID NO: 13483 - DNA, 20 bp, Artificial Sequence
  Description of Artificial Sequence: Synthetic oligonucleotide
  Target: DMPK; (+) strand; PAM type: NRG; PAM sequence: CGG
tcttcctagtcaccccggcc

SEQ ID NO: 13484 - DNA, 20 bp, Artificial Sequence
  Description of Artificial Sequence: Synthetic oligonucleotide
  Target: DMPK; (+) strand; PAM type: NRG; PAM sequence: GAG
ttcctagtcaccccggcccg

SEQ ID NO: 13485 - DNA, 20 bp, Artificial Sequence
  Description of Artificial Sequence: Synthetic oligonucleotide
  Target: DMPK; (+) strand; PAM type: NRG; PAM sequence: CAG
caccccggcccggagctcac

SEQ ID NO: 13486 - DNA, 20 bp, Artificial Sequence
  Description of Artificial Sequence: Synthetic oligonucleotide
  Target: DMPK; (+) strand; PAM type: NRG; PAM sequence: AGG
accccggcccggagctcacc

SEQ ID NO: 13487 - DNA, 20 bp, Artificial Sequence
  Description of Artificial Sequence: Synthetic oligonucleotide
  Target: DMPK; (+) strand; PAM type: NRG; PAM sequence: TAG
ccggcccggagctcaccagg

SEQ ID NO: 13488 - DNA, 20 bp, Artificial Sequence
  Description of Artificial Sequence: Synthetic oligonucleotide
  Target: DMPK; (+) strand; PAM type: NRG; PAM sequence: TGG
tcaccaggtagttctcatcc

SEQ ID NO: 13489 - DNA, 20 bp, Artificial Sequence
  Description of Artificial Sequence: Synthetic oligonucleotide
  Target: DMPK; (+) strand; PAM type: NRG; PAM sequence: AAG
ccaggtagttctcatcctgg

SEQ ID NO: 13490 - DNA, 20 bp, Artificial Sequence
  Description of Artificial Sequence: Synthetic oligonucleotide
  Target: DMPK; (+) strand; PAM type: NRG; PAM sequence: AGG
caggtagttctcatcctgga

SEQ ID NO: 13491 - DNA, 20 bp, Artificial Sequence
  Description of Artificial Sequence: Synthetic oligonucleotide
  Target: DMPK; (+) strand; PAM type: NRG; PAM sequence: AAG
agttctcatcctggaaggcg

SEQ ID NO: 13492 - DNA, 20 bp, Artificial Sequence
  Description of Artificial Sequence: Synthetic oligonucleotide
  Target: DMPK; (+) strand; PAM type: NRG; PAM sequence: CAG
tcatcctggaaggcgaagtg

SEQ ID NO: 13493 - DNA, 20 bp, Artificial Sequence
  Description of Artificial Sequence: Synthetic oligonucleotide
  Target: DMPK; (+) strand; PAM type: NRG; PAM sequence: CGG
gcagctgcgtgatccaccgc

SEQ ID NO: 13494 - DNA, 20 bp, Artificial Sequence
  Description of Artificial Sequence: Synthetic oligonucleotide
  Target: DMPK; (+) strand; PAM type: NRG; PAM sequence: CGG
ccaacacgtccctctcctca

SEQ ID NO: 13495 - DNA, 20 bp, Artificial Sequence
  Description of Artificial Sequence: Synthetic oligonucleotide
  Target: DMPK; (+) strand; PAM type: NRG; PAM sequence: AAG
acacgtccctctcctcacgg

SEQ ID NO: 13496 - DNA, 20 bp, Artificial Sequence
  Description of Artificial Sequence: Synthetic oligonucleotide
  Target: DMPK; (+) strand; PAM type: NRG; PAM sequence: CAG
tcacggaagcacgacacctg

SEQ ID NO: 13497 - DNA, 20 bp, Artificial Sequence
  Description of Artificial Sequence: Synthetic oligonucleotide
  Target: DMPK; (+) strand; PAM type: NRG; PAM sequence: AGG
cacggaagcacgacacctgc

SEQ ID NO: 13498 - DNA, 20 bp, Artificial Sequence
  Description of Artificial Sequence: Synthetic oligonucleotide
  Target: DMPK; (+) strand; PAM type: NRG; PAM sequence: GGG
acggaagcacgacacctgca

SEQ ID NO: 13499 - DNA, 20 bp, Artificial Sequence
  Description of Artificial Sequence: Synthetic oligonucleotide
  Target: DMPK; (+) strand; PAM type: NRG; PAM sequence: CGG
cacgacacctgcagggcacc

SEQ ID NO: 13500 - DNA, 20 bp, Artificial Sequence
  Description of Artificial Sequence: Synthetic oligonucleotide
  Target: DMPK; (+) strand; PAM type: NRG; PAM sequence: GAG
cgacacctgcagggcacccg

SEQ ID NO: 13501 - DNA, 20 bp, Artificial Sequence
  Description of Artificial Sequence: Synthetic oligonucleotide
  Target: DMPK; (+) strand; PAM type: NRG; PAM sequence: AGG
gacacctgcagggcacccgg

SEQ ID NO: 13502 - DNA, 20 bp, Artificial Sequence
  Description of Artificial Sequence: Synthetic oligonucleotide
  Target: DMPK; (+) strand; PAM type: NRG; PAM sequence: GAG
cacctgcagggcacccggag

SEQ ID NO: 13503 - DNA, 20 bp, Artificial Sequence
  Description of Artificial Sequence: Synthetic oligonucleotide
  Target: DMPK; (+) strand; PAM type: NRG; PAM sequence: CAG
cagggcacccggaggagctg

SEQ ID NO: 13504 - DNA, 20 bp, Artificial Sequence
  Description of Artificial Sequence: Synthetic oligonucleotide
  Target: DMPK; (+) strand; PAM type: NRG; PAM sequence: CGG
gcacccggaggagctgcagc

SEQ ID NO: 13505 - DNA, 20 bp, Artificial Sequence
  Description of Artificial Sequence: Synthetic oligonucleotide
  Target: DMPK; (+) strand; PAM type: NRG; PAM sequence: GAG
acccggaggagctgcagccg

SEQ ID NO: 13506 - DNA, 20 bp, Artificial Sequence
  Description of Artificial Sequence: Synthetic oligonucleotide
  Target: DMPK; (+) strand; PAM type: NRG; PAM sequence: CGG
ggaggagctgcagccggaga

SEQ ID NO: 13507 - DNA, 20 bp, Artificial Sequence
  Description of Artificial Sequence: Synthetic oligonucleotide
  Target: DMPK; (+) strand; PAM type: NRG; PAM sequence: GGG
gaggagctgcagccggagac

SEQ ID NO: 13508 - DNA, 20 bp, Artificial Sequence
  Description of Artificial Sequence: Synthetic oligonucleotide
  Target: DMPK; (+) strand; PAM type: NRG; PAM sequence: GGG
aggagctgcagccggagacg

SEQ ID NO: 13509 - DNA, 20 bp, Artificial Sequence
  Description of Artificial Sequence: Synthetic oligonucleotide
  Target: DMPK; (+) strand; PAM type: NRG; PAM sequence: CGG
ctgcagccggagacggggcg

SEQ ID NO: 13510 - DNA, 20 bp, Artificial Sequence
  Description of Artificial Sequence: Synthetic oligonucleotide
  Target: DMPK; (+) strand; PAM type: NRG; PAM sequence: AAG
agacggggcgcggatcctca

SEQ ID NO: 13511 - DNA, 20 bp, Artificial Sequence
  Description of Artificial Sequence: Synthetic oligonucleotide
  Target: DMPK; (+) strand; PAM type: NRG; PAM sequence: CAG
caaagccccccacgtccgcc

SEQ ID NO: 13512 - DNA, 20 bp, Artificial Sequence
  Description of Artificial Sequence: Synthetic oligonucleotide
  Target: DMPK; (+) strand; PAM type: NRG; PAM sequence: CAG
cccctcacctcgcccctctt

SEQ ID NO: 13513 - DNA, 20 bp, Artificial Sequence
  Description of Artificial Sequence: Synthetic oligonucleotide
  Target: DMPK; (+) strand; PAM type: NRG; PAM sequence: TGG
ccacttgttcatgatcttca

SEQ ID NO: 13514 - DNA, 20 bp, Artificial Sequence
  Description of Artificial Sequence: Synthetic oligonucleotide
  Target: DMPK; (+) strand; PAM type: NRG; PAM sequence: TGG
tgatcttcatggcatacacc

SEQ ID NO: 13515 - DNA, 20 bp, Artificial Sequence
  Description of Artificial Sequence: Synthetic oligonucleotide
  Target: DMPK; (+) strand; PAM type: NRG; PAM sequence: GAG
catcttcactaccgctacct

SEQ ID NO: 13516 - DNA, 20 bp, Artificial Sequence
  Description of Artificial Sequence: Synthetic oligonucleotide
  Target: DMPK; (+) strand; PAM type: NRG; PAM sequence: AGG
atcttcactaccgctacctg

SEQ ID NO: 13517 - DNA, 20 bp, Artificial Sequence
  Description of Artificial Sequence: Synthetic oligonucleotide
  Target: DMPK; (+) strand; PAM type: NRG; PAM sequence: GAG
cactaccgctacctgaggtc

SEQ ID NO: 13518 - DNA, 20 bp, Artificial Sequence
  Description of Artificial Sequence: Synthetic oligonucleotide
  Target: DMPK; (+) strand; PAM type: NRG; PAM sequence: TAG
accgctacctgaggtcgaga

SEQ ID NO: 13519 - DNA, 20 bp, Artificial Sequence
  Description of Artificial Sequence: Synthetic oligonucleotide
  Target: DMPK; (+) strand; PAM type: NRG; PAM sequence: GAG
ctacctgaggtcgagatagt

SEQ ID NO: 13520 - DNA, 20 bp, Artificial Sequence
  Description of Artificial Sequence: Synthetic oligonucleotide
  Target: DMPK; (+) strand; PAM type: NRG; PAM sequence: CAG
ctgaggtcgagatagtgaga

SEQ ID NO: 13521 - DNA, 20 bp, Artificial Sequence
  Description of Artificial Sequence: Synthetic oligonucleotide
  Target: DMPK; (+) strand; PAM type: NRG; PAM sequence: GAG
gaggtcgagatagtgagaca

SEQ ID NO: 13522 - DNA, 20 bp, Artificial Sequence
  Description of Artificial Sequence: Synthetic oligonucleotide
  Target: DMPK; (+) strand; PAM type: NRG; PAM sequence: TGG
gtcgagatagtgagacagag

SEQ ID NO: 13523 - DNA, 20 bp, Artificial Sequence
  Description of Artificial Sequence: Synthetic oligonucleotide
  Target: DMPK; (+) strand; PAM type: NRG; PAM sequence: GAG
cgagatagtgagacagagtg

SEQ ID NO: 13524 - DNA, 20 bp, Artificial Sequence
  Description of Artificial Sequence: Synthetic oligonucleotide
  Target: DMPK; (+) strand; PAM type: NRG; PAM sequence: CGG
atagtgagacagagtggaga

SEQ ID NO: 13525 - DNA, 20 bp, Artificial Sequence
  Description of Artificial Sequence: Synthetic oligonucleotide
  Target: DMPK; (+) strand; PAM type: NRG; PAM sequence: CGG
gtgagacagagtggagacgg

SEQ ID NO: 13526 - DNA, 20 bp, Artificial Sequence
  Description of Artificial Sequence: Synthetic oligonucleotide
  Target: DMPK; (+) strand; PAM type: NRG; PAM sequence: GGG
tgagacagagtggagacggc

SEQ ID NO: 13527 - DNA, 20 bp, Artificial Sequence
  Description of Artificial Sequence: Synthetic oligonucleotide
  Target: DMPK; (+) strand; PAM type: NRG; PAM sequence: AAG
tggagacggcgggaaaacaa

SEQ ID NO: 13528 - DNA, 20 bp, Artificial Sequence
  Description of Artificial Sequence: Synthetic oligonucleotide
  Target: DMPK; (+) strand; PAM type: NRG; PAM sequence: AGG
ggagacggcgggaaaacaaa

SEQ ID NO: 13529 - DNA, 20 bp, Artificial Sequence
  Description of Artificial Sequence: Synthetic oligonucleotide
  Target: DMPK; (+) strand; PAM type: NRG; PAM sequence: GGG
gagacggcgggaaaacaaaa

SEQ ID NO: 13530 - DNA, 20 bp, Artificial Sequence
  Description of Artificial Sequence: Synthetic oligonucleotide
  Target: DMPK; (+) strand; PAM type: NRG; PAM sequence: CAG
ggaaaacaaaagggctcgcc

SEQ ID NO: 13531 - DNA, 20 bp, Artificial Sequence
  Description of Artificial Sequence: Synthetic oligonucleotide
  Target: DMPK; (+) strand; PAM type: NRG; PAM sequence: CAG
actccacccgcttctgcacc

SEQ ID NO: 13532 - DNA, 20 bp, Artificial Sequence
  Description of Artificial Sequence: Synthetic oligonucleotide
  Target: DMPK; (+) strand; PAM type: NRG; PAM sequence: TGG
cccgcttctgcacccagccg

SEQ ID NO: 13533 - DNA, 20 bp, Artificial Sequence
  Description of Artificial Sequence: Synthetic oligonucleotide
  Target: DMPK; (+) strand; PAM type: NRG; PAM sequence: TGG
acctgccacaccacgcccat

SEQ ID NO: 13534 - DNA, 20 bp, Artificial Sequence
  Description of Artificial Sequence: Synthetic oligonucleotide
  Target: DMPK; (+) strand; PAM type: NRG; PAM sequence: AAG
acaccacgcccattggtccc

SEQ ID NO: 13535 - DNA, 20 bp, Artificial Sequence
  Description of Artificial Sequence: Synthetic oligonucleotide
  Target: DMPK; (+) strand; PAM type: NRG; PAM sequence: CAG
ttggtcccaagccccgcctc

SEQ ID NO: 13536 - DNA, 20 bp, Artificial Sequence
  Description of Artificial Sequence: Synthetic oligonucleotide
  Target: DMPK; (+) strand; PAM type: NRG; PAM sequence: CAG
cccaagccccgcctccagcc

SEQ ID NO: 13537 - DNA, 20 bp, Artificial Sequence
  Description of Artificial Sequence: Synthetic oligonucleotide
  Target: DMPK; (+) strand; PAM type: NRG; PAM sequence: TAG
ccccgcctccagcccagccc

SEQ ID NO: 13538 - DNA, 20 bp, Artificial Sequence
  Description of Artificial Sequence: Synthetic oligonucleotide
  Target: DMPK; (+) strand; PAM type: NRG; PAM sequence: AGG
cccgcctccagcccagccct

SEQ ID NO: 13539 - DNA, 20 bp, Artificial Sequence
  Description of Artificial Sequence: Synthetic oligonucleotide
  Target: DMPK; (+) strand; PAM type: NRG; PAM sequence: AAG
ccagcccagccctaggttct

SEQ ID NO: 13540 - DNA, 20 bp, Artificial Sequence
  Description of Artificial Sequence: Synthetic oligonucleotide
  Target: DMPK; (+) strand; PAM type: NRG; PAM sequence: AGG
cagcccagccctaggttcta

SEQ ID NO: 13541 - DNA, 20 bp, Artificial Sequence
  Description of Artificial Sequence: Synthetic oligonucleotide
  Target: DMPK; (+) strand; PAM type: NRG; PAM sequence: CGG
cagccctaggttctaaggct

SEQ ID NO: 13542 - DNA, 20 bp, Artificial Sequence
  Description of Artificial Sequence: Synthetic oligonucleotide
  Target: DMPK; (+) strand; PAM type: NRG; PAM sequence: AAG
tcggtcattcatcaatttct

SEQ ID NO: 13543 - DNA, 20 bp, Artificial Sequence
  Description of Artificial Sequence: Synthetic oligonucleotide
  Target: DMPK; (+) strand; PAM type: NRG; PAM sequence: AGG
cggtcattcatcaatttcta

SEQ ID NO: 13544 - DNA, 20 bp, Artificial Sequence
  Description of Artificial Sequence: Synthetic oligonucleotide
  Target: DMPK; (+) strand; PAM type: NRG; PAM sequence: GAG
ccctatgccccgcccaccac

SEQ ID NO: 13545 - DNA, 20 bp, Artificial Sequence
  Description of Artificial Sequence: Synthetic oligonucleotide
  Target: DMPK; (+) strand; PAM type: NRG; PAM sequence: AAG
tgccccgcccaccacgagtc

SEQ ID NO: 13546 - DNA, 20 bp, Artificial Sequence
  Description of Artificial Sequence: Synthetic oligonucleotide
  Target: DMPK; (+) strand; PAM type: NRG; PAM sequence: CAG
ccgcccaccacgagtcaagt

SEQ ID NO: 13547 - DNA, 20 bp, Artificial Sequence
  Description of Artificial Sequence: Synthetic oligonucleotide
  Target: DMPK; (+) strand; PAM type: NRG; PAM sequence: AGG
cgcccaccacgagtcaagtc

SEQ ID NO: 13548 - DNA, 20 bp, Artificial Sequence
  Description of Artificial Sequence: Synthetic oligonucleotide
  Target: DMPK; (+) strand; PAM type: NRG; PAM sequence: CGG
agtcaagtcaggctcccgcc

SEQ ID NO: 13549 - DNA, 20 bp, Artificial Sequence
  Description of Artificial Sequence: Synthetic oligonucleotide
  Target: DMPK; (+) strand; PAM type: NRG; PAM sequence: CGG
agtcaggctcccgcccggtt

SEQ ID NO: 13550 - DNA, 20 bp, Artificial Sequence
  Description of Artificial Sequence: Synthetic oligonucleotide
  Target: DMPK; (+) strand; PAM type: NRG; PAM sequence: CAG
gccccgcgtccgatcacctt

SEQ ID NO: 13551 - DNA, 20 bp, Artificial Sequence
  Description of Artificial Sequence: Synthetic oligonucleotide
  Target: DMPK; (+) strand; PAM type: NRG; PAM sequence: AAG
cgatcaccttcagaatctcg

SEQ ID NO: 13552 - DNA, 20 bp, Artificial Sequence
  Description of Artificial Sequence: Synthetic oligonucleotide
  Target: DMPK; (+) strand; PAM type: NRG; PAM sequence: CAG
atctcgaagtcgtccctctg

SEQ ID NO: 13553 - DNA, 20 bp, Artificial Sequence
  Description of Artificial Sequence: Synthetic oligonucleotide
  Target: DMPK; (+) strand; PAM type: NRG; PAM sequence: CGG
cgaagtcgtccctctgcagt

SEQ ID NO: 13554 - DNA, 20 bp, Artificial Sequence
  Description of Artificial Sequence: Synthetic oligonucleotide
  Target: DMPK; (+) strand; PAM type: NRG; PAM sequence: AAG
ctctgcagtcggacctcctt

SEQ ID NO: 13555 - DNA, 20 bp, Artificial Sequence
  Description of Artificial Sequence: Synthetic oligonucleotide
  Target: DMPK; (+) strand; PAM type: NRG; PAM sequence: TGG
ctccttaagcctcaccacga

SEQ ID NO: 13556 - DNA, 20 bp, Artificial Sequence
  Description of Artificial Sequence: Synthetic oligonucleotide
  Target: DMPK; (+) strand; PAM type: NRG; PAM sequence: GGG
tccttaagcctcaccacgat

SEQ ID NO: 13557 - DNA, 20 bp, Artificial Sequence
  Description of Artificial Sequence: Synthetic oligonucleotide
  Target: DMPK; (+) strand; PAM type: NRG; PAM sequence: TGG
ctcaccacgatgggctccgc

SEQ ID NO: 13558 - DNA, 20 bp, Artificial Sequence
  Description of Artificial Sequence: Synthetic oligonucleotide
  Target: DMPK; (+) strand; PAM type: NRG; PAM sequence: GGG
tcaccacgatgggctccgct

SEQ ID NO: 13559 - DNA, 20 bp, Artificial Sequence
  Description of Artificial Sequence: Synthetic oligonucleotide
  Target: DMPK; (+) strand; PAM type: NRG; PAM sequence: GGG
caccacgatgggctccgctg

SEQ ID NO: 13560 - DNA, 20 bp, Artificial Sequence
  Description of Artificial Sequence: Synthetic oligonucleotide
  Target: DMPK; (+) strand; PAM type: NRG; PAM sequence: GGG
accacgatgggctccgctgg

SEQ ID NO: 13561 - DNA, 20 bp, Artificial Sequence
  Description of Artificial Sequence: Synthetic oligonucleotide
  Target: DMPK; (+) strand; PAM type: NRG; PAM sequence: GGG
ccacgatgggctccgctggg

SEQ ID NO: 13562 - DNA, 20 bp, Artificial Sequence
  Description of Artificial Sequence: Synthetic oligonucleotide
  Target: DMPK; (+) strand; PAM type: NRG; PAM sequence: GGG
cacgatgggctccgctgggg

SEQ ID NO: 13563 - DNA, 20 bp, Artificial Sequence
  Description of Artificial Sequence: Synthetic oligonucleotide
  Target: DMPK; (+) strand; PAM type: NRG; PAM sequence: TGG
gatgggctccgctggggggg

SEQ ID NO: 13564 - DNA, 20 bp, Artificial Sequence
  Description of Artificial Sequence: Synthetic oligonucleotide
  Target: DMPK; (+) strand; PAM type: NRG; PAM sequence: TGG
gggctccgctgggggggtgg

SEQ ID NO: 13565 - DNA, 20 bp, Artificial Sequence
  Description of Artificial Sequence: Synthetic oligonucleotide
  Target: DMPK; (+) strand; PAM type: NRG; PAM sequence: GGG
ggctccgctgggggggtggt

SEQ ID NO: 13566 - DNA, 20 bp, Artificial Sequence
  Description of Artificial Sequence: Synthetic oligonucleotide
  Target: DMPK; (+) strand; PAM type: NRG; PAM sequence: GGG
gctccgctgggggggtggtg

SEQ ID NO: 13567 - DNA, 20 bp, Artificial Sequence
  Description of Artificial Sequence: Synthetic oligonucleotide
  Target: DMPK; (+) strand; PAM type: NRG; PAM sequence: GGG
ctccgctgggggggtggtgg

SEQ ID NO: 13568 - DNA, 20 bp, Artificial Sequence
  Description of Artificial Sequence: Synthetic oligonucleotide
  Target: DMPK; (+) strand; PAM type: NRG; PAM sequence: AAG
ctgggggggtggtgggggaa

SEQ ID NO: 13569 - DNA, 20 bp, Artificial Sequence
  Description of Artificial Sequence: Synthetic oligonucleotide
  Target: DMPK; (+) strand; PAM type: NRG; PAM sequence: GAG
ggtggtgggggaaaagaacc

SEQ ID NO: 13570 - DNA, 20 bp, Artificial Sequence
  Description of Artificial Sequence: Synthetic oligonucleotide
  Target: DMPK; (+) strand; PAM type: NRG; PAM sequence: AGG
gtggtgggggaaaagaaccg

SEQ ID NO: 13571 - DNA, 20 bp, Artificial Sequence
  Description of Artificial Sequence: Synthetic oligonucleotide
  Target: DMPK; (+) strand; PAM type: NRG; PAM sequence: GGG
tggtgggggaaaagaaccga

SEQ ID NO: 13572 - DNA, 20 bp, Artificial Sequence
  Description of Artificial Sequence: Synthetic oligonucleotide
  Target: DMPK; (+) strand; PAM type: NRG; PAM sequence: CAG
ggaaaagaaccgagggtcac

SEQ ID NO: 13573 - DNA, 20 bp, Artificial Sequence
  Description of Artificial Sequence: Synthetic oligonucleotide
  Target: DMPK; (+) strand; PAM type: NRG; PAM sequence: AAG
aagaaccgagggtcaccaga

SEQ ID NO: 13574 - DNA, 20 bp, Artificial Sequence
  Description of Artificial Sequence: Synthetic oligonucleotide
  Target: DMPK; (+) strand; PAM type: NRG; PAM sequence: AGG
agaaccgagggtcaccagaa

SEQ ID NO: 13575 - DNA, 20 bp, Artificial Sequence
  Description of Artificial Sequence: Synthetic oligonucleotide
  Target: DMPK; (+) strand; PAM type: NRG; PAM sequence: GGG
gaaccgagggtcaccagaaa

SEQ ID NO: 13576 - DNA, 20 bp, Artificial Sequence
  Description of Artificial Sequence: Synthetic oligonucleotide
  Target: DMPK; (+) strand; PAM type: NRG; PAM sequence: TGG
agggtcaccagaaagggcac

SEQ ID NO: 13577 - DNA, 20 bp, Artificial Sequence
  Description of Artificial Sequence: Synthetic oligonucleotide
  Target: DMPK; (+) strand; PAM type: NRG; PAM sequence: GAG
ggtcaccagaaagggcactg

SEQ ID NO: 13578 - DNA, 20 bp, Artificial Sequence
  Description of Artificial Sequence: Synthetic oligonucleotide
  Target: DMPK; (+) strand; PAM type: NRG; PAM sequence: AAG
ccagaaagggcactggagac

SEQ ID NO: 13579 - DNA, 20 bp, Artificial Sequence
  Description of Artificial Sequence: Synthetic oligonucleotide
  Target: DMPK; (+) strand; PAM type: NRG; PAM sequence: AGG
cagaaagggcactggagaca

SEQ ID NO: 13580 - DNA, 20 bp, Artificial Sequence
  Description of Artificial Sequence: Synthetic oligonucleotide
  Target: DMPK; (+) strand; PAM type: NRG; PAM sequence: GGG
agaaagggcactggagacaa

SEQ ID NO: 13581 - DNA, 20 bp, Artificial Sequence
  Description of Artificial Sequence: Synthetic oligonucleotide
  Target: DMPK; (+) strand; PAM type: NRG; PAM sequence: GGG
gaaagggcactggagacaag

SEQ ID NO: 13582 - DNA, 20 bp, Artificial Sequence
  Description of Artificial Sequence: Synthetic oligonucleotide
  Target: DMPK; (+) strand; PAM type: NRG; PAM sequence: GGG
aaagggcactggagacaagg

SEQ ID NO: 13583 - DNA, 20 bp, Artificial Sequence
  Description of Artificial Sequence: Synthetic oligonucleotide
  Target: DMPK; (+) strand; PAM type: NRG; PAM sequence: AAG
ggcactggagacaaggggga

SEQ ID NO: 13584 - DNA, 20 bp, Artificial Sequence
  Description of Artificial Sequence: Synthetic oligonucleotide
  Target: DMPK; (+) strand; PAM type: NRG; PAM sequence: CAG
ctccccttctctctgcctct

SEQ ID NO: 13585 - DNA, 20 bp, Artificial Sequence
  Description of Artificial Sequence: Synthetic oligonucleotide
  Target: DMPK; (+) strand; PAM type: NRG; PAM sequence: TAG
tctgcctctcagcttcaccc

SEQ ID NO: 13586 - DNA, 20 bp, Artificial Sequence
  Description of Artificial Sequence: Synthetic oligonucleotide
  Target: DMPK; (+) strand; PAM type: NRG; PAM sequence: AGG
ctgcctctcagcttcaccct

SEQ ID NO: 13587 - DNA, 20 bp, Artificial Sequence
  Description of Artificial Sequence: Synthetic oligonucleotide
  Target: DMPK; (+) strand; PAM type: NRG; PAM sequence: CAG
ccctaggactgtctgcttcc

SEQ ID NO: 13588 - DNA, 20 bp, Artificial Sequence
  Description of Artificial Sequence: Synthetic oligonucleotide
  Target: DMPK; (+) strand; PAM type: NRG; PAM sequence: AGG
cctaggactgtctgcttccc

SEQ ID NO: 13589 - DNA, 20 bp, Artificial Sequence
  Description of Artificial Sequence: Synthetic oligonucleotide
  Target: DMPK; (+) strand; PAM type: NRG; PAM sequence: GGG
ctaggactgtctgcttccca

SEQ ID NO: 13590 - DNA, 20 bp, Artificial Sequence
  Description of Artificial Sequence: Synthetic oligonucleotide
  Target: DMPK; (+) strand; PAM type: NRG; PAM sequence: GGG
taggactgtctgcttcccag

SEQ ID NO: 13591 - DNA, 20 bp, Artificial Sequence
  Description of Artificial Sequence: Synthetic oligonucleotide
  Target: DMPK; (+) strand; PAM type: NRG; PAM sequence: AAG
tccccacataaacaccgtgt

SEQ ID NO: 13592 - DNA, 20 bp, Artificial Sequence
  Description of Artificial Sequence: Synthetic oligonucleotide
  Target: DMPK; (+) strand; PAM type: NRG; PAM sequence: AGG
ccccacataaacaccgtgta

SEQ ID NO: 13593 - DNA, 20 bp, Artificial Sequence
  Description of Artificial Sequence: Synthetic oligonucleotide
  Target: DMPK; (+) strand; PAM type: NRG; PAM sequence: TGG
ataaacaccgtgtaaggttc

SEQ ID NO: 13594 - DNA, 20 bp, Artificial Sequence
  Description of Artificial Sequence: Synthetic oligonucleotide
  Target: DMPK; (+) strand; PAM type: NRG; PAM sequence: GGG
taaacaccgtgtaaggttct

SEQ ID NO: 13595 - DNA, 20 bp, Artificial Sequence
  Description of Artificial Sequence: Synthetic oligonucleotide
  Target: DMPK; (+) strand; PAM type: NRG; PAM sequence: GGG
aaacaccgtgtaaggttctg

SEQ ID NO: 13596 - DNA, 20 bp, Artificial Sequence
  Description of Artificial Sequence: Synthetic oligonucleotide
  Target: DMPK; (+) strand; PAM type: NRG; PAM sequence: GGG
aacaccgtgtaaggttctgg

SEQ ID NO: 13597 - DNA, 20 bp, Artificial Sequence
  Description of Artificial Sequence: Synthetic oligonucleotide
  Target: DMPK; (+) strand; PAM type: NRG; PAM sequence: TAG
gggccaaaaatgccctccca

SEQ ID NO: 13598 - DNA, 20 bp, Artificial Sequence
  Description of Artificial Sequence: Synthetic oligonucleotide
  Target: DMPK; (+) strand; PAM type: NRG; PAM sequence: GAG
gccaaaaatgccctcccata

SEQ ID NO: 13599 - DNA, 20 bp, Artificial Sequence
  Description of Artificial Sequence: Synthetic oligonucleotide
  Target: DMPK; (+) strand; PAM type: NRG; PAM sequence: AGG
ccaaaaatgccctcccatag

SEQ ID NO: 13600 - DNA, 20 bp, Artificial Sequence
  Description of Artificial Sequence: Synthetic oligonucleotide
  Target: DMPK; (+) strand; PAM type: NRG; PAM sequence: GAG
aaatgccctcccatagaggt

SEQ ID NO: 13601 - DNA, 20 bp, Artificial Sequence
  Description of Artificial Sequence: Synthetic oligonucleotide
  Target: DMPK; (+) strand; PAM type: NRG; PAM sequence: GAG
cccatagaggtgagatgcct

SEQ ID NO: 13602 - DNA, 20 bp, Artificial Sequence
  Description of Artificial Sequence: Synthetic oligonucleotide
  Target: DMPK; (+) strand; PAM type: NRG; PAM sequence: AAG
atagaggtgagatgcctgag

SEQ ID NO: 13603 - DNA, 20 bp, Artificial Sequence
  Description of Artificial Sequence: Synthetic oligonucleotide
  Target: DMPK; (+) strand; PAM type: NRG; PAM sequence: CGG
gatgcctgagaagccctttg

SEQ ID NO: 13604 - DNA, 20 bp, Artificial Sequence
  Description of Artificial Sequence: Synthetic oligonucleotide
  Target: DMPK; (+) strand; PAM type: NRG; PAM sequence: GGG
atgcctgagaagccctttgc

SEQ ID NO: 13605 - DNA, 20 bp, Artificial Sequence
  Description of Artificial Sequence: Synthetic oligonucleotide
  Target: DMPK; (+) strand; PAM type: NRG; PAM sequence: CAG
ctgagaagccctttgcggga

SEQ ID NO: 13606 - DNA, 20 bp, Artificial Sequence
  Description of Artificial Sequence: Synthetic oligonucleotide
  Target: DMPK; (+) strand; PAM type: NRG; PAM sequence: AGG
tgagaagccctttgcgggac

SEQ ID NO: 13607 - DNA, 20 bp, Artificial Sequence
  Description of Artificial Sequence: Synthetic oligonucleotide
  Target: DMPK; (+) strand; PAM type: NRG; PAM sequence: GGG
gagaagccctttgcgggaca

SEQ ID NO: 13608 - DNA, 20 bp, Artificial Sequence
  Description of Artificial Sequence: Synthetic oligonucleotide
  Target: DMPK; (+) strand; PAM type: NRG; PAM sequence: TGG
ccctttgcgggacagggcat

SEQ ID NO: 13609 - DNA, 20 bp, Artificial Sequence
  Description of Artificial Sequence: Synthetic oligonucleotide
  Target: DMPK; (+) strand; PAM type: NRG; PAM sequence: CAG
tgcgggacagggcattggcc

SEQ ID NO: 13610 - DNA, 20 bp, Artificial Sequence
  Description of Artificial Sequence: Synthetic oligonucleotide
  Target: DMPK; (+) strand; PAM type: NRG; PAM sequence: GAG
cgggacagggcattggccca

SEQ ID NO: 13611 - DNA, 20 bp, Artificial Sequence
  Description of Artificial Sequence: Synthetic oligonucleotide
  Target: DMPK; (+) strand; PAM type: NRG; PAM sequence: AGG
gggacagggcattggcccag

SEQ ID NO: 13612 - DNA, 20 bp, Artificial Sequence
  Description of Artificial Sequence: Synthetic oligonucleotide
  Target: DMPK; (+) strand; PAM type: NRG; PAM sequence: GGG
ggacagggcattggcccaga

SEQ ID NO: 13613 - DNA, 20 bp, Artificial Sequence
  Description of Artificial Sequence: Synthetic oligonucleotide
  Target: DMPK; (+) strand; PAM type: NRG; PAM sequence: AAG
gcattggcccagagggctcc

SEQ ID NO: 13614 - DNA, 20 bp, Artificial Sequence
  Description of Artificial Sequence: Synthetic oligonucleotide
  Target: DMPK; (+) strand; PAM type: NRG; PAM sequence: AGG
cattggcccagagggctcca

SEQ ID NO: 13615 - DNA, 20 bp, Artificial Sequence
  Description of Artificial Sequence: Synthetic oligonucleotide
  Target: DMPK; (+) strand; PAM type: NRG; PAM sequence: GGG
attggcccagagggctccaa

SEQ ID NO: 13616 - DNA, 20 bp, Artificial Sequence
  Description of Artificial Sequence: Synthetic oligonucleotide
  Target: DMPK; (+) strand; PAM type: NRG; PAM sequence: CAG
cagagggctccaagggtgtg

SEQ ID NO: 13617 - DNA, 20 bp, Artificial Sequence
  Description of Artificial Sequence: Synthetic oligonucleotide
  Target: DMPK; (+) strand; PAM type: NRG; PAM sequence: AGG
agagggctccaagggtgtgc

SEQ ID NO: 13618 - DNA, 20 bp, Artificial Sequence
  Description of Artificial Sequence: Synthetic oligonucleotide
  Target: DMPK; (+) strand; PAM type: NRG; PAM sequence: TGG
ggctccaagggtgtgcagga

SEQ ID NO: 13619 - DNA, 20 bp, Artificial Sequence
  Description of Artificial Sequence: Synthetic oligonucleotide
  Target: DMPK; (+) strand; PAM type: NRG; PAM sequence: TAG
ccaagggtgtgcaggatggt

SEQ ID NO: 13620 - DNA, 20 bp, Artificial Sequence
  Description of Artificial Sequence: Synthetic oligonucleotide
  Target: DMPK; (+) strand; PAM type: NRG; PAM sequence: AGG
caagggtgtgcaggatggtt

SEQ ID NO: 13621 - DNA, 20 bp, Artificial Sequence
  Description of Artificial Sequence: Synthetic oligonucleotide
  Target: DMPK; (+) strand; PAM type: NRG; PAM sequence: GGG
aagggtgtgcaggatggtta

SEQ ID NO: 13622 - DNA, 20 bp, Artificial Sequence
  Description of Artificial Sequence: Synthetic oligonucleotide
  Target: DMPK; (+) strand; PAM type: NRG; PAM sequence: TGG
ggtgtgcaggatggttaggg

SEQ ID NO: 13623 - DNA, 20 bp, Artificial Sequence
  Description of Artificial Sequence: Synthetic oligonucleotide
  Target: DMPK; (+) strand; PAM type: NRG; PAM sequence: GGG
gtgtgcaggatggttagggt

SEQ ID NO: 13624 - DNA, 20 bp, Artificial Sequence
  Description of Artificial Sequence: Synthetic oligonucleotide
  Target: DMPK; (+) strand; PAM type: NRG; PAM sequence: GGG
tgtgcaggatggttagggtg

SEQ ID NO: 13625 - DNA, 20 bp, Artificial Sequence
  Description of Artificial Sequence: Synthetic oligonucleotide
  Target: DMPK; (+) strand; PAM type: NRG; PAM sequence: CGG
ggatggttagggtggggtaa

SEQ ID NO: 13626 - DNA, 20 bp, Artificial Sequence
  Description of Artificial Sequence: Synthetic oligonucleotide
  Target: DMPK; (+) strand; PAM type: NRG; PAM sequence: GAG
atggttagggtggggtaacg

SEQ ID NO: 13627 - DNA, 20 bp, Artificial Sequence
  Description of Artificial Sequence: Synthetic oligonucleotide
  Target: DMPK; (+) strand; PAM type: NRG; PAM sequence: CAG
gggtggggtaacggagtctg

SEQ ID NO: 13628 - DNA, 20 bp, Artificial Sequence
  Description of Artificial Sequence: Synthetic oligonucleotide
  Target: DMPK; (+) strand; PAM type: NRG; PAM sequence: AAG
tggggtaacggagtctgcag

SEQ ID NO: 13629 - DNA, 20 bp, Artificial Sequence
  Description of Artificial Sequence: Synthetic oligonucleotide
  Target: DMPK; (+) strand; PAM type: NRG; PAM sequence: AGG
ggggtaacggagtctgcaga

SEQ ID NO: 13630 - DNA, 20 bp, Artificial Sequence
  Description of Artificial Sequence: Synthetic oligonucleotide
  Target: DMPK; (+) strand; PAM type: NRG; PAM sequence: CAG
taacggagtctgcagaagga

SEQ ID NO: 13631 - DNA, 20 bp, Artificial Sequence
  Description of Artificial Sequence: Synthetic oligonucleotide
  Target: DMPK; (+) strand; PAM type: NRG; PAM sequence: AAG
ctgcagaaggacagacccta

SEQ ID NO: 13632 - DNA, 20 bp, Artificial Sequence
  Description of Artificial Sequence: Synthetic oligonucleotide
  Target: DMPK; (+) strand; PAM type: NRG; PAM sequence: AAG
aaggacagaccctaaagaac

SEQ ID NO: 13633 - DNA, 20 bp, Artificial Sequence
  Description of Artificial Sequence: Synthetic oligonucleotide
  Target: DMPK; (+) strand; PAM type: NRG; PAM sequence: AGG
aggacagaccctaaagaaca

SEQ ID NO: 13634 - DNA, 20 bp, Artificial Sequence
  Description of Artificial Sequence: Synthetic oligonucleotide
  Target: DMPK; (+) strand; PAM type: NRG; PAM sequence: GGG
ggacagaccctaaagaacaa

SEQ ID NO: 13635 - DNA, 20 bp, Artificial Sequence
  Description of Artificial Sequence: Synthetic oligonucleotide
  Target: DMPK; (+) strand; PAM type: NRG; PAM sequence: GGG
gacagaccctaaagaacaag

SEQ ID NO: 13636 - DNA, 20 bp, Artificial Sequence
  Description of Artificial Sequence: Synthetic oligonucleotide
  Target: DMPK; (+) strand; PAM type: NRG; PAM sequence: GAG
cagaccctaaagaacaaggg

SEQ ID NO: 13637 - DNA, 20 bp, Artificial Sequence
  Description of Artificial Sequence: Synthetic oligonucleotide
  Target: DMPK; (+) strand; PAM type: NRG; PAM sequence: AAG
accctaaagaacaaggggag

SEQ ID NO: 13638 - DNA, 20 bp, Artificial Sequence
  Description of Artificial Sequence: Synthetic oligonucleotide
  Target: DMPK; (+) strand; PAM type: NRG; PAM sequence: AGG
ccctaaagaacaaggggaga

SEQ ID NO: 13639 - DNA, 20 bp, Artificial Sequence
  Description of Artificial Sequence: Synthetic oligonucleotide
  Target: DMPK; (+) strand; PAM type: NRG; PAM sequence: AAG
gaacaaggggagaaggaaat

SEQ ID NO: 13640 - DNA, 20 bp, Artificial Sequence
  Description of Artificial Sequence: Synthetic oligonucleotide
  Target: DMPK; (+) strand; PAM type: NRG; PAM sequence: CAG
ggggagaaggaaataagacc

SEQ ID NO: 13641 - DNA, 20 bp, Artificial Sequence
  Description of Artificial Sequence: Synthetic oligonucleotide
  Target: DMPK; (+) strand; PAM type: NRG; PAM sequence: CAG
tccaccttccaccctgactc

SEQ ID NO: 13642 - DNA, 20 bp, Artificial Sequence
  Description of Artificial Sequence: Synthetic oligonucleotide
  Target: DMPK; (+) strand; PAM type: NRG; PAM sequence: AGG
ccaccttccaccctgactcc

SEQ ID NO: 13643 - DNA, 20 bp, Artificial Sequence
  Description of Artificial Sequence: Synthetic oligonucleotide
  Target: DMPK; (+) strand; PAM type: NRG; PAM sequence: CAG
tccaccctgactccaggtga

SEQ ID NO: 13644 - DNA, 20 bp, Artificial Sequence
  Description of Artificial Sequence: Synthetic oligonucleotide
  Target: DMPK; (+) strand; PAM type: NRG; PAM sequence: CAG
cctgactccaggtgacagtt

SEQ ID NO: 13645 - DNA, 20 bp, Artificial Sequence
  Description of Artificial Sequence: Synthetic oligonucleotide
  Target: DMPK; (+) strand; PAM type: NRG; PAM sequence: AGG
ctgactccaggtgacagttc

SEQ ID NO: 13646 - DNA, 20 bp, Artificial Sequence
  Description of Artificial Sequence: Synthetic oligonucleotide
  Target: DMPK; (+) strand; PAM type: NRG; PAM sequence: CAG
tccaggtgacagttcaggtg

SEQ ID NO: 13647 - DNA, 20 bp, Artificial Sequence
  Description of Artificial Sequence: Synthetic oligonucleotide
  Target: DMPK; (+) strand; PAM type: NRG; PAM sequence: CAG
ggtgacagttcaggtgcagc

SEQ ID NO: 13648 - DNA, 20 bp, Artificial Sequence
  Description of Artificial Sequence: Synthetic oligonucleotide
  Target: DMPK; (+) strand; PAM type: NRG; PAM sequence: AGG
gtgacagttcaggtgcagcc

SEQ ID NO: 13649 - DNA, 20 bp, Artificial Sequence
  Description of Artificial Sequence: Synthetic oligonucleotide
  Target: DMPK; (+) strand; PAM type: NRG; PAM sequence: GGG
tgacagttcaggtgcagcca

SEQ ID NO: 13650 - DNA, 20 bp, Artificial Sequence
  Description of Artificial Sequence: Synthetic oligonucleotide
  Target: DMPK; (+) strand; PAM type: NRG; PAM sequence: TAG
cccacccccacgttctcatg

SEQ ID NO: 13651 - DNA, 20 bp, Artificial Sequence
  Description of Artificial Sequence: Synthetic oligonucleotide
  Target: DMPK; (+) strand; PAM type: NRG; PAM sequence: TGG
cgttctcatgtagaatgtcc

SEQ ID NO: 13652 - DNA, 20 bp, Artificial Sequence
  Description of Artificial Sequence: Synthetic oligonucleotide
  Target: DMPK; (+) strand; PAM type: NRG; PAM sequence: GGG
gttctcatgtagaatgtcct

SEQ ID NO: 13653 - DNA, 20 bp, Artificial Sequence
  Description of Artificial Sequence: Synthetic oligonucleotide
  Target: DMPK; (+) strand; PAM type: NRG; PAM sequence: CGG
atgtagaatgtcctgggtaa

SEQ ID NO: 13654 - DNA, 20 bp, Artificial Sequence
  Description of Artificial Sequence: Synthetic oligonucleotide
  Target: DMPK; (+) strand; PAM type: NRG; PAM sequence: CAG
gaatgtcctgggtaacggcc

SEQ ID NO: 13655 - DNA, 20 bp, Artificial Sequence
  Description of Artificial Sequence: Synthetic oligonucleotide
  Target: DMPK; (+) strand; PAM type: NRG; PAM sequence: TGG
cctgggtaacggcccagacg

SEQ ID NO: 13656 - DNA, 20 bp, Artificial Sequence
  Description of Artificial Sequence: Synthetic oligonucleotide
  Target: DMPK; (+) strand; PAM type: NRG; PAM sequence: GGG
ctgggtaacggcccagacgt

SEQ ID NO: 13657 - DNA, 20 bp, Artificial Sequence
  Description of Artificial Sequence: Synthetic oligonucleotide
  Target: DMPK; (+) strand; PAM type: NRG; PAM sequence: GGG
tgggtaacggcccagacgtg

SEQ ID NO: 13658 - DNA, 20 bp, Artificial Sequence
  Description of Artificial Sequence: Synthetic oligonucleotide
  Target: DMPK; (+) strand; PAM type: NRG; PAM sequence: CAG
cccagacgtggggttgtatc

SEQ ID NO: 13659 - DNA, 20 bp, Artificial Sequence
  Description of Artificial Sequence: Synthetic oligonucleotide
  Target: DMPK; (+) strand; PAM type: NRG; PAM sequence: TAG
ggggttgtatccagtacctc

SEQ ID NO: 13660 - DNA, 20 bp, Artificial Sequence
  Description of Artificial Sequence: Synthetic oligonucleotide
  Target: DMPK; (+) strand; PAM type: NRG; PAM sequence: CAG
gtatccagtacctctagatt

SEQ ID NO: 13661 - DNA, 20 bp, Artificial Sequence
  Description of Artificial Sequence: Synthetic oligonucleotide
  Target: DMPK; (+) strand; PAM type: NRG; PAM sequence: CAG
agtacctctagattcagatg

SEQ ID NO: 13662 - DNA, 20 bp, Artificial Sequence
  Description of Artificial Sequence: Synthetic oligonucleotide
  Target: DMPK; (+) strand; PAM type: NRG; PAM sequence: AGG
gtacctctagattcagatgc

SEQ ID NO: 13663 - DNA, 20 bp, Artificial Sequence
  Description of Artificial Sequence: Synthetic oligonucleotide
  Target: DMPK; (+) strand; PAM type: NRG; PAM sequence: TGG
cctctagattcagatgcagg

SEQ ID NO: 13664 - DNA, 20 bp, Artificial Sequence
  Description of Artificial Sequence: Synthetic oligonucleotide
  Target: DMPK; (+) strand; PAM type: NRG; PAM sequence: TGG
gtggttcttgaaccacactt

SEQ ID NO: 13665 - DNA, 20 bp, Artificial Sequence
  Description of Artificial Sequence: Synthetic oligonucleotide
  Target: DMPK; (+) strand; PAM type: NRG; PAM sequence: TGG
aaccacactttggaaaaccc

SEQ ID NO: 13666 - DNA, 20 bp, Artificial Sequence
  Description of Artificial Sequence: Synthetic oligonucleotide
  Target: DMPK; (+) strand; PAM type: NRG; PAM sequence: TGG
actttggaaaaccctggatt

SEQ ID NO: 13667 - DNA, 20 bp, Artificial Sequence
  Description of Artificial Sequence: Synthetic oligonucleotide
  Target: DMPK; (+) strand; PAM type: NRG; PAM sequence: GGG
ctttggaaaaccctggattt

SEQ ID NO: 13668 - DNA, 20 bp, Artificial Sequence
  Description of Artificial Sequence: Synthetic oligonucleotide
  Target: DMPK; (+) strand; PAM type: NRG; PAM sequence: GGG
tttggaaaaccctggatttg

SEQ ID NO: 13669 - DNA, 20 bp, Artificial Sequence
  Description of Artificial Sequence: Synthetic oligonucleotide
  Target: DMPK; (+) strand; PAM type: NRG; PAM sequence: TGG
gaaaaccctggatttggggc

SEQ ID NO: 13670 - DNA, 20 bp, Artificial Sequence
  Description of Artificial Sequence: Synthetic oligonucleotide
  Target: DMPK; (+) strand; PAM type: NRG; PAM sequence: GGG
aaaaccctggatttggggct

SEQ ID NO: 13671 - DNA, 20 bp, Artificial Sequence
  Description of Artificial Sequence: Synthetic oligonucleotide
  Target: DMPK; (+) strand; PAM type: NRG; PAM sequence: GGG
aaaccctggatttggggctg

SEQ ID NO: 13672 - DNA, 20 bp, Artificial Sequence
  Description of Artificial Sequence: Synthetic oligonucleotide
  Target: DMPK; (+) strand; PAM type: NRG; PAM sequence: GGG
aaccctggatttggggctgg

SEQ ID NO: 13673 - DNA, 20 bp, Artificial Sequence
  Description of Artificial Sequence: Synthetic oligonucleotide
  Target: DMPK; (+) strand; PAM type: NRG; PAM sequence: AAG
cctggatttggggctggggg

SEQ ID NO: 13674 - DNA, 20 bp, Artificial Sequence
  Description of Artificial Sequence: Synthetic oligonucleotide
  Target: DMPK; (+) strand; PAM type: NRG; PAM sequence: AGG
ctggatttggggctggggga

SEQ ID NO: 13675 - DNA, 20 bp, Artificial Sequence
  Description of Artificial Sequence: Synthetic oligonucleotide
  Target: DMPK; (+) strand; PAM type: NRG; PAM sequence: CAG
tttggggctgggggaaggaa

SEQ ID NO: 13676 - DNA, 20 bp, Artificial Sequence
  Description of Artificial Sequence: Synthetic oligonucleotide
  Target: DMPK; (+) strand; PAM type: NRG; PAM sequence: AGG
ttggggctgggggaaggaac

SEQ ID NO: 13677 - DNA, 20 bp, Artificial Sequence
  Description of Artificial Sequence: Synthetic oligonucleotide
  Target: DMPK; (+) strand; PAM type: NRG; PAM sequence: CAG
ggctgggggaaggaacagga

SEQ ID NO: 13678 - DNA, 20 bp, Artificial Sequence
  Description of Artificial Sequence: Synthetic oligonucleotide
  Target: DMPK; (+) strand; PAM type: NRG; PAM sequence: AGG
gctgggggaaggaacaggac

SEQ ID NO: 13679 - DNA, 20 bp, Artificial Sequence
  Description of Artificial Sequence: Synthetic oligonucleotide
  Target: DMPK; (+) strand; PAM type: NRG; PAM sequence: GGG
ctgggggaaggaacaggaca

SEQ ID NO: 13680 - DNA, 20 bp, Artificial Sequence
  Description of Artificial Sequence: Synthetic oligonucleotide
  Target: DMPK; (+) strand; PAM type: NRG; PAM sequence: GAG
gggggaaggaacaggacagg

SEQ ID NO: 13681 - DNA, 20 bp, Artificial Sequence
  Description of Artificial Sequence: Synthetic oligonucleotide
  Target: DMPK; (+) strand; PAM type: NRG; PAM sequence: AAG
aggaacaggacagggagaca

SEQ ID NO: 13682 - DNA, 20 bp, Artificial Sequence
  Description of Artificial Sequence: Synthetic oligonucleotide
  Target: DMPK; (+) strand; PAM type: NRG; PAM sequence: AGG
ggaacaggacagggagacaa

SEQ ID NO: 13683 - DNA, 20 bp, Artificial Sequence
  Description of Artificial Sequence: Synthetic oligonucleotide
  Target: DMPK; (+) strand; PAM type: NRG; PAM sequence: TAG
acaggacagggagacaaagg

SEQ ID NO: 13684 - DNA, 20 bp, Artificial Sequence
  Description of Artificial Sequence: Synthetic oligonucleotide
  Target: DMPK; (+) strand; PAM type: NRG; PAM sequence: TGG
acagggagacaaaggtagca

SEQ ID NO: 13685 - DNA, 20 bp, Artificial Sequence
  Description of Artificial Sequence: Synthetic oligonucleotide
  Target: DMPK; (+) strand; PAM type: NRG; PAM sequence: CAG
ggtagcatggtcacatatcc

SEQ ID NO: 13686 - DNA, 20 bp, Artificial Sequence
  Description of Artificial Sequence: Synthetic oligonucleotide
  Target: DMPK; (+) strand; PAM type: NRG; PAM sequence: AAG
tggtcacatatcccagactc

SEQ ID NO: 13687 - DNA, 20 bp, Artificial Sequence
  Description of Artificial Sequence: Synthetic oligonucleotide
  Target: DMPK; (+) strand; PAM type: NRG; PAM sequence: CGG
tatcccagactcaagtgctc

SEQ ID NO: 13688 - DNA, 20 bp, Artificial Sequence
  Description of Artificial Sequence: Synthetic oligonucleotide
  Target: DMPK; (+) strand; PAM type: NRG; PAM sequence: CAG
cagactcaagtgctccggtc

SEQ ID NO: 13689 - DNA, 20 bp, Artificial Sequence
  Description of Artificial Sequence: Synthetic oligonucleotide
  Target: DMPK; (+) strand; PAM type: NRG; PAM sequence: CAG
ctccggtccagcccatctct

SEQ ID NO: 13690 - DNA, 20 bp, Artificial Sequence
  Description of Artificial Sequence: Synthetic oligonucleotide
  Target: DMPK; (+) strand; PAM type: NRG; PAM sequence: CAG
cagcccatctctcagtcctc

SEQ ID NO: 13691 - DNA, 20 bp, Artificial Sequence
  Description of Artificial Sequence: Synthetic oligonucleotide
  Target: DMPK; (+) strand; PAM type: NRG; PAM sequence: AGG
agcccatctctcagtcctcc

SEQ ID NO: 13692 - DNA, 20 bp, Artificial Sequence
  Description of Artificial Sequence: Synthetic oligonucleotide
  Target: DMPK; (+) strand; PAM type: NRG; PAM sequence: GAG
cccatctctcagtcctccag

SEQ ID NO: 13693 - DNA, 20 bp, Artificial Sequence
  Description of Artificial Sequence: Synthetic oligonucleotide
  Target: DMPK; (+) strand; PAM type: NRG; PAM sequence: AGG
ccatctctcagtcctccagg

SEQ ID NO: 13694 - DNA, 20 bp, Artificial Sequence
  Description of Artificial Sequence: Synthetic oligonucleotide
  Target: DMPK; (+) strand; PAM type: NRG; PAM sequence: GAG
atctctcagtcctccaggag

SEQ ID NO: 13695 - DNA, 20 bp, Artificial Sequence
  Description of Artificial Sequence: Synthetic oligonucleotide
  Target: DMPK; (+) strand; PAM type: NRG; PAM sequence: TAG
gtcctccaggaggagtgctt

SEQ ID NO: 13696 - DNA, 20 bp, Artificial Sequence
  Description of Artificial Sequence: Synthetic oligonucleotide
  Target: DMPK; (+) strand; PAM type: NRG; PAM sequence: CAG
ttagtcctaccccttattta

SEQ ID NO: 13697 - DNA, 20 bp, Artificial Sequence
  Description of Artificial Sequence: Synthetic oligonucleotide
  Target: DMPK; (+) strand; PAM type: NRG; PAM sequence: CAG
ccttatttacagatgacaat

SEQ ID NO: 13698 - DNA, 20 bp, Artificial Sequence
  Description of Artificial Sequence: Synthetic oligonucleotide
  Target: DMPK; (+) strand; PAM type: NRG; PAM sequence: AGG
cttatttacagatgacaatc

SEQ ID NO: 13699 - DNA, 20 bp, Artificial Sequence
  Description of Artificial Sequence: Synthetic oligonucleotide
  Target: DMPK; (+) strand; PAM type: NRG; PAM sequence: CAG
cagatgacaatcaggcctct

SEQ ID NO: 13700 - DNA, 20 bp, Artificial Sequence
  Description of Artificial Sequence: Synthetic oligonucleotide
  Target: DMPK; (+) strand; PAM type: NRG; PAM sequence: AAG
atgacaatcaggcctctcag

SEQ ID NO: 13701 - DNA, 20 bp, Artificial Sequence
  Description of Artificial Sequence: Synthetic oligonucleotide
  Target: DMPK; (+) strand; PAM type: NRG; PAM sequence: AAG
aatcaggcctctcagaagtc

SEQ ID NO: 13702 - DNA, 20 bp, Artificial Sequence
  Description of Artificial Sequence: Synthetic oligonucleotide
  Target: DMPK; (+) strand; PAM type: NRG; PAM sequence: AGG
atcaggcctctcagaagtca

SEQ ID NO: 13703 - DNA, 20 bp, Artificial Sequence
  Description of Artificial Sequence: Synthetic oligonucleotide
  Target: DMPK; (+) strand; PAM type: NRG; PAM sequence: TAG
agaagtcaaggtcctatgac

SEQ ID NO: 13704 - DNA, 20 bp, Artificial Sequence
  Description of Artificial Sequence: Synthetic oligonucleotide
  Target: DMPK; (+) strand; PAM type: NRG; PAM sequence: AGG
gaagtcaaggtcctatgact

SEQ ID NO: 13705 - DNA, 20 bp, Artificial Sequence
  Description of Artificial Sequence: Synthetic oligonucleotide
  Target: DMPK; (+) strand; PAM type: NRG; PAM sequence: TGG
tatgactaggaatgttaaac

SEQ ID NO: 13706 - DNA, 20 bp, Artificial Sequence
  Description of Artificial Sequence: Synthetic oligonucleotide
  Target: DMPK; (+) strand; PAM type: NRG; PAM sequence: GGG
atgactaggaatgttaaact

SEQ ID NO: 13707 - DNA, 20 bp, Artificial Sequence
  Description of Artificial Sequence: Synthetic oligonucleotide
  Target: DMPK; (+) strand; PAM type: NRG; PAM sequence: CAG
actaggaatgttaaactggg

SEQ ID NO: 13708 - DNA, 20 bp, Artificial Sequence
  Description of Artificial Sequence: Synthetic oligonucleotide
  Target: DMPK; (+) strand; PAM type: NRG; PAM sequence: TGG
gaatgttaaactgggcagcc

SEQ ID NO: 13709 - DNA, 20 bp, Artificial Sequence
  Description of Artificial Sequence: Synthetic oligonucleotide
  Target: DMPK; (+) strand; PAM type: NRG; PAM sequence: GGG
aatgttaaactgggcagcct

SEQ ID NO: 13710 - DNA, 20 bp, Artificial Sequence
  Description of Artificial Sequence: Synthetic oligonucleotide
  Target: DMPK; (+) strand; PAM type: NRG; PAM sequence: TGG
gttaaactgggcagcctggg

SEQ ID NO: 13711 - DNA, 20 bp, Artificial Sequence
  Description of Artificial Sequence: Synthetic oligonucleotide
  Target: DMPK; (+) strand; PAM type: NRG; PAM sequence: GGG
ttaaactgggcagcctgggt

SEQ ID NO: 13712 - DNA, 20 bp, Artificial Sequence
  Description of Artificial Sequence: Synthetic oligonucleotide
  Target: DMPK; (+) strand; PAM type: NRG; PAM sequence: GGG
taaactgggcagcctgggtg

SEQ ID NO: 13713 - DNA, 20 bp, Artificial Sequence
  Description of Artificial Sequence: Synthetic oligonucleotide
  Target: DMPK; (+) strand; PAM type: NRG; PAM sequence: GGG
aaactgggcagcctgggtgg

SEQ ID NO: 13714 - DNA, 20 bp, Artificial Sequence
  Description of Artificial Sequence: Synthetic oligonucleotide
  Target: DMPK; (+) strand; PAM type: NRG; PAM sequence: CAG
gggcagcctgggtgggggac

SEQ ID NO: 13715 - DNA, 20 bp, Artificial Sequence
  Description of Artificial Sequence: Synthetic oligonucleotide
  Target: DMPK; (+) strand; PAM type: NRG; PAM sequence: TGG
agcctgggtgggggaccagc

SEQ ID NO: 13716 - DNA, 20 bp, Artificial Sequence
  Description of Artificial Sequence: Synthetic oligonucleotide
  Target: DMPK; (+) strand; PAM type: NRG; PAM sequence: GGG
gcctgggtgggggaccagct

SEQ ID NO: 13717 - DNA, 20 bp, Artificial Sequence
  Description of Artificial Sequence: Synthetic oligonucleotide
  Target: DMPK; (+) strand; PAM type: NRG; PAM sequence: GGG
cctgggtgggggaccagctg

SEQ ID NO: 13718 - DNA, 20 bp, Artificial Sequence
  Description of Artificial Sequence: Synthetic oligonucleotide
  Target: DMPK; (+) strand; PAM type: NRG; PAM sequence: TGG
gggtgggggaccagctgggg

SEQ ID NO: 13719 - DNA, 20 bp, Artificial Sequence
  Description of Artificial Sequence: Synthetic oligonucleotide
  Target: DMPK; (+) strand; PAM type: NRG; PAM sequence: GAG
gtgggggaccagctggggtg

SEQ ID NO: 13720 - DNA, 20 bp, Artificial Sequence
  Description of Artificial Sequence: Synthetic oligonucleotide
  Target: DMPK; (+) strand; PAM type: NRG; PAM sequence: AGG
tgggggaccagctggggtgg

SEQ ID NO: 13721 - DNA, 20 bp, Artificial Sequence
  Description of Artificial Sequence: Synthetic oligonucleotide
  Target: DMPK; (+) strand; PAM type: NRG; PAM sequence: TGG
ccagctggggtggaggcttg

SEQ ID NO: 13722 - DNA, 20 bp, Artificial Sequence
  Description of Artificial Sequence: Synthetic oligonucleotide
  Target: DMPK; (+) strand; PAM type: NRG; PAM sequence: CAG
tggggtggaggcttgtggct

SEQ ID NO: 13723 - DNA, 20 bp, Artificial Sequence
  Description of Artificial Sequence: Synthetic oligonucleotide
  Target: DMPK; (+) strand; PAM type: NRG; PAM sequence: AGG
ggggtggaggcttgtggctc

SEQ ID NO: 13724 - DNA, 20 bp, Artificial Sequence
  Description of Artificial Sequence: Synthetic oligonucleotide
  Target: DMPK; (+) strand; PAM type: NRG; PAM sequence: GGG
gggtggaggcttgtggctca

SEQ ID NO: 13725 - DNA, 20 bp, Artificial Sequence
  Description of Artificial Sequence: Synthetic oligonucleotide
  Target: DMPK; (+) strand; PAM type: NRG; PAM sequence: TGG
ggcttgtggctcagggactg

SEQ ID NO: 13726 - DNA, 20 bp, Artificial Sequence
  Description of Artificial Sequence: Synthetic oligonucleotide
  Target: DMPK; (+) strand; PAM type: NRG; PAM sequence: GGG
gcttgtggctcagggactgt

SEQ ID NO: 13727 - DNA, 20 bp, Artificial Sequence
  Description of Artificial Sequence: Synthetic oligonucleotide
  Target: DMPK; (+) strand; PAM type: NRG; PAM sequence: GGG
cttgtggctcagggactgtg

SEQ ID NO: 13728 - DNA, 20 bp, Artificial Sequence
  Description of Artificial Sequence: Synthetic oligonucleotide
  Target: DMPK; (+) strand; PAM type: NRG; PAM sequence: CAG
tggctcagggactgtgggga

SEQ ID NO: 13729 - DNA, 20 bp, Artificial Sequence
  Description of Artificial Sequence: Synthetic oligonucleotide
  Target: DMPK; (+) strand; PAM type: NRG; PAM sequence: AGG
ggctcagggactgtggggac

SEQ ID NO: 13730 - DNA, 20 bp, Artificial Sequence
  Description of Artificial Sequence: Synthetic oligonucleotide
  Target: DMPK; (+) strand; PAM type: NRG; PAM sequence: GGG
gctcagggactgtggggaca

SEQ ID NO: 13731 - DNA, 20 bp, Artificial Sequence
  Description of Artificial Sequence: Synthetic oligonucleotide
  Target: DMPK; (+) strand; PAM type: NRG; PAM sequence: GAG
tcagggactgtggggacagg

SEQ ID NO: 13732 - DNA, 20 bp, Artificial Sequence
  Description of Artificial Sequence: Synthetic oligonucleotide
  Target: DMPK; (+) strand; PAM type: NRG; PAM sequence: AGG
cagggactgtggggacaggg

SEQ ID NO: 13733 - DNA, 20 bp, Artificial Sequence
  Description of Artificial Sequence: Synthetic oligonucleotide
  Target: DMPK; (+) strand; PAM type: NRG; PAM sequence: TGG
actgtggggacagggaggcc

SEQ ID NO: 13734 - DNA, 20 bp, Artificial Sequence
  Description of Artificial Sequence: Synthetic oligonucleotide
  Target: DMPK; (+) strand; PAM type: NRG; PAM sequence: CGG
gacagggaggcctggactcc

SEQ ID NO: 13735 - DNA, 20 bp, Artificial Sequence
  Description of Artificial Sequence: Synthetic oligonucleotide
  Target: DMPK; (+) strand; PAM type: NRG; PAM sequence: GGG
acagggaggcctggactccc

SEQ ID NO: 13736 - DNA, 20 bp, Artificial Sequence
  Description of Artificial Sequence: Synthetic oligonucleotide
  Target: DMPK; (+) strand; PAM type: NRG; PAM sequence: GGG
cagggaggcctggactcccg

SEQ ID NO: 13737 - DNA, 20 bp, Artificial Sequence
  Description of Artificial Sequence: Synthetic oligonucleotide
  Target: DMPK; (+) strand; PAM type: NRG; PAM sequence: GGG
agggaggcctggactcccgg

SEQ ID NO: 13738 - DNA, 20 bp, Artificial Sequence
  Description of Artificial Sequence: Synthetic oligonucleotide
  Target: DMPK; (+) strand; PAM type: NRG; PAM sequence: TGG
gaggcctggactcccggggg

SEQ ID NO: 13739 - DNA, 20 bp, Artificial Sequence
  Description of Artificial Sequence: Synthetic oligonucleotide
  Target: DMPK; (+) strand; PAM type: NRG; PAM sequence: AAG
gcctggactcccgggggtgg

SEQ ID NO: 13740 - DNA, 20 bp, Artificial Sequence
  Description of Artificial Sequence: Synthetic oligonucleotide
  Target: DMPK; (+) strand; PAM type: NRG; PAM sequence: AAG
tggactcccgggggtggaag

SEQ ID NO: 13741 - DNA, 20 bp, Artificial Sequence
  Description of Artificial Sequence: Synthetic oligonucleotide
  Target: DMPK; (+) strand; PAM type: NRG; PAM sequence: TGG
actcccgggggtggaagaag

SEQ ID NO: 13742 - DNA, 20 bp, Artificial Sequence
  Description of Artificial Sequence: Synthetic oligonucleotide
  Target: DMPK; (+) strand; PAM type: NRG; PAM sequence: GAG
tcccgggggtggaagaagtg

SEQ ID NO: 13743 - DNA, 20 bp, Artificial Sequence
  Description of Artificial Sequence: Synthetic oligonucleotide
  Target: DMPK; (+) strand; PAM type: NRG; PAM sequence: AGG
cccgggggtggaagaagtgg

SEQ ID NO: 13744 - DNA, 20 bp, Artificial Sequence
  Description of Artificial Sequence: Synthetic oligonucleotide
  Target: DMPK; (+) strand; PAM type: NRG; PAM sequence: CAG
gggggtggaagaagtggagg

SEQ ID NO: 13745 - DNA, 20 bp, Artificial Sequence
  Description of Artificial Sequence: Synthetic oligonucleotide
  Target: DMPK; (+) strand; PAM type: NRG; PAM sequence: AGG
ggggtggaagaagtggaggc

SEQ ID NO: 13746 - DNA, 20 bp, Artificial Sequence
  Description of Artificial Sequence: Synthetic oligonucleotide
  Target: DMPK; (+) strand; PAM type: NRG; PAM sequence: TGG
tggaagaagtggaggcagga

SEQ ID NO: 13747 - DNA, 20 bp, Artificial Sequence
  Description of Artificial Sequence: Synthetic oligonucleotide
  Target: DMPK; (+) strand; PAM type: NRG; PAM sequence: GAG
gaagaagtggaggcaggatg

SEQ ID NO: 13748 - DNA, 20 bp, Artificial Sequence
  Description of Artificial Sequence: Synthetic oligonucleotide
  Target: DMPK; (+) strand; PAM type: NRG; PAM sequence: GAG
agaagtggaggcaggatgga

SEQ ID NO: 13749 - DNA, 20 bp, Artificial Sequence
  Description of Artificial Sequence: Synthetic oligonucleotide
  Target: DMPK; (+) strand; PAM type: NRG; PAM sequence: GAG
aagtggaggcaggatggaga

SEQ ID NO: 13750 - DNA, 20 bp, Artificial Sequence
  Description of Artificial Sequence: Synthetic oligonucleotide
  Target: DMPK; (+) strand; PAM type: NRG; PAM sequence: AGG
agtggaggcaggatggagag

SEQ ID NO: 13751 - DNA, 20 bp, Artificial Sequence
  Description of Artificial Sequence: Synthetic oligonucleotide
  Target: DMPK; (+) strand; PAM type: NRG; PAM sequence: GGG
gtggaggcaggatggagaga

SEQ ID NO: 13752 - DNA, 20 bp, Artificial Sequence
  Description of Artificial Sequence: Synthetic oligonucleotide
  Target: DMPK; (+) strand; PAM type: NRG; PAM sequence: TGG
aggcaggatggagagaggga

SEQ ID NO: 13753 - DNA, 20 bp, Artificial Sequence
  Description of Artificial Sequence: Synthetic oligonucleotide
  Target: DMPK; (+) strand; PAM type: NRG; PAM sequence: GGG
ggcaggatggagagagggat

SEQ ID NO: 13754 - DNA, 20 bp, Artificial Sequence
  Description of Artificial Sequence: Synthetic oligonucleotide
  Target: DMPK; (+) strand; PAM type: NRG; PAM sequence: TGG
gatggagagagggatgggta

SEQ ID NO: 13755 - DNA, 20 bp, Artificial Sequence
  Description of Artificial Sequence: Synthetic oligonucleotide
  Target: DMPK; (+) strand; PAM type: NRG; PAM sequence: GGG
atggagagagggatgggtat

SEQ ID NO: 13756 - DNA, 20 bp, Artificial Sequence
  Description of Artificial Sequence: Synthetic oligonucleotide
  Target: DMPK; (+) strand; PAM type: NRG; PAM sequence: GAG
ggagagagggatgggtatgg

SEQ ID NO: 13757 - DNA, 20 bp, Artificial Sequence
  Description of Artificial Sequence: Synthetic oligonucleotide
  Target: DMPK; (+) strand; PAM type: NRG; PAM sequence: AGG
gagagagggatgggtatggg

SEQ ID NO: 13758 - DNA, 20 bp, Artificial Sequence
  Description of Artificial Sequence: Synthetic oligonucleotide
  Target: DMPK; (+) strand; PAM type: NRG; PAM sequence: GGG
agagagggatgggtatggga

SEQ ID NO: 13759 - DNA, 20 bp, Artificial Sequence
  Description of Artificial Sequence: Synthetic oligonucleotide
  Target: DMPK; (+) strand; PAM type: NRG; PAM sequence: GGG
gagagggatgggtatgggag

SEQ ID NO: 13760 - DNA, 20 bp, Artificial Sequence
  Description of Artificial Sequence: Synthetic oligonucleotide
  Target: DMPK; (+) strand; PAM type: NRG; PAM sequence: GAG
gagggatgggtatgggaggg

SEQ ID NO: 13761 - DNA, 20 bp, Artificial Sequence
  Description of Artificial Sequence: Synthetic oligonucleotide
  Target: DMPK; (+) strand; PAM type: NRG; PAM sequence: AGG
agggatgggtatgggagggg

SEQ ID NO: 13762 - DNA, 20 bp, Artificial Sequence
  Description of Artificial Sequence: Synthetic oligonucleotide
  Target: DMPK; (+) strand; PAM type: NRG; PAM sequence: GGG
gggatgggtatgggagggga

SEQ ID NO: 13763 - DNA, 20 bp, Artificial Sequence
  Description of Artificial Sequence: Synthetic oligonucleotide
  Target: DMPK; (+) strand; PAM type: NRG; PAM sequence: AAG
atgggtatgggaggggaggg

SEQ ID NO: 13764 - DNA, 20 bp, Artificial Sequence
  Description of Artificial Sequence: Synthetic oligonucleotide
  Target: DMPK; (+) strand; PAM type: NRG; PAM sequence: AGG
tgggtatgggaggggaggga

SEQ ID NO: 13765 - DNA, 20 bp, Artificial Sequence
  Description of Artificial Sequence: Synthetic oligonucleotide
  Target: DMPK; (+) strand; PAM type: NRG; PAM sequence: GAG
ggtatgggaggggagggaag

SEQ ID NO: 13766 - DNA, 20 bp, Artificial Sequence
  Description of Artificial Sequence: Synthetic oligonucleotide
  Target: DMPK; (+) strand; PAM type: NRG; PAM sequence: GAG
tatgggaggggagggaagga

SEQ ID NO: 13767 - DNA, 20 bp, Artificial Sequence
  Description of Artificial Sequence: Synthetic oligonucleotide
  Target: DMPK; (+) strand; PAM type: NRG; PAM sequence: AGG
atgggaggggagggaaggag

SEQ ID NO: 13768 - DNA, 20 bp, Artificial Sequence
  Description of Artificial Sequence: Synthetic oligonucleotide
  Target: DMPK; (+) strand; PAM type: NRG; PAM sequence: GAG
gggaggggagggaaggagag

SEQ ID NO: 13769 - DNA, 20 bp, Artificial Sequence
  Description of Artificial Sequence: Synthetic oligonucleotide
  Target: DMPK; (+) strand; PAM type: NRG; PAM sequence: CAG
ggggagggaaggagaggaga

SEQ ID NO: 13770 - DNA, 20 bp, Artificial Sequence
  Description of Artificial Sequence: Synthetic oligonucleotide
  Target: DMPK; (+) strand; PAM type: NRG; PAM sequence: TGG
gagggaaggagaggagacag

SEQ ID NO: 13771 - DNA, 20 bp, Artificial Sequence
  Description of Artificial Sequence: Synthetic oligonucleotide
  Target: DMPK; (+) strand; PAM type: NRG; PAM sequence: GGG
agggaaggagaggagacagt

SEQ ID NO: 13772 - DNA, 20 bp, Artificial Sequence
  Description of Artificial Sequence: Synthetic oligonucleotide
  Target: DMPK; (+) strand; PAM type: NRG; PAM sequence: TGG
ggagaggagacagtgggttc

SEQ ID NO: 13773 - DNA, 20 bp, Artificial Sequence
  Description of Artificial Sequence: Synthetic oligonucleotide
  Target: DMPK; (+) strand; PAM type: NRG; PAM sequence: GAG
agaggagacagtgggttctg

SEQ ID NO: 13774 - DNA, 20 bp, Artificial Sequence
  Description of Artificial Sequence: Synthetic oligonucleotide
  Target: DMPK; (+) strand; PAM type: NRG; PAM sequence: AGG
gaggagacagtgggttctgg

SEQ ID NO: 13775 - DNA, 20 bp, Artificial Sequence
  Description of Artificial Sequence: Synthetic oligonucleotide
  Target: DMPK; (+) strand; PAM type: NRG; PAM sequence: AAG
agacagtgggttctggagga

SEQ ID NO: 13776 - DNA, 20 bp, Artificial Sequence
  Description of Artificial Sequence: Synthetic oligonucleotide
  Target: DMPK; (+) strand; PAM type: NRG; PAM sequence: GAG
acagtgggttctggaggaaa

SEQ ID NO: 13777 - DNA, 20 bp, Artificial Sequence
  Description of Artificial Sequence: Synthetic oligonucleotide
  Target: DMPK; (+) strand; PAM type: NRG; PAM sequence: GAG
agtgggttctggaggaaaga

SEQ ID NO: 13778 - DNA, 20 bp, Artificial Sequence
  Description of Artificial Sequence: Synthetic oligonucleotide
  Target: DMPK; (+) strand; PAM type: NRG; PAM sequence: AGG
gtgggttctggaggaaagag

SEQ ID NO: 13779 - DNA, 20 bp, Artificial Sequence
  Description of Artificial Sequence: Synthetic oligonucleotide
  Target: DMPK; (+) strand; PAM type: NRG; PAM sequence: GGG
tgggttctggaggaaagaga

SEQ ID NO: 13780 - DNA, 20 bp, Artificial Sequence
  Description of Artificial Sequence: Synthetic oligonucleotide
  Target: DMPK; (+) strand; PAM type: NRG; PAM sequence: GGG
gggttctggaggaaagagag

SEQ ID NO: 13781 - DNA, 20 bp, Artificial Sequence
  Description of Artificial Sequence: Synthetic oligonucleotide
  Target: DMPK; (+) strand; PAM type: NRG; PAM sequence: CGG
tggaggaaagagaggggttc

SEQ ID NO: 13782 - DNA, 20 bp, Artificial Sequence
  Description of Artificial Sequence: Synthetic oligonucleotide
  Target: DMPK; (+) strand; PAM type: NRG; PAM sequence: GGG
ggaggaaagagaggggttcc

SEQ ID NO: 13783 - DNA, 20 bp, Artificial Sequence
  Description of Artificial Sequence: Synthetic oligonucleotide
  Target: DMPK; (+) strand; PAM type: NRG; PAM sequence: GGG
gaggaaagagaggggttccg

SEQ ID NO: 13784 - DNA, 20 bp, Artificial Sequence
  Description of Artificial Sequence: Synthetic oligonucleotide
  Target: DMPK; (+) strand; PAM type: NRG; PAM sequence: GGG
aggaaagagaggggttccgg

SEQ ID NO: 13785 - DNA, 20 bp, Artificial Sequence
  Description of Artificial Sequence: Synthetic oligonucleotide
  Target: DMPK; (+) strand; PAM type: NRG; PAM sequence: GGG
ggaaagagaggggttccggg

SEQ ID NO: 13786 - DNA, 20 bp, Artificial Sequence
  Description of Artificial Sequence: Synthetic oligonucleotide
  Target: DMPK; (+) strand; PAM type: NRG; PAM sequence: CGG
agaggggttccggggggttc

SEQ ID NO: 13787 - DNA, 20 bp, Artificial Sequence
  Description of Artificial Sequence: Synthetic oligonucleotide
  Target: DMPK; (+) strand; PAM type: NRG; PAM sequence: GGG
gaggggttccggggggttcc

SEQ ID NO: 13788 - DNA, 20 bp, Artificial Sequence
  Description of Artificial Sequence: Synthetic oligonucleotide
  Target: DMPK; (+) strand; PAM type: NRG; PAM sequence: GAG
ggggttccggggggttccgg

SEQ ID NO: 13789 - DNA, 20 bp, Artificial Sequence
  Description of Artificial Sequence: Synthetic oligonucleotide
  Target: DMPK; (+) strand; PAM type: NRG; PAM sequence: GAG
ggttccggggggttccggga

SEQ ID NO: 13790 - DNA, 20 bp, Artificial Sequence
  Description of Artificial Sequence: Synthetic oligonucleotide
  Target: DMPK; (+) strand; PAM type: NRG; PAM sequence: TGG
tccggggggttccgggagag

SEQ ID NO: 13791 - DNA, 20 bp, Artificial Sequence
  Description of Artificial Sequence: Synthetic oligonucleotide
  Target: DMPK; (+) strand; PAM type: NRG; PAM sequence: GGG
ccggggggttccgggagagt

SEQ ID NO: 13792 - DNA, 20 bp, Artificial Sequence
  Description of Artificial Sequence: Synthetic oligonucleotide
  Target: DMPK; (+) strand; PAM type: NRG; PAM sequence: CAG
ggggttccgggagagtgggc

SEQ ID NO: 13793 - DNA, 20 bp, Artificial Sequence
  Description of Artificial Sequence: Synthetic oligonucleotide
  Target: DMPK; (+) strand; PAM type: NRG; PAM sequence: CAG
gttccgggagagtgggccag

SEQ ID NO: 13794 - DNA, 20 bp, Artificial Sequence
  Description of Artificial Sequence: Synthetic oligonucleotide
  Target: DMPK; (+) strand; PAM type: NRG; PAM sequence: AGG
ttccgggagagtgggccagc

SEQ ID NO: 13795 - DNA, 20 bp, Artificial Sequence
  Description of Artificial Sequence: Synthetic oligonucleotide
  Target: DMPK; (+) strand; PAM type: NRG; PAM sequence: GGG
tccgggagagtgggccagca

SEQ ID NO: 13796 - DNA, 20 bp, Artificial Sequence
  Description of Artificial Sequence: Synthetic oligonucleotide
  Target: DMPK; (+) strand; PAM type: NRG; PAM sequence: CAG
gtgggccagcagggacgaac

SEQ ID NO: 13797 - DNA, 20 bp, Artificial Sequence
  Description of Artificial Sequence: Synthetic oligonucleotide
  Target: DMPK; (+) strand; PAM type: NRG; PAM sequence: CAG
gccagcagggacgaaccagc

SEQ ID NO: 13798 - DNA, 20 bp, Artificial Sequence
  Description of Artificial Sequence: Synthetic oligonucleotide
  Target: DMPK; (+) strand; PAM type: NRG; PAM sequence: AGG
ccagcagggacgaaccagcc

SEQ ID NO: 13799 - DNA, 20 bp, Artificial Sequence
  Description of Artificial Sequence: Synthetic oligonucleotide
  Target: DMPK; (+) strand; PAM type: NRG; PAM sequence: GGG
cagcagggacgaaccagcca

SEQ ID NO: 13800 - DNA, 20 bp, Artificial Sequence
  Description of Artificial Sequence: Synthetic oligonucleotide
  Target: DMPK; (+) strand; PAM type: NRG; PAM sequence: GAG
gggacgaaccagccagggct

SEQ ID NO: 13801 - DNA, 20 bp, Artificial Sequence
  Description of Artificial Sequence: Synthetic oligonucleotide
  Target: DMPK; (+) strand; PAM type: NRG; PAM sequence: AGG
ggacgaaccagccagggctg

SEQ ID NO: 13802 - DNA, 20 bp, Artificial Sequence
  Description of Artificial Sequence: Synthetic oligonucleotide
  Target: DMPK; (+) strand; PAM type: NRG; PAM sequence: CGG
gaaccagccagggctgagga

SEQ ID NO: 13803 - DNA, 20 bp, Artificial Sequence
  Description of Artificial Sequence: Synthetic oligonucleotide
  Target: DMPK; (+) strand; PAM type: NRG; PAM sequence: GGG
aaccagccagggctgaggac

SEQ ID NO: 13804 - DNA, 20 bp, Artificial Sequence
  Description of Artificial Sequence: Synthetic oligonucleotide
  Target: DMPK; (+) strand; PAM type: NRG; PAM sequence: GGG
accagccagggctgaggacg

SEQ ID NO: 13805 - DNA, 20 bp, Artificial Sequence
  Description of Artificial Sequence: Synthetic oligonucleotide
  Target: DMPK; (+) strand; PAM type: NRG; PAM sequence: GGG
ccagccagggctgaggacgg

SEQ ID NO: 13806 - DNA, 20 bp, Artificial Sequence
  Description of Artificial Sequence: Synthetic oligonucleotide
  Target: DMPK; (+) strand; PAM type: NRG; PAM sequence: GAG
agccagggctgaggacgggg

SEQ ID NO: 13807 - DNA, 20 bp, Artificial Sequence
  Description of Artificial Sequence: Synthetic oligonucleotide
  Target: DMPK; (+) strand; PAM type: NRG; PAM sequence: AGG
gccagggctgaggacggggg

SEQ ID NO: 13808 - DNA, 20 bp, Artificial Sequence
  Description of Artificial Sequence: Synthetic oligonucleotide
  Target: DMPK; (+) strand; PAM type: NRG; PAM sequence: GGG
ccagggctgaggacggggga

SEQ ID NO: 13809 - DNA, 20 bp, Artificial Sequence
  Description of Artificial Sequence: Synthetic oligonucleotide
  Target: DMPK; (+) strand; PAM type: NRG; PAM sequence: GAG
agggctgaggacgggggagg

SEQ ID NO: 13810 - DNA, 20 bp, Artificial Sequence
  Description of Artificial Sequence: Synthetic oligonucleotide
  Target: DMPK; (+) strand; PAM type: NRG; PAM sequence: AGG
gggctgaggacgggggaggg

SEQ ID NO: 13811 - DNA, 20 bp, Artificial Sequence
  Description of Artificial Sequence: Synthetic oligonucleotide
  Target: DMPK; (+) strand; PAM type: NRG; PAM sequence: GAG
gctgaggacgggggagggag

SEQ ID NO: 13812 - DNA, 20 bp, Artificial Sequence
  Description of Artificial Sequence: Synthetic oligonucleotide
  Target: DMPK; (+) strand; PAM type: NRG; PAM sequence: GAG
tgaggacgggggagggagga

SEQ ID NO: 13813 - DNA, 20 bp, Artificial Sequence
  Description of Artificial Sequence: Synthetic oligonucleotide
  Target: DMPK; (+) strand; PAM type: NRG; PAM sequence: GAG
aggacgggggagggaggaga

SEQ ID NO: 13814 - DNA, 20 bp, Artificial Sequence
  Description of Artificial Sequence: Synthetic oligonucleotide
  Target: DMPK; (+) strand; PAM type: NRG; PAM sequence: AAG
gggggagggaggagagagcc

SEQ ID NO: 13815 - DNA, 20 bp, Artificial Sequence
  Description of Artificial Sequence: Synthetic oligonucleotide
  Target: DMPK; (+) strand; PAM type: NRG; PAM sequence: GAG
gaggagagagccaagacatt

SEQ ID NO: 13816 - DNA, 20 bp, Artificial Sequence
  Description of Artificial Sequence: Synthetic oligonucleotide
  Target: DMPK; (+) strand; PAM type: NRG; PAM sequence: AAG
ccaagacattgagccctttt

SEQ ID NO: 13817 - DNA, 20 bp, Artificial Sequence
  Description of Artificial Sequence: Synthetic oligonucleotide
  Target: DMPK; (+) strand; PAM type: NRG; PAM sequence: AGG
caagacattgagccctttta

SEQ ID NO: 13818 - DNA, 20 bp, Artificial Sequence
  Description of Artificial Sequence: Synthetic oligonucleotide
  Target: DMPK; (+) strand; PAM type: NRG; PAM sequence: CAG
gacattgagcccttttaagg

SEQ ID NO: 13819 - DNA, 20 bp, Artificial Sequence
  Description of Artificial Sequence: Synthetic oligonucleotide
  Target: DMPK; (+) strand; PAM type: NRG; PAM sequence: CAG
attgagcccttttaaggcag

SEQ ID NO: 13820 - DNA, 20 bp, Artificial Sequence
  Description of Artificial Sequence: Synthetic oligonucleotide
  Target: DMPK; (+) strand; PAM type: NRG; PAM sequence: AGG
ttgagcccttttaaggcagc

SEQ ID NO: 13821 - DNA, 20 bp, Artificial Sequence
  Description of Artificial Sequence: Synthetic oligonucleotide
  Target: DMPK; (+) strand; PAM type: NRG; PAM sequence: TGG
ttttaaggcagcaggaaccc

SEQ ID NO: 13822 - DNA, 20 bp, Artificial Sequence
  Description of Artificial Sequence: Synthetic oligonucleotide
  Target: DMPK; (+) strand; PAM type: NRG; PAM sequence: CAG
cctggccccctcccccgccc

SEQ ID NO: 13823 - DNA, 20 bp, Artificial Sequence
  Description of Artificial Sequence: Synthetic oligonucleotide
  Target: DMPK; (+) strand; PAM type: NRG; PAM sequence: AGG
ctggccccctcccccgcccc

SEQ ID NO: 13824 - DNA, 20 bp, Artificial Sequence
  Description of Artificial Sequence: Synthetic oligonucleotide
  Target: DMPK; (+) strand; PAM type: NRG; PAM sequence: TGG
cccctcccccgccccaggcc

SEQ ID NO: 13825 - DNA, 20 bp, Artificial Sequence
  Description of Artificial Sequence: Synthetic oligonucleotide
  Target: DMPK; (+) strand; PAM type: NRG; PAM sequence: CAG
ctcccccgccccaggcctgg

SEQ ID NO: 13826 - DNA, 20 bp, Artificial Sequence
  Description of Artificial Sequence: Synthetic oligonucleotide
  Target: DMPK; (+) strand; PAM type: NRG; PAM sequence: AGG
tcccccgccccaggcctggc

SEQ ID NO: 13827 - DNA, 20 bp, Artificial Sequence
  Description of Artificial Sequence: Synthetic oligonucleotide
  Target: DMPK; (+) strand; PAM type: NRG; PAM sequence: GGG
cccccgccccaggcctggca

SEQ ID NO: 13828 - DNA, 20 bp, Artificial Sequence
  Description of Artificial Sequence: Synthetic oligonucleotide
  Target: DMPK; (+) strand; PAM type: NRG; PAM sequence: GGG
ccccgccccaggcctggcag

SEQ ID NO: 13829 - DNA, 20 bp, Artificial Sequence
  Description of Artificial Sequence: Synthetic oligonucleotide
  Target: DMPK; (+) strand; PAM type: NRG; PAM sequence: GAG
ccgccccaggcctggcaggg

SEQ ID NO: 13830 - DNA, 20 bp, Artificial Sequence
  Description of Artificial Sequence: Synthetic oligonucleotide
  Target: DMPK; (+) strand; PAM type: NRG; PAM sequence: AGG
cgccccaggcctggcagggg

SEQ ID NO: 13831 - DNA, 20 bp, Artificial Sequence
  Description of Artificial Sequence: Synthetic oligonucleotide
  Target: DMPK; (+) strand; PAM type: NRG; PAM sequence: GGG
gccccaggcctggcagggga

SEQ ID NO: 13832 - DNA, 20 bp, Artificial Sequence
  Description of Artificial Sequence: Synthetic oligonucleotide
  Target: DMPK; (+) strand; PAM type: NRG; PAM sequence: GGG
ccccaggcctggcaggggag

SEQ ID NO: 13833 - DNA, 20 bp, Artificial Sequence
  Description of Artificial Sequence: Synthetic oligonucleotide
  Target: DMPK; (+) strand; PAM type: NRG; PAM sequence: GAG
cctggcaggggaggggccgc

SEQ ID NO: 13834 - DNA, 20 bp, Artificial Sequence
  Description of Artificial Sequence: Synthetic oligonucleotide
  Target: DMPK; (+) strand; PAM type: NRG; PAM sequence: CAG
aggggaggggccgcgagatg

SEQ ID NO: 13835 - DNA, 20 bp, Artificial Sequence
  Description of Artificial Sequence: Synthetic oligonucleotide
  Target: DMPK; (+) strand; PAM type: NRG; PAM sequence: CGG
aggggccgcgagatgcagct

SEQ ID NO: 13836 - DNA, 20 bp, Artificial Sequence
  Description of Artificial Sequence: Synthetic oligonucleotide
  Target: DMPK; (+) strand; PAM type: NRG; PAM sequence: GGG
ggggccgcgagatgcagctc

SEQ ID NO: 13837 - DNA, 20 bp, Artificial Sequence
  Description of Artificial Sequence: Synthetic oligonucleotide
  Target: DMPK; (+) strand; PAM type: NRG; PAM sequence: AAG
agatgcagctcgggccacaa

SEQ ID NO: 13838 - DNA, 20 bp, Artificial Sequence
  Description of Artificial Sequence: Synthetic oligonucleotide
  Target: DMPK; (+) strand; PAM type: NRG; PAM sequence: AGG
gatgcagctcgggccacaaa

SEQ ID NO: 13839 - DNA, 20 bp, Artificial Sequence
  Description of Artificial Sequence: Synthetic oligonucleotide
  Target: DMPK; (+) strand; PAM type: NRG; PAM sequence: GAG
tgcagctcgggccacaaaag

SEQ ID NO: 13840 - DNA, 20 bp, Artificial Sequence
  Description of Artificial Sequence: Synthetic oligonucleotide
  Target: DMPK; (+) strand; PAM type: NRG; PAM sequence: CGG
cacaaaaggagtgctcctcc

SEQ ID NO: 13841 - DNA, 20 bp, Artificial Sequence
  Description of Artificial Sequence: Synthetic oligonucleotide
  Target: DMPK; (+) strand; PAM type: NRG; PAM sequence: GGG
acaaaaggagtgctcctccc

SEQ ID NO: 13842 - DNA, 20 bp, Artificial Sequence
  Description of Artificial Sequence: Synthetic oligonucleotide
  Target: DMPK; (+) strand; PAM type: NRG; PAM sequence: GAG
aaaaggagtgctcctcccgg

SEQ ID NO: 13843 - DNA, 20 bp, Artificial Sequence
  Description of Artificial Sequence: Synthetic oligonucleotide
  Target: DMPK; (+) strand; PAM type: NRG; PAM sequence: CAG
agtgctcctcccgggagcgc

SEQ ID NO: 13844 - DNA, 20 bp, Artificial Sequence
  Description of Artificial Sequence: Synthetic oligonucleotide
  Target: DMPK; (+) strand; PAM type: NRG; PAM sequence: CGG
cgccagacccctaccccacc

SEQ ID NO: 13845 - DNA, 20 bp, Artificial Sequence
  Description of Artificial Sequence: Synthetic oligonucleotide
  Target: DMPK; (+) strand; PAM type: NRG; PAM sequence: CAG
acccctaccccacccggtct

SEQ ID NO: 13846 - DNA, 20 bp, Artificial Sequence
  Description of Artificial Sequence: Synthetic oligonucleotide
  Target: DMPK; (+) strand; PAM type: NRG; PAM sequence: AAG
cccaacttcatcctctacta

SEQ ID NO: 13847 - DNA, 20 bp, Artificial Sequence
  Description of Artificial Sequence: Synthetic oligonucleotide
  Target: DMPK; (+) strand; PAM type: NRG; PAM sequence: AGG
ccaacttcatcctctactaa

SEQ ID NO: 13848 - DNA, 20 bp, Artificial Sequence
  Description of Artificial Sequence: Synthetic oligonucleotide
  Target: DMPK; (+) strand; PAM type: NRG; PAM sequence: GGG
caacttcatcctctactaaa

SEQ ID NO: 13849 - DNA, 20 bp, Artificial Sequence
  Description of Artificial Sequence: Synthetic oligonucleotide
  Target: DMPK; (+) strand; PAM type: NRG; PAM sequence: GAG
acttcatcctctactaaagg

SEQ ID NO: 13850 - DNA, 20 bp, Artificial Sequence
  Description of Artificial Sequence: Synthetic oligonucleotide
  Target: DMPK; (+) strand; PAM type: NRG; PAM sequence: AGG
cttcatcctctactaaaggg

SEQ ID NO: 13851 - DNA, 20 bp, Artificial Sequence
  Description of Artificial Sequence: Synthetic oligonucleotide
  Target: DMPK; (+) strand; PAM type: NRG; PAM sequence: CAG
atcctctactaaagggaggc

SEQ ID NO: 13852 - DNA, 20 bp, Artificial Sequence
  Description of Artificial Sequence: Synthetic oligonucleotide
  Target: DMPK; (+) strand; PAM type: NRG; PAM sequence: AGG
tcctctactaaagggaggcc

SEQ ID NO: 13853 - DNA, 20 bp, Artificial Sequence
  Description of Artificial Sequence: Synthetic oligonucleotide
  Target: DMPK; (+) strand; PAM type: NRG; PAM sequence: GAG
ctctactaaagggaggccag

SEQ ID NO: 13854 - DNA, 20 bp, Artificial Sequence
  Description of Artificial Sequence: Synthetic oligonucleotide
  Target: DMPK; (+) strand; PAM type: NRG; PAM sequence: GAG
ctactaaagggaggccagga

SEQ ID NO: 13855 - DNA, 20 bp, Artificial Sequence
  Description of Artificial Sequence: Synthetic oligonucleotide
  Target: DMPK; (+) strand; PAM type: NRG; PAM sequence: TAG
agggaggccaggagagtcat

SEQ ID NO: 13856 - DNA, 20 bp, Artificial Sequence
  Description of Artificial Sequence: Synthetic oligonucleotide
  Target: DMPK; (+) strand; PAM type: NRG; PAM sequence: AGG
gggaggccaggagagtcatt

SEQ ID NO: 13857 - DNA, 20 bp, Artificial Sequence
  Description of Artificial Sequence: Synthetic oligonucleotide
  Target: DMPK; (+) strand; PAM type: NRG; PAM sequence: GGG
ggaggccaggagagtcatta

SEQ ID NO: 13858 - DNA, 20 bp, Artificial Sequence
  Description of Artificial Sequence: Synthetic oligonucleotide
  Target: DMPK; (+) strand; PAM type: NRG; PAM sequence: GGG
gaggccaggagagtcattag

SEQ ID NO: 13859 - DNA, 20 bp, Artificial Sequence
  Description of Artificial Sequence: Synthetic oligonucleotide
  Target: DMPK; (+) strand; PAM type: NRG; PAM sequence: TGG
aggagagtcattaggggctg

SEQ ID NO: 13860 - DNA, 20 bp, Artificial Sequence
  Description of Artificial Sequence: Synthetic oligonucleotide
  Target: DMPK; (+) strand; PAM type: NRG; PAM sequence: GGG
ggagagtcattaggggctgt

SEQ ID NO: 13861 - DNA, 20 bp, Artificial Sequence
  Description of Artificial Sequence: Synthetic oligonucleotide
  Target: DMPK; (+) strand; PAM type: NRG; PAM sequence: GAG
agagtcattaggggctgtgg

SEQ ID NO: 13862 - DNA, 20 bp, Artificial Sequence
  Description of Artificial Sequence: Synthetic oligonucleotide
  Target: DMPK; (+) strand; PAM type: NRG; PAM sequence: AGG
gagtcattaggggctgtggg

SEQ ID NO: 13863 - DNA, 20 bp, Artificial Sequence
  Description of Artificial Sequence: Synthetic oligonucleotide
  Target: DMPK; (+) strand; PAM type: NRG; PAM sequence: TGG
cattaggggctgtgggaggt

SEQ ID NO: 13864 - DNA, 20 bp, Artificial Sequence
  Description of Artificial Sequence: Synthetic oligonucleotide
  Target: DMPK; (+) strand; PAM type: NRG; PAM sequence: GGG
attaggggctgtgggaggtt

SEQ ID NO: 13865 - DNA, 20 bp, Artificial Sequence
  Description of Artificial Sequence: Synthetic oligonucleotide
  Target: DMPK; (+) strand; PAM type: NRG; PAM sequence: GAG
taggggctgtgggaggttgg

SEQ ID NO: 13866 - DNA, 20 bp, Artificial Sequence
  Description of Artificial Sequence: Synthetic oligonucleotide
  Target: DMPK; (+) strand; PAM type: NRG; PAM sequence: AAG
gggctgtgggaggttgggag

SEQ ID NO: 13867 - DNA, 20 bp, Artificial Sequence
  Description of Artificial Sequence: Synthetic oligonucleotide
  Target: DMPK; (+) strand; PAM type: NRG; PAM sequence: AGG
ggctgtgggaggttgggaga

SEQ ID NO: 13868 - DNA, 20 bp, Artificial Sequence
  Description of Artificial Sequence: Synthetic oligonucleotide
  Target: DMPK; (+) strand; PAM type: NRG; PAM sequence: CAG
aggttgggagaaggtttttc

SEQ ID NO: 13869 - DNA, 20 bp, Artificial Sequence
  Description of Artificial Sequence: Synthetic oligonucleotide
  Target: DMPK; (+) strand; PAM type: NRG; PAM sequence: GAG
gttgggagaaggtttttcca

SEQ ID NO: 13870 - DNA, 20 bp, Artificial Sequence
  Description of Artificial Sequence: Synthetic oligonucleotide
  Target: DMPK; (+) strand; PAM type: NRG; PAM sequence: AGG
ttgggagaaggtttttccag

SEQ ID NO: 13871 - DNA, 20 bp, Artificial Sequence
  Description of Artificial Sequence: Synthetic oligonucleotide
  Target: DMPK; (+) strand; PAM type: NRG; PAM sequence: TGG
aggtttttccagaggctgaa

SEQ ID NO: 13872 - DNA, 20 bp, Artificial Sequence
  Description of Artificial Sequence: Synthetic oligonucleotide
  Target: DMPK; (+) strand; PAM type: NRG; PAM sequence: TGG
tttccagaggctgaatggcc

SEQ ID NO: 13873 - DNA, 20 bp, Artificial Sequence
  Description of Artificial Sequence: Synthetic oligonucleotide
  Target: DMPK; (+) strand; PAM type: NRG; PAM sequence: TGG
ctgaatggcctggcccttct

SEQ ID NO: 13874 - DNA, 20 bp, Artificial Sequence
  Description of Artificial Sequence: Synthetic oligonucleotide
  Target: DMPK; (+) strand; PAM type: NRG; PAM sequence: TGG
ccaccttcccatctgtgaaa

SEQ ID NO: 13875 - DNA, 20 bp, Artificial Sequence
  Description of Artificial Sequence: Synthetic oligonucleotide
  Target: DMPK; (+) strand; PAM type: NRG; PAM sequence: GGG
caccttcccatctgtgaaat

SEQ ID NO: 13876 - DNA, 20 bp, Artificial Sequence
  Description of Artificial Sequence: Synthetic oligonucleotide
  Target: DMPK; (+) strand; PAM type: NRG; PAM sequence: GAG
ccttcccatctgtgaaatgg

SEQ ID NO: 13877 - DNA, 20 bp, Artificial Sequence
  Description of Artificial Sequence: Synthetic oligonucleotide
  Target: DMPK; (+) strand; PAM type: NRG; PAM sequence: AGG
cttcccatctgtgaaatggg

SEQ ID NO: 13878 - DNA, 20 bp, Artificial Sequence
  Description of Artificial Sequence: Synthetic oligonucleotide
  Target: DMPK; (+) strand; PAM type: NRG; PAM sequence: GAG
tcccatctgtgaaatgggag

SEQ ID NO: 13879 - DNA, 20 bp, Artificial Sequence
  Description of Artificial Sequence: Synthetic oligonucleotide
  Target: DMPK; (+) strand; PAM type: NRG; PAM sequence: AGG
cccatctgtgaaatgggagg

SEQ ID NO: 13880 - DNA, 20 bp, Artificial Sequence
  Description of Artificial Sequence: Synthetic oligonucleotide
  Target: DMPK; (+) strand; PAM type: NRG; PAM sequence: GAG
catctgtgaaatgggaggag

SEQ ID NO: 13881 - DNA, 20 bp, Artificial Sequence
  Description of Artificial Sequence: Synthetic oligonucleotide
  Target: DMPK; (+) strand; PAM type: NRG; PAM sequence: AGG
atctgtgaaatgggaggagg

SEQ ID NO: 13882 - DNA, 20 bp, Artificial Sequence
  Description of Artificial Sequence: Synthetic oligonucleotide
  Target: DMPK; (+) strand; PAM type: NRG; PAM sequence: GGG
tctgtgaaatgggaggagga

SEQ ID NO: 13883 - DNA, 20 bp, Artificial Sequence
  Description of Artificial Sequence: Synthetic oligonucleotide
  Target: DMPK; (+) strand; PAM type: NRG; PAM sequence: AAG
tgaaatgggaggaggaggga

SEQ ID NO: 13884 - DNA, 20 bp, Artificial Sequence
  Description of Artificial Sequence: Synthetic oligonucleotide
  Target: DMPK; (+) strand; PAM type: NRG; PAM sequence: AGG
gaaatgggaggaggagggaa

SEQ ID NO: 13885 - DNA, 20 bp, Artificial Sequence
  Description of Artificial Sequence: Synthetic oligonucleotide
  Target: DMPK; (+) strand; PAM type: NRG; PAM sequence: CAG
ggaggaggagggaaaggaac

SEQ ID NO: 13886 - DNA, 20 bp, Artificial Sequence
  Description of Artificial Sequence: Synthetic oligonucleotide
  Target: DMPK; (+) strand; PAM type: NRG; PAM sequence: AGG
gaggaggagggaaaggaacc

SEQ ID NO: 13887 - DNA, 20 bp, Artificial Sequence
  Description of Artificial Sequence: Synthetic oligonucleotide
  Target: DMPK; (+) strand; PAM type: NRG; PAM sequence: TGG
ggagggaaaggaaccaggcc

SEQ ID NO: 13888 - DNA, 20 bp, Artificial Sequence
  Description of Artificial Sequence: Synthetic oligonucleotide
  Target: DMPK; (+) strand; PAM type: NRG; PAM sequence: GGG
gagggaaaggaaccaggcct

SEQ ID NO: 13889 - DNA, 20 bp, Artificial Sequence
  Description of Artificial Sequence: Synthetic oligonucleotide
  Target: DMPK; (+) strand; PAM type: NRG; PAM sequence: CAG
gaaaggaaccaggcctgggt

SEQ ID NO: 13890 - DNA, 20 bp, Artificial Sequence
  Description of Artificial Sequence: Synthetic oligonucleotide
  Target: DMPK; (+) strand; PAM type: NRG; PAM sequence: AAG
ggaaccaggcctgggtcaga

SEQ ID NO: 13891 - DNA, 20 bp, Artificial Sequence
  Description of Artificial Sequence: Synthetic oligonucleotide
  Target: DMPK; (+) strand; PAM type: NRG; PAM sequence: GAG
aaccaggcctgggtcagaaa

SEQ ID NO: 13892 - DNA, 20 bp, Artificial Sequence
  Description of Artificial Sequence: Synthetic oligonucleotide
  Target: DMPK; (+) strand; PAM type: NRG; PAM sequence: TGG
aggcctgggtcagaaagaga

SEQ ID NO: 13893 - DNA, 20 bp, Artificial Sequence
  Description of Artificial Sequence: Synthetic oligonucleotide
  Target: DMPK; (+) strand; PAM type: NRG; PAM sequence: AAG
ggtcagaaagagatggacac

SEQ ID NO: 13894 - DNA, 20 bp, Artificial Sequence
  Description of Artificial Sequence: Synthetic oligonucleotide
  Target: DMPK; (+) strand; PAM type: NRG; PAM sequence: GAG
tcagaaagagatggacacaa

SEQ ID NO: 13895 - DNA, 20 bp, Artificial Sequence
  Description of Artificial Sequence: Synthetic oligonucleotide
  Target: DMPK; (+) strand; PAM type: NRG; PAM sequence: AGG
cagaaagagatggacacaag

SEQ ID NO: 13896 - DNA, 20 bp, Artificial Sequence
  Description of Artificial Sequence: Synthetic oligonucleotide
  Target: DMPK; (+) strand; PAM type: NRG; PAM sequence: AAG
aaagagatggacacaagagg

SEQ ID NO: 13897 - DNA, 20 bp, Artificial Sequence
  Description of Artificial Sequence: Synthetic oligonucleotide
  Target: DMPK; (+) strand; PAM type: NRG; PAM sequence: CAG
gagatggacacaagaggaag

SEQ ID NO: 13898 - DNA, 20 bp, Artificial Sequence
  Description of Artificial Sequence: Synthetic oligonucleotide
  Target: DMPK; (+) strand; PAM type: NRG; PAM sequence: AGG
agatggacacaagaggaagc

SEQ ID NO: 13899 - DNA, 20 bp, Artificial Sequence
  Description of Artificial Sequence: Synthetic oligonucleotide
  Target: DMPK; (+) strand; PAM type: NRG; PAM sequence: GGG
gatggacacaagaggaagca

SEQ ID NO: 13900 - DNA, 20 bp, Artificial Sequence
  Description of Artificial Sequence: Synthetic oligonucleotide
  Target: DMPK; (+) strand; PAM type: NRG; PAM sequence: GGG
atggacacaagaggaagcag

SEQ ID NO: 13901 - DNA, 20 bp, Artificial Sequence
  Description of Artificial Sequence: Synthetic oligonucleotide
  Target: DMPK; (+) strand; PAM type: NRG; PAM sequence: AAG
gacacaagaggaagcagggg

SEQ ID NO: 13902 - DNA, 20 bp, Artificial Sequence
  Description of Artificial Sequence: Synthetic oligonucleotide
  Target: DMPK; (+) strand; PAM type: NRG; PAM sequence: AGG
acacaagaggaagcagggga

SEQ ID NO: 13903 - DNA, 20 bp, Artificial Sequence
  Description of Artificial Sequence: Synthetic oligonucleotide
  Target: DMPK; (+) strand; PAM type: NRG; PAM sequence: CGG
caagaggaagcaggggaagg

SEQ ID NO: 13904 - DNA, 20 bp, Artificial Sequence
  Description of Artificial Sequence: Synthetic oligonucleotide
  Target: DMPK; (+) strand; PAM type: NRG; PAM sequence: GAG
agaggaagcaggggaaggcg

SEQ ID NO: 13905 - DNA, 20 bp, Artificial Sequence
  Description of Artificial Sequence: Synthetic oligonucleotide
  Target: DMPK; (+) strand; PAM type: NRG; PAM sequence: CAG
agcaggggaaggcggagaaa

SEQ ID NO: 13906 - DNA, 20 bp, Artificial Sequence
  Description of Artificial Sequence: Synthetic oligonucleotide
  Target: DMPK; (+) strand; PAM type: NRG; PAM sequence: AGG
gcaggggaaggcggagaaac

SEQ ID NO: 13907 - DNA, 20 bp, Artificial Sequence
  Description of Artificial Sequence: Synthetic oligonucleotide
  Target: DMPK; (+) strand; PAM type: NRG; PAM sequence: AAG
aaggcggagaaacaggaaac

SEQ ID NO: 13908 - DNA, 20 bp, Artificial Sequence
  Description of Artificial Sequence: Synthetic oligonucleotide
  Target: DMPK; (+) strand; PAM type: NRG; PAM sequence: CAG
caggaaacaagtgtcacaca

SEQ ID NO: 13909 - DNA, 20 bp, Artificial Sequence
  Description of Artificial Sequence: Synthetic oligonucleotide
  Target: DMPK; (+) strand; PAM type: NRG; PAM sequence: CAG
cacacacagtttgttacaca

SEQ ID NO: 13910 - DNA, 20 bp, Artificial Sequence
  Description of Artificial Sequence: Synthetic oligonucleotide
  Target: DMPK; (+) strand; PAM type: NRG; PAM sequence: AGG
acacacagtttgttacacac

SEQ ID NO: 13911 - DNA, 20 bp, Artificial Sequence
  Description of Artificial Sequence: Synthetic oligonucleotide
  Target: DMPK; (+) strand; PAM type: NRG; PAM sequence: CAG
acaggccaaaaaccaaacac

SEQ ID NO: 13912 - DNA, 20 bp, Artificial Sequence
  Description of Artificial Sequence: Synthetic oligonucleotide
  Target: DMPK; (+) strand; PAM type: NRG; PAM sequence: GAG
aaaaccaaacaccagtcact

SEQ ID NO: 13913 - DNA, 20 bp, Artificial Sequence
  Description of Artificial Sequence: Synthetic oligonucleotide
  Target: DMPK; (+) strand; PAM type: NRG; PAM sequence: AGG
aaaccaaacaccagtcactg

SEQ ID NO: 13914 - DNA, 20 bp, Artificial Sequence
  Description of Artificial Sequence: Synthetic oligonucleotide
  Target: DMPK; (+) strand; PAM type: NRG; PAM sequence: GGG
aaccaaacaccagtcactga

SEQ ID NO: 13915 - DNA, 20 bp, Artificial Sequence
  Description of Artificial Sequence: Synthetic oligonucleotide
  Target: DMPK; (+) strand; PAM type: NRG; PAM sequence: CAG
aaacaccagtcactgagggc

SEQ ID NO: 13916 - DNA, 20 bp, Artificial Sequence
  Description of Artificial Sequence: Synthetic oligonucleotide
  Target: DMPK; (+) strand; PAM type: NRG; PAM sequence: GAG
tcactgagggccagacatat

SEQ ID NO: 13917 - DNA, 20 bp, Artificial Sequence
  Description of Artificial Sequence: Synthetic oligonucleotide
  Target: DMPK; (+) strand; PAM type: NRG; PAM sequence: AGG
cactgagggccagacatatg

SEQ ID NO: 13918 - DNA, 20 bp, Artificial Sequence
  Description of Artificial Sequence: Synthetic oligonucleotide
  Target: DMPK; (+) strand; PAM type: NRG; PAM sequence: GGG
actgagggccagacatatga

SEQ ID NO: 13919 - DNA, 20 bp, Artificial Sequence
  Description of Artificial Sequence: Synthetic oligonucleotide
  Target: DMPK; (+) strand; PAM type: NRG; PAM sequence: CAG
agggccagacatatgagggc

SEQ ID NO: 13920 - DNA, 20 bp, Artificial Sequence
  Description of Artificial Sequence: Synthetic oligonucleotide
  Target: DMPK; (+) strand; PAM type: NRG; PAM sequence: GAG
ggccagacatatgagggcca

SEQ ID NO: 13921 - DNA, 20 bp, Artificial Sequence
  Description of Artificial Sequence: Synthetic oligonucleotide
  Target: DMPK; (+) strand; PAM type: NRG; PAM sequence: AGG
gccagacatatgagggccag

SEQ ID NO: 13922 - DNA, 20 bp, Artificial Sequence
  Description of Artificial Sequence: Synthetic oligonucleotide
  Target: DMPK; (+) strand; PAM type: NRG; PAM sequence: GGG
ccagacatatgagggccaga

SEQ ID NO: 13923 - DNA, 20 bp, Artificial Sequence
  Description of Artificial Sequence: Synthetic oligonucleotide
  Target: DMPK; (+) strand; PAM type: NRG; PAM sequence: GGG
cagacatatgagggccagag

SEQ ID NO: 13924 - DNA, 20 bp, Artificial Sequence
  Description of Artificial Sequence: Synthetic oligonucleotide
  Target: DMPK; (+) strand; PAM type: NRG; PAM sequence: CAG
acatatgagggccagagggg

SEQ ID NO: 13925 - DNA, 20 bp, Artificial Sequence
  Description of Artificial Sequence: Synthetic oligonucleotide
  Target: DMPK; (+) strand; PAM type: NRG; PAM sequence: AGG
catatgagggccagaggggc

SEQ ID NO: 13926 - DNA, 20 bp, Artificial Sequence
  Description of Artificial Sequence: Synthetic oligonucleotide
  Target: DMPK; (+) strand; PAM type: NRG; PAM sequence: GGG
atatgagggccagaggggca

SEQ ID NO: 13927 - DNA, 20 bp, Artificial Sequence
  Description of Artificial Sequence: Synthetic oligonucleotide
  Target: DMPK; (+) strand; PAM type: NRG; PAM sequence: TGG
gggccagaggggcagggtgc

SEQ ID NO: 13928 - DNA, 20 bp, Artificial Sequence
  Description of Artificial Sequence: Synthetic oligonucleotide
  Target: DMPK; (+) strand; PAM type: NRG; PAM sequence: GGG
ggccagaggggcagggtgct

SEQ ID NO: 13929 - DNA, 20 bp, Artificial Sequence
  Description of Artificial Sequence: Synthetic oligonucleotide
  Target: DMPK; (+) strand; PAM type: NRG; PAM sequence: AAG
gggcagggtgctgggaatga

SEQ ID NO: 13930 - DNA, 20 bp, Artificial Sequence
  Description of Artificial Sequence: Synthetic oligonucleotide
  Target: DMPK; (+) strand; PAM type: NRG; PAM sequence: CAG
gtgctgggaatgaaagaaac

SEQ ID NO: 13931 - DNA, 20 bp, Artificial Sequence
  Description of Artificial Sequence: Synthetic oligonucleotide
  Target: DMPK; (+) strand; PAM type: NRG; PAM sequence: CAG
gaatgaaagaaaccagtgac

SEQ ID NO: 13932 - DNA, 20 bp, Artificial Sequence
  Description of Artificial Sequence: Synthetic oligonucleotide
  Target: DMPK; (+) strand; PAM type: NRG; PAM sequence: GAG
gaaagaaaccagtgaccagt

SEQ ID NO: 13933 - DNA, 20 bp, Artificial Sequence
  Description of Artificial Sequence: Synthetic oligonucleotide
  Target: DMPK; (+) strand; PAM type: NRG; PAM sequence: GAG
aaccagtgaccagtgagccc

SEQ ID NO: 13934 - DNA, 20 bp, Artificial Sequence
  Description of Artificial Sequence: Synthetic oligonucleotide
  Target: DMPK; (+) strand; PAM type: NRG; PAM sequence: TGG
tgaccagtgagcccgagtcc

SEQ ID NO: 13935 - DNA, 20 bp, Artificial Sequence
  Description of Artificial Sequence: Synthetic oligonucleotide
  Target: DMPK; (+) strand; PAM type: NRG; PAM sequence: GGG
gaccagtgagcccgagtcct

SEQ ID NO: 13936 - DNA, 20 bp, Artificial Sequence
  Description of Artificial Sequence: Synthetic oligonucleotide
  Target: DMPK; (+) strand; PAM type: NRG; PAM sequence: TGG
gtgagcccgagtcctgggct

SEQ ID NO: 13937 - DNA, 20 bp, Artificial Sequence
  Description of Artificial Sequence: Synthetic oligonucleotide
  Target: DMPK; (+) strand; PAM type: NRG; PAM sequence: GGG
tgagcccgagtcctgggctt

SEQ ID NO: 13938 - DNA, 20 bp, Artificial Sequence
  Description of Artificial Sequence: Synthetic oligonucleotide
  Target: DMPK; (+) strand; PAM type: NRG; PAM sequence: GGG
gagcccgagtcctgggcttg

SEQ ID NO: 13939 - DNA, 20 bp, Artificial Sequence
  Description of Artificial Sequence: Synthetic oligonucleotide
  Target: DMPK; (+) strand; PAM type: NRG; PAM sequence: GAG
gcccgagtcctgggcttggg

SEQ ID NO: 13940 - DNA, 20 bp, Artificial Sequence
  Description of Artificial Sequence: Synthetic oligonucleotide
  Target: DMPK; (+) strand; PAM type: NRG; PAM sequence: AGG
cccgagtcctgggcttgggg

SEQ ID NO: 13941 - DNA, 20 bp, Artificial Sequence
  Description of Artificial Sequence: Synthetic oligonucleotide
  Target: DMPK; (+) strand; PAM type: NRG; PAM sequence: GAG
cgagtcctgggcttggggag

SEQ ID NO: 13942 - DNA, 20 bp, Artificial Sequence
  Description of Artificial Sequence: Synthetic oligonucleotide
  Target: DMPK; (+) strand; PAM type: NRG; PAM sequence: AGG
gagtcctgggcttggggagg

SEQ ID NO: 13943 - DNA, 20 bp, Artificial Sequence
  Description of Artificial Sequence: Synthetic oligonucleotide
  Target: DMPK; (+) strand; PAM type: NRG; PAM sequence: TGG
tcctgggcttggggaggagg

SEQ ID NO: 13944 - DNA, 20 bp, Artificial Sequence
  Description of Artificial Sequence: Synthetic oligonucleotide
  Target: DMPK; (+) strand; PAM type: NRG; PAM sequence: GGG
cctgggcttggggaggaggt

SEQ ID NO: 13945 - DNA, 20 bp, Artificial Sequence
  Description of Artificial Sequence: Synthetic oligonucleotide
  Target: DMPK; (+) strand; PAM type: NRG; PAM sequence: CAG
gggcttggggaggaggtggg

SEQ ID NO: 13946 - DNA, 20 bp, Artificial Sequence
  Description of Artificial Sequence: Synthetic oligonucleotide
  Target: DMPK; (+) strand; PAM type: NRG; PAM sequence: AAG
tggggaggaggtgggcagac

SEQ ID NO: 13947 - DNA, 20 bp, Artificial Sequence
  Description of Artificial Sequence: Synthetic oligonucleotide
  Target: DMPK; (+) strand; PAM type: NRG; PAM sequence: AGG
ggggaggaggtgggcagaca

SEQ ID NO: 13948 - DNA, 20 bp, Artificial Sequence
  Description of Artificial Sequence: Synthetic oligonucleotide
  Target: DMPK; (+) strand; PAM type: NRG; PAM sequence: CAG
gaggaggtgggcagacaagg

SEQ ID NO: 13949 - DNA, 20 bp, Artificial Sequence
  Description of Artificial Sequence: Synthetic oligonucleotide
  Target: DMPK; (+) strand; PAM type: NRG; PAM sequence: TGG
aggtgggcagacaaggcagc

SEQ ID NO: 13950 - DNA, 20 bp, Artificial Sequence
  Description of Artificial Sequence: Synthetic oligonucleotide
  Target: DMPK; (+) strand; PAM type: NRG; PAM sequence: CAG
tgggcagacaaggcagctgg

SEQ ID NO: 13951 - DNA, 20 bp, Artificial Sequence
  Description of Artificial Sequence: Synthetic oligonucleotide
  Target: DMPK; (+) strand; PAM type: NRG; PAM sequence: AAG
gcagacaaggcagctggcag

SEQ ID NO: 13952 - DNA, 20 bp, Artificial Sequence
  Description of Artificial Sequence: Synthetic oligonucleotide
  Target: DMPK; (+) strand; PAM type: NRG; PAM sequence: CGG
gacaaggcagctggcagaag

SEQ ID NO: 13953 - DNA, 20 bp, Artificial Sequence
  Description of Artificial Sequence: Synthetic oligonucleotide
  Target: DMPK; (+) strand; PAM type: NRG; PAM sequence: AAG
aaggcagctggcagaagcgg

SEQ ID NO: 13954 - DNA, 20 bp, Artificial Sequence
  Description of Artificial Sequence: Synthetic oligonucleotide
  Target: DMPK; (+) strand; PAM type: NRG; PAM sequence: CAG
aagcggaagcatcctccttc

SEQ ID NO: 13955 - DNA, 20 bp, Artificial Sequence
  Description of Artificial Sequence: Synthetic oligonucleotide
  Target: DMPK; (+) strand; PAM type: NRG; PAM sequence: TGG
aagcatcctccttccagccc

SEQ ID NO: 13956 - DNA, 20 bp, Artificial Sequence
  Description of Artificial Sequence: Synthetic oligonucleotide
  Target: DMPK; (+) strand; PAM type: NRG; PAM sequence: CAG
cctccttccagccctggccc

SEQ ID NO: 13957 - DNA, 20 bp, Artificial Sequence
  Description of Artificial Sequence: Synthetic oligonucleotide
  Target: DMPK; (+) strand; PAM type: NRG; PAM sequence: AGG
ctccttccagccctggcccc

SEQ ID NO: 13958 - DNA, 20 bp, Artificial Sequence
  Description of Artificial Sequence: Synthetic oligonucleotide
  Target: DMPK; (+) strand; PAM type: NRG; PAM sequence: TGG
ccagccctggccccaggccc

SEQ ID NO: 13959 - DNA, 20 bp, Artificial Sequence
  Description of Artificial Sequence: Synthetic oligonucleotide
  Target: DMPK; (+) strand; PAM type: NRG; PAM sequence: AAG
ccctggccccaggccctgga

SEQ ID NO: 13960 - DNA, 20 bp, Artificial Sequence
  Description of Artificial Sequence: Synthetic oligonucleotide
  Target: DMPK; (+) strand; PAM type: NRG; PAM sequence: AAG
aggccctggaaagcccttgc

SEQ ID NO: 13961 - DNA, 20 bp, Artificial Sequence
  Description of Artificial Sequence: Synthetic oligonucleotide
  Target: DMPK; (+) strand; PAM type: NRG; PAM sequence: AAG
ccctggaaagcccttgcaag

SEQ ID NO: 13962 - DNA, 20 bp, Artificial Sequence
  Description of Artificial Sequence: Synthetic oligonucleotide
  Target: DMPK; (+) strand; PAM type: NRG; PAM sequence: AGG
cctggaaagcccttgcaaga

SEQ ID NO: 13963 - DNA, 20 bp, Artificial Sequence
  Description of Artificial Sequence: Synthetic oligonucleotide
  Target: DMPK; (+) strand; PAM type: NRG; PAM sequence: GGG
ctggaaagcccttgcaagaa

SEQ ID NO: 13964 - DNA, 20 bp, Artificial Sequence
  Description of Artificial Sequence: Synthetic oligonucleotide
  Target: DMPK; (+) strand; PAM type: NRG; PAM sequence: GGG
tggaaagcccttgcaagaag

SEQ ID NO: 13965 - DNA, 20 bp, Artificial Sequence
  Description of Artificial Sequence: Synthetic oligonucleotide
  Target: DMPK; (+) strand; PAM type: NRG; PAM sequence: TGG
ccttgcaagaaggggttttg

SEQ ID NO: 13966 - DNA, 20 bp, Artificial Sequence
  Description of Artificial Sequence: Synthetic oligonucleotide
  Target: DMPK; (+) strand; PAM type: NRG; PAM sequence: GGG
cttgcaagaaggggttttgt

SEQ ID NO: 13967 - DNA, 20 bp, Artificial Sequence
  Description of Artificial Sequence: Synthetic oligonucleotide
  Target: DMPK; (+) strand; PAM type: NRG; PAM sequence: CAG
caagaaggggttttgtggga

SEQ ID NO: 13968 - DNA, 20 bp, Artificial Sequence
  Description of Artificial Sequence: Synthetic oligonucleotide
  Target: DMPK; (+) strand; PAM type: NRG; PAM sequence: TGG
aaggggttttgtgggacagc

SEQ ID NO: 13969 - DNA, 20 bp, Artificial Sequence
  Description of Artificial Sequence: Synthetic oligonucleotide
  Target: DMPK; (+) strand; PAM type: NRG; PAM sequence: AAG
gggttttgtgggacagctgg

SEQ ID NO: 13970 - DNA, 20 bp, Artificial Sequence
  Description of Artificial Sequence: Synthetic oligonucleotide
  Target: DMPK; (+) strand; PAM type: NRG; PAM sequence: AGG
ggttttgtgggacagctgga

SEQ ID NO: 13971 - DNA, 20 bp, Artificial Sequence
  Description of Artificial Sequence: Synthetic oligonucleotide
  Target: DMPK; (+) strand; PAM type: NRG; PAM sequence: TGG
ttgtgggacagctggaaggt

SEQ ID NO: 13972 - DNA, 20 bp, Artificial Sequence
  Description of Artificial Sequence: Synthetic oligonucleotide
  Target: DMPK; (+) strand; PAM type: NRG; PAM sequence: GAG
gtgggacagctggaaggttg

SEQ ID NO: 13973 - DNA, 20 bp, Artificial Sequence
  Description of Artificial Sequence: Synthetic oligonucleotide
  Target: DMPK; (+) strand; PAM type: NRG; PAM sequence: AGG
tgggacagctggaaggttgg

SEQ ID NO: 13974 - DNA, 20 bp, Artificial Sequence
  Description of Artificial Sequence: Synthetic oligonucleotide
  Target: DMPK; (+) strand; PAM type: NRG; PAM sequence: TGG
agctggaaggttggaggccc

SEQ ID NO: 13975 - DNA, 20 bp, Artificial Sequence
  Description of Artificial Sequence: Synthetic oligonucleotide
  Target: DMPK; (+) strand; PAM type: NRG; PAM sequence: GGG
gctggaaggttggaggccct

SEQ ID NO: 13976 - DNA, 20 bp, Artificial Sequence
  Description of Artificial Sequence: Synthetic oligonucleotide
  Target: DMPK; (+) strand; PAM type: NRG; PAM sequence: CAG
gaaggttggaggccctgggc

SEQ ID NO: 13977 - DNA, 20 bp, Artificial Sequence
  Description of Artificial Sequence: Synthetic oligonucleotide
  Target: DMPK; (+) strand; PAM type: NRG; PAM sequence: AGG
aaggttggaggccctgggcc

SEQ ID NO: 13978 - DNA, 20 bp, Artificial Sequence
  Description of Artificial Sequence: Synthetic oligonucleotide
  Target: DMPK; (+) strand; PAM type: NRG; PAM sequence: GAG
ggttggaggccctgggccag

SEQ ID NO: 13979 - DNA, 20 bp, Artificial Sequence
  Description of Artificial Sequence: Synthetic oligonucleotide
  Target: DMPK; (+) strand; PAM type: NRG; PAM sequence: AAG
gccctgggccaggagaacta

SEQ ID NO: 13980 - DNA, 20 bp, Artificial Sequence
  Description of Artificial Sequence: Synthetic oligonucleotide
  Target: DMPK; (+) strand; PAM type: NRG; PAM sequence: AGG
ccctgggccaggagaactaa

SEQ ID NO: 13981 - DNA, 20 bp, Artificial Sequence
  Description of Artificial Sequence: Synthetic oligonucleotide
  Target: DMPK; (+) strand; PAM type: NRG; PAM sequence: CAG
gccaggagaactaaaggacg

SEQ ID NO: 13982 - DNA, 20 bp, Artificial Sequence
  Description of Artificial Sequence: Synthetic oligonucleotide
  Target: DMPK; (+) strand; PAM type: NRG; PAM sequence: AGG
ccaggagaactaaaggacgc

SEQ ID NO: 13983 - DNA, 20 bp, Artificial Sequence
  Description of Artificial Sequence: Synthetic oligonucleotide
  Target: DMPK; (+) strand; PAM type: NRG; PAM sequence: GGG
caggagaactaaaggacgca

SEQ ID NO: 13984 - DNA, 20 bp, Artificial Sequence
  Description of Artificial Sequence: Synthetic oligonucleotide
  Target: DMPK; (+) strand; PAM type: NRG; PAM sequence: CGG
aactaaaggacgcagggacc

SEQ ID NO: 13985 - DNA, 20 bp, Artificial Sequence
  Description of Artificial Sequence: Synthetic oligonucleotide
  Target: DMPK; (+) strand; PAM type: NRG; PAM sequence: GGG
actaaaggacgcagggaccc

SEQ ID NO: 13986 - DNA, 20 bp, Artificial Sequence
  Description of Artificial Sequence: Synthetic oligonucleotide
  Target: DMPK; (+) strand; PAM type: NRG; PAM sequence: GGG
ctaaaggacgcagggacccg

SEQ ID NO: 13987 - DNA, 20 bp, Artificial Sequence
  Description of Artificial Sequence: Synthetic oligonucleotide
  Target: DMPK; (+) strand; PAM type: NRG; PAM sequence: TGG
aaggacgcagggacccgggg

SEQ ID NO: 13988 - DNA, 20 bp, Artificial Sequence
  Description of Artificial Sequence: Synthetic oligonucleotide
  Target: DMPK; (+) strand; PAM type: NRG; PAM sequence: CGG
gacgcagggacccggggtgg

SEQ ID NO: 13989 - DNA, 20 bp, Artificial Sequence
  Description of Artificial Sequence: Synthetic oligonucleotide
  Target: DMPK; (+) strand; PAM type: NRG; PAM sequence: GGG
acgcagggacccggggtggc

SEQ ID NO: 13990 - DNA, 20 bp, Artificial Sequence
  Description of Artificial Sequence: Synthetic oligonucleotide
  Target: DMPK; (+) strand; PAM type: NRG; PAM sequence: TGG
gggacccggggtggcgggaa

SEQ ID NO: 13991 - DNA, 20 bp, Artificial Sequence
  Description of Artificial Sequence: Synthetic oligonucleotide
  Target: DMPK; (+) strand; PAM type: NRG; PAM sequence: TGG
acccggggtggcgggaatgg

SEQ ID NO: 13992 - DNA, 20 bp, Artificial Sequence
  Description of Artificial Sequence: Synthetic oligonucleotide
  Target: DMPK; (+) strand; PAM type: NRG; PAM sequence: CGG
ggaatggtggctgacccaca

SEQ ID NO: 13993 - DNA, 20 bp, Artificial Sequence
  Description of Artificial Sequence: Synthetic oligonucleotide
  Target: DMPK; (+) strand; PAM type: NRG; PAM sequence: TAG
tggctgacccacacggctca

SEQ ID NO: 13994 - DNA, 20 bp, Artificial Sequence
  Description of Artificial Sequence: Synthetic oligonucleotide
  Target: DMPK; (+) strand; PAM type: NRG; PAM sequence: AGG
ggctgacccacacggctcat

SEQ ID NO: 13995 - DNA, 20 bp, Artificial Sequence
  Description of Artificial Sequence: Synthetic oligonucleotide
  Target: DMPK; (+) strand; PAM type: NRG; PAM sequence: GAG
ccacacggctcataggaacc

SEQ ID NO: 13996 - DNA, 20 bp, Artificial Sequence
  Description of Artificial Sequence: Synthetic oligonucleotide
  Target: DMPK; (+) strand; PAM type: NRG; PAM sequence: TGG
gctcataggaaccgagactt

SEQ ID NO: 13997 - DNA, 20 bp, Artificial Sequence
  Description of Artificial Sequence: Synthetic oligonucleotide
  Target: DMPK; (+) strand; PAM type: NRG; PAM sequence: GGG
ctcataggaaccgagacttt

SEQ ID NO: 13998 - DNA, 20 bp, Artificial Sequence
  Description of Artificial Sequence: Synthetic oligonucleotide
  Target: DMPK; (+) strand; PAM type: NRG; PAM sequence: GGG
tcataggaaccgagactttg

SEQ ID NO: 13999 - DNA, 20 bp, Artificial Sequence
  Description of Artificial Sequence: Synthetic oligonucleotide
  Target: DMPK; (+) strand; PAM type: NRG; PAM sequence: TGG
aggaaccgagactttggggc

SEQ ID NO: 14000 - DNA, 20 bp, Artificial Sequence
  Description of Artificial Sequence: Synthetic oligonucleotide
  Target: DMPK; (+) strand; PAM type: NRG; PAM sequence: GGG
ggaaccgagactttggggct

SEQ ID NO: 14001 - DNA, 20 bp, Artificial Sequence
  Description of Artificial Sequence: Synthetic oligonucleotide
  Target: DMPK; (+) strand; PAM type: NRG; PAM sequence: GGG
gaaccgagactttggggctg

SEQ ID NO: 14002 - DNA, 20 bp, Artificial Sequence
  Description of Artificial Sequence: Synthetic oligonucleotide
  Target: DMPK; (+) strand; PAM type: NRG; PAM sequence: GGG
aaccgagactttggggctgg

SEQ ID NO: 14003 - DNA, 20 bp, Artificial Sequence
  Description of Artificial Sequence: Synthetic oligonucleotide
  Target: DMPK; (+) strand; PAM type: NRG; PAM sequence: TGG
cgagactttggggctggggg

SEQ ID NO: 14004 - DNA, 20 bp, Artificial Sequence
  Description of Artificial Sequence: Synthetic oligonucleotide
  Target: DMPK; (+) strand; PAM type: NRG; PAM sequence: GGG
gagactttggggctgggggt

SEQ ID NO: 14005 - DNA, 20 bp, Artificial Sequence
  Description of Artificial Sequence: Synthetic oligonucleotide
  Target: DMPK; (+) strand; PAM type: NRG; PAM sequence: GGG
agactttggggctgggggtg

SEQ ID NO: 14006 - DNA, 20 bp, Artificial Sequence
  Description of Artificial Sequence: Synthetic oligonucleotide
  Target: DMPK; (+) strand; PAM type: NRG; PAM sequence: GGG
gactttggggctgggggtgg

SEQ ID NO: 14007 - DNA, 20 bp, Artificial Sequence
  Description of Artificial Sequence: Synthetic oligonucleotide
  Target: DMPK; (+) strand; PAM type: NRG; PAM sequence: TGG
tttggggctgggggtggggg

SEQ ID NO: 14008 - DNA, 20 bp, Artificial Sequence
  Description of Artificial Sequence: Synthetic oligonucleotide
  Target: DMPK; (+) strand; PAM type: NRG; PAM sequence: GGG
ttggggctgggggtgggggt

SEQ ID NO: 14009 - DNA, 20 bp, Artificial Sequence
  Description of Artificial Sequence: Synthetic oligonucleotide
  Target: DMPK; (+) strand; PAM type: NRG; PAM sequence: CAG
gctgggggtgggggtgggtg

SEQ ID NO: 14010 - DNA, 20 bp, Artificial Sequence
  Description of Artificial Sequence: Synthetic oligonucleotide
  Target: DMPK; (+) strand; PAM type: NRG; PAM sequence: AAG
ggtgggtgcagaacctacaa

SEQ ID NO: 14011 - DNA, 20 bp, Artificial Sequence
  Description of Artificial Sequence: Synthetic oligonucleotide
  Target: DMPK; (+) strand; PAM type: NRG; PAM sequence: AAG
gggtgcagaacctacaaaag

SEQ ID NO: 14012 - DNA, 20 bp, Artificial Sequence
  Description of Artificial Sequence: Synthetic oligonucleotide
  Target: DMPK; (+) strand; PAM type: NRG; PAM sequence: AGG
ggtgcagaacctacaaaaga

SEQ ID NO: 14013 - DNA, 20 bp, Artificial Sequence
  Description of Artificial Sequence: Synthetic oligonucleotide
  Target: DMPK; (+) strand; PAM type: NRG; PAM sequence: GAG
tgcagaacctacaaaagaag

SEQ ID NO: 14014 - DNA, 20 bp, Artificial Sequence
  Description of Artificial Sequence: Synthetic oligonucleotide
  Target: DMPK; (+) strand; PAM type: NRG; PAM sequence: CAG
acaaaagaaggagacacacc

SEQ ID NO: 14015 - DNA, 20 bp, Artificial Sequence
  Description of Artificial Sequence: Synthetic oligonucleotide
  Target: DMPK; (+) strand; PAM type: NRG; PAM sequence: AAG
aaagaaggagacacacccag

SEQ ID NO: 14016 - DNA, 20 bp, Artificial Sequence
  Description of Artificial Sequence: Synthetic oligonucleotide
  Target: DMPK; (+) strand; PAM type: NRG; PAM sequence: AAG
gacacacccagaagaaccca

SEQ ID NO: 14017 - DNA, 20 bp, Artificial Sequence
  Description of Artificial Sequence: Synthetic oligonucleotide
  Target: DMPK; (+) strand; PAM type: NRG; PAM sequence: TGG
gaacccaaagttgtccctcc

SEQ ID NO: 14018 - DNA, 20 bp, Artificial Sequence
  Description of Artificial Sequence: Synthetic oligonucleotide
  Target: DMPK; (+) strand; PAM type: NRG; PAM sequence: CAG
aagttgtccctcctggatcg

SEQ ID NO: 14019 - DNA, 20 bp, Artificial Sequence
  Description of Artificial Sequence: Synthetic oligonucleotide
  Target: DMPK; (+) strand; PAM type: NRG; PAM sequence: GAG
gttgtccctcctggatcgca

SEQ ID NO: 14020 - DNA, 20 bp, Artificial Sequence
  Description of Artificial Sequence: Synthetic oligonucleotide
  Target: DMPK; (+) strand; PAM type: NRG; PAM sequence: AGG
ttgtccctcctggatcgcag

SEQ ID NO: 14021 - DNA, 20 bp, Artificial Sequence
  Description of Artificial Sequence: Synthetic oligonucleotide
  Target: DMPK; (+) strand; PAM type: NRG; PAM sequence: GAG
gtccctcctggatcgcagag

SEQ ID NO: 14022 - DNA, 20 bp, Artificial Sequence
  Description of Artificial Sequence: Synthetic oligonucleotide
  Target: DMPK; (+) strand; PAM type: NRG; PAM sequence: AGG
tccctcctggatcgcagagg

SEQ ID NO: 14023 - DNA, 20 bp, Artificial Sequence
  Description of Artificial Sequence: Synthetic oligonucleotide
  Target: DMPK; (+) strand; PAM type: NRG; PAM sequence: GGG
ccctcctggatcgcagagga

SEQ ID NO: 14024 - DNA, 20 bp, Artificial Sequence
  Description of Artificial Sequence: Synthetic oligonucleotide
  Target: DMPK; (+) strand; PAM type: NRG; PAM sequence: GGG
cctcctggatcgcagaggag

SEQ ID NO: 14025 - DNA, 20 bp, Artificial Sequence
  Description of Artificial Sequence: Synthetic oligonucleotide
  Target: DMPK; (+) strand; PAM type: NRG; PAM sequence: GGG
ctcctggatcgcagaggagg

SEQ ID NO: 14026 - DNA, 20 bp, Artificial Sequence
  Description of Artificial Sequence: Synthetic oligonucleotide
  Target: DMPK; (+) strand; PAM type: NRG; PAM sequence: TGG
gatcgcagaggagggggcac

SEQ ID NO: 14027 - DNA, 20 bp, Artificial Sequence
  Description of Artificial Sequence: Synthetic oligonucleotide
  Target: DMPK; (+) strand; PAM type: NRG; PAM sequence: TGG
cgcagaggagggggcactgg

SEQ ID NO: 14028 - DNA, 20 bp, Artificial Sequence
  Description of Artificial Sequence: Synthetic oligonucleotide
  Target: DMPK; (+) strand; PAM type: NRG; PAM sequence: AAG
actggtggcgcctgtctgca

SEQ ID NO: 14029 - DNA, 20 bp, Artificial Sequence
  Description of Artificial Sequence: Synthetic oligonucleotide
  Target: DMPK; (+) strand; PAM type: NRG; PAM sequence: TGG
gtggcgcctgtctgcaaagc

SEQ ID NO: 14030 - DNA, 20 bp, Artificial Sequence
  Description of Artificial Sequence: Synthetic oligonucleotide
  Target: DMPK; (+) strand; PAM type: NRG; PAM sequence: CAG
ctgcaaagctggttctccca

SEQ ID NO: 14031 - DNA, 20 bp, Artificial Sequence
  Description of Artificial Sequence: Synthetic oligonucleotide
  Target: DMPK; (+) strand; PAM type: NRG; PAM sequence: AGG
tgcaaagctggttctcccac

SEQ ID NO: 14032 - DNA, 20 bp, Artificial Sequence
  Description of Artificial Sequence: Synthetic oligonucleotide
  Target: DMPK; (+) strand; PAM type: NRG; PAM sequence: GGG
gcaaagctggttctcccaca

SEQ ID NO: 14033 - DNA, 20 bp, Artificial Sequence
  Description of Artificial Sequence: Synthetic oligonucleotide
  Target: DMPK; (+) strand; PAM type: NRG; PAM sequence: GAG
ttctcccacagggcccgcgt

SEQ ID NO: 14034 - DNA, 20 bp, Artificial Sequence
  Description of Artificial Sequence: Synthetic oligonucleotide
  Target: DMPK; (+) strand; PAM type: NRG; PAM sequence: CAG
cgcgtgagtcaccgccctcc

SEQ ID NO: 14035 - DNA, 20 bp, Artificial Sequence
  Description of Artificial Sequence: Synthetic oligonucleotide
  Target: DMPK; (+) strand; PAM type: NRG; PAM sequence: TGG
gtcaccgccctcccagtgcc

SEQ ID NO: 14036 - DNA, 20 bp, Artificial Sequence
  Description of Artificial Sequence: Synthetic oligonucleotide
  Target: DMPK; (+) strand; PAM type: NRG; PAM sequence: GGG
tcaccgccctcccagtgcct

SEQ ID NO: 14037 - DNA, 20 bp, Artificial Sequence
  Description of Artificial Sequence: Synthetic oligonucleotide
  Target: DMPK; (+) strand; PAM type: NRG; PAM sequence: TGG
cccagtgcctgggcacctgt

SEQ ID NO: 14038 - DNA, 20 bp, Artificial Sequence
  Description of Artificial Sequence: Synthetic oligonucleotide
  Target: DMPK; (+) strand; PAM type: NRG; PAM sequence: GGG
ccagtgcctgggcacctgtt

SEQ ID NO: 14039 - DNA, 20 bp, Artificial Sequence
  Description of Artificial Sequence: Synthetic oligonucleotide
  Target: DMPK; (+) strand; PAM type: NRG; PAM sequence: GGG
cagtgcctgggcacctgttg

SEQ ID NO: 14040 - DNA, 20 bp, Artificial Sequence
  Description of Artificial Sequence: Synthetic oligonucleotide
  Target: DMPK; (+) strand; PAM type: NRG; PAM sequence: CAG
tgcctgggcacctgttgggg

SEQ ID NO: 14041 - DNA, 20 bp, Artificial Sequence
  Description of Artificial Sequence: Synthetic oligonucleotide
  Target: DMPK; (+) strand; PAM type: NRG; PAM sequence: TGG
tgggcacctgttggggcagc

SEQ ID NO: 14042 - DNA, 20 bp, Artificial Sequence
  Description of Artificial Sequence: Synthetic oligonucleotide
  Target: DMPK; (+) strand; PAM type: NRG; PAM sequence: GAG
ggcacctgttggggcagctg

SEQ ID NO: 14043 - DNA, 20 bp, Artificial Sequence
  Description of Artificial Sequence: Synthetic oligonucleotide
  Target: DMPK; (+) strand; PAM type: NRG; PAM sequence: GAG
cacctgttggggcagctgga

SEQ ID NO: 14044 - DNA, 20 bp, Artificial Sequence
  Description of Artificial Sequence: Synthetic oligonucleotide
  Target: DMPK; (+) strand; PAM type: NRG; PAM sequence: AGG
acctgttggggcagctggag

SEQ ID NO: 14045 - DNA, 20 bp, Artificial Sequence
  Description of Artificial Sequence: Synthetic oligonucleotide
  Target: DMPK; (+) strand; PAM type: NRG; PAM sequence: TGG
gttggggcagctggagaggc

SEQ ID NO: 14046 - DNA, 20 bp, Artificial Sequence
  Description of Artificial Sequence: Synthetic oligonucleotide
  Target: DMPK; (+) strand; PAM type: NRG; PAM sequence: CGG
ggcgccgaacacctgcctgt

SEQ ID NO: 14047 - DNA, 20 bp, Artificial Sequence
  Description of Artificial Sequence: Synthetic oligonucleotide
  Target: DMPK; (+) strand; PAM type: NRG; PAM sequence: TGG
ctgcctgtcggctgcgcccc

SEQ ID NO: 14048 - DNA, 20 bp, Artificial Sequence
  Description of Artificial Sequence: Synthetic oligonucleotide
  Target: DMPK; (+) strand; PAM type: NRG; PAM sequence: CAG
cctgtcggctgcgcccctgg

SEQ ID NO: 14049 - DNA, 20 bp, Artificial Sequence
  Description of Artificial Sequence: Synthetic oligonucleotide
  Target: DMPK; (+) strand; PAM type: NRG; PAM sequence: TGG
ccctggcagctgccccatgc

SEQ ID NO: 14050 - DNA, 20 bp, Artificial Sequence
  Description of Artificial Sequence: Synthetic oligonucleotide
  Target: DMPK; (+) strand; PAM type: NRG; PAM sequence: TGG
ctgccccatgctggccctcc

SEQ ID NO: 14051 - DNA, 20 bp, Artificial Sequence
  Description of Artificial Sequence: Synthetic oligonucleotide
  Target: DMPK; (+) strand; PAM type: NRG; PAM sequence: CAG
ctggccctcctggcttgccc

SEQ ID NO: 14052 - DNA, 20 bp, Artificial Sequence
  Description of Artificial Sequence: Synthetic oligonucleotide
  Target: DMPK; (+) strand; PAM type: NRG; PAM sequence: AGG
tggccctcctggcttgcccc

SEQ ID NO: 14053 - DNA, 20 bp, Artificial Sequence
  Description of Artificial Sequence: Synthetic oligonucleotide
  Target: DMPK; (+) strand; PAM type: NRG; PAM sequence: CAG
tcctggcttgccccaggcca

SEQ ID NO: 14054 - DNA, 20 bp, Artificial Sequence
  Description of Artificial Sequence: Synthetic oligonucleotide
  Target: DMPK; (+) strand; PAM type: NRG; PAM sequence: AGG
cctggcttgccccaggccac

SEQ ID NO: 14055 - DNA, 20 bp, Artificial Sequence
  Description of Artificial Sequence: Synthetic oligonucleotide
  Target: DMPK; (+) strand; PAM type: NRG; PAM sequence: CAG
tgccccaggccacaggaaac

SEQ ID NO: 14056 - DNA, 20 bp, Artificial Sequence
  Description of Artificial Sequence: Synthetic oligonucleotide
  Target: DMPK; (+) strand; PAM type: NRG; PAM sequence: AGG
gccccaggccacaggaaacc

SEQ ID NO: 14057 - DNA, 20 bp, Artificial Sequence
  Description of Artificial Sequence: Synthetic oligonucleotide
  Target: DMPK; (+) strand; PAM type: NRG; PAM sequence: GGG
ccccaggccacaggaaacca

SEQ ID NO: 14058 - DNA, 20 bp, Artificial Sequence
  Description of Artificial Sequence: Synthetic oligonucleotide
  Target: DMPK; (+) strand; PAM type: NRG; PAM sequence: GGG
cccaggccacaggaaaccag

SEQ ID NO: 14059 - DNA, 20 bp, Artificial Sequence
  Description of Artificial Sequence: Synthetic oligonucleotide
  Target: DMPK; (+) strand; PAM type: NRG; PAM sequence: GAG
caggccacaggaaaccaggg

SEQ ID NO: 14060 - DNA, 20 bp, Artificial Sequence
  Description of Artificial Sequence: Synthetic oligonucleotide
  Target: DMPK; (+) strand; PAM type: NRG; PAM sequence: GAG
ggccacaggaaaccagggga

SEQ ID NO: 14061 - DNA, 20 bp, Artificial Sequence
  Description of Artificial Sequence: Synthetic oligonucleotide
  Target: DMPK; (+) strand; PAM type: NRG; PAM sequence: AGG
gccacaggaaaccaggggag

SEQ ID NO: 14062 - DNA, 20 bp, Artificial Sequence
  Description of Artificial Sequence: Synthetic oligonucleotide
  Target: DMPK; (+) strand; PAM type: NRG; PAM sequence: GGG
ccacaggaaaccaggggaga

SEQ ID NO: 14063 - DNA, 20 bp, Artificial Sequence
  Description of Artificial Sequence: Synthetic oligonucleotide
  Target: DMPK; (+) strand; PAM type: NRG; PAM sequence: TAG
gaaaccaggggagagggcca

SEQ ID NO: 14064 - DNA, 20 bp, Artificial Sequence
  Description of Artificial Sequence: Synthetic oligonucleotide
  Target: DMPK; (+) strand; PAM type: NRG; PAM sequence: GAG
aaccaggggagagggccata

SEQ ID NO: 14065 - DNA, 20 bp, Artificial Sequence
  Description of Artificial Sequence: Synthetic oligonucleotide
  Target: DMPK; (+) strand; PAM type: NRG; PAM sequence: TGG
agggccatagagcccacttt

SEQ ID NO: 14066 - DNA, 20 bp, Artificial Sequence
  Description of Artificial Sequence: Synthetic oligonucleotide
  Target: DMPK; (+) strand; PAM type: NRG; PAM sequence: GGG
gggccatagagcccactttt

SEQ ID NO: 14067 - DNA, 20 bp, Artificial Sequence
  Description of Artificial Sequence: Synthetic oligonucleotide
  Target: DMPK; (+) strand; PAM type: NRG; PAM sequence: GGG
ggccatagagcccacttttg

SEQ ID NO: 14068 - DNA, 20 bp, Artificial Sequence
  Description of Artificial Sequence: Synthetic oligonucleotide
  Target: DMPK; (+) strand; PAM type: NRG; PAM sequence: GGG
gccatagagcccacttttgg

SEQ ID NO: 14069 - DNA, 20 bp, Artificial Sequence
  Description of Artificial Sequence: Synthetic oligonucleotide
  Target: DMPK; (+) strand; PAM type: NRG; PAM sequence: GGG
ccatagagcccacttttggg

SEQ ID NO: 14070 - DNA, 20 bp, Artificial Sequence
  Description of Artificial Sequence: Synthetic oligonucleotide
  Target: DMPK; (+) strand; PAM type: NRG; PAM sequence: GAG
atagagcccacttttggggg

SEQ ID NO: 14071 - DNA, 20 bp, Artificial Sequence
  Description of Artificial Sequence: Synthetic oligonucleotide
  Target: DMPK; (+) strand; PAM type: NRG; PAM sequence: AGG
tagagcccacttttgggggg

SEQ ID NO: 14072 - DNA, 20 bp, Artificial Sequence
  Description of Artificial Sequence: Synthetic oligonucleotide
  Target: DMPK; (+) strand; PAM type: NRG; PAM sequence: GGG
agagcccacttttgggggga

SEQ ID NO: 14073 - DNA, 20 bp, Artificial Sequence
  Description of Artificial Sequence: Synthetic oligonucleotide
  Target: DMPK; (+) strand; PAM type: NRG; PAM sequence: TAG
cacttttggggggagggtcc

SEQ ID NO: 14074 - DNA, 20 bp, Artificial Sequence
  Description of Artificial Sequence: Synthetic oligonucleotide
  Target: DMPK; (+) strand; PAM type: NRG; PAM sequence: AGG
acttttggggggagggtcct

SEQ ID NO: 14075 - DNA, 20 bp, Artificial Sequence
  Description of Artificial Sequence: Synthetic oligonucleotide
  Target: DMPK; (+) strand; PAM type: NRG; PAM sequence: GAG
ttttggggggagggtcctag

SEQ ID NO: 14076 - DNA, 20 bp, Artificial Sequence
  Description of Artificial Sequence: Synthetic oligonucleotide
  Target: DMPK; (+) strand; PAM type: NRG; PAM sequence: GAG
ttggggggagggtcctagga

SEQ ID NO: 14077 - DNA, 20 bp, Artificial Sequence
  Description of Artificial Sequence: Synthetic oligonucleotide
  Target: DMPK; (+) strand; PAM type: NRG; PAM sequence: AGG
tggggggagggtcctaggag

SEQ ID NO: 14078 - DNA, 20 bp, Artificial Sequence
  Description of Artificial Sequence: Synthetic oligonucleotide
  Target: DMPK; (+) strand; PAM type: NRG; PAM sequence: GGG
ggggggagggtcctaggaga

SEQ ID NO: 14079 - DNA, 20 bp, Artificial Sequence
  Description of Artificial Sequence: Synthetic oligonucleotide
  Target: DMPK; (+) strand; PAM type: NRG; PAM sequence: GAG
ggggagggtcctaggagagg

SEQ ID NO: 14080 - DNA, 20 bp, Artificial Sequence
  Description of Artificial Sequence: Synthetic oligonucleotide
  Target: DMPK; (+) strand; PAM type: NRG; PAM sequence: CAG
gtcctaggagagggagctcc

SEQ ID NO: 14081 - DNA, 20 bp, Artificial Sequence
  Description of Artificial Sequence: Synthetic oligonucleotide
  Target: DMPK; (+) strand; PAM type: NRG; PAM sequence: GAG
atgaccctgaccctgaccct

SEQ ID NO: 14082 - DNA, 20 bp, Artificial Sequence
  Description of Artificial Sequence: Synthetic oligonucleotide
  Target: DMPK; (+) strand; PAM type: NRG; PAM sequence: AGG
tgaccctgaccctgaccctg

SEQ ID NO: 14083 - DNA, 20 bp, Artificial Sequence
  Description of Artificial Sequence: Synthetic oligonucleotide
  Target: DMPK; (+) strand; PAM type: NRG; PAM sequence: CGG
ccctgaccctgaccctgagg

SEQ ID NO: 14084 - DNA, 20 bp, Artificial Sequence
  Description of Artificial Sequence: Synthetic oligonucleotide
  Target: DMPK; (+) strand; PAM type: NRG; PAM sequence: GGG
cctgaccctgaccctgaggc

SEQ ID NO: 14085 - DNA, 20 bp, Artificial Sequence
  Description of Artificial Sequence: Synthetic oligonucleotide
  Target: DMPK; (+) strand; PAM type: NRG; PAM sequence: GGG
ctgaccctgaccctgaggcg

SEQ ID NO: 14086 - DNA, 20 bp, Artificial Sequence
  Description of Artificial Sequence: Synthetic oligonucleotide
  Target: DMPK; (+) strand; PAM type: NRG; PAM sequence: CAG
cctgaccctgaggcggggtg

SEQ ID NO: 14087 - DNA, 20 bp, Artificial Sequence
  Description of Artificial Sequence: Synthetic oligonucleotide
  Target: DMPK; (+) strand; PAM type: NRG; PAM sequence: GAG
tgaccctgaggcggggtgca

SEQ ID NO: 14088 - DNA, 20 bp, Artificial Sequence
  Description of Artificial Sequence: Synthetic oligonucleotide
  Target: DMPK; (+) strand; PAM type: NRG; PAM sequence: GAG
accctgaggcggggtgcaga

SEQ ID NO: 14089 - DNA, 20 bp, Artificial Sequence
  Description of Artificial Sequence: Synthetic oligonucleotide
  Target: DMPK; (+) strand; PAM type: NRG; PAM sequence: AGG
ccctgaggcggggtgcagag

SEQ ID NO: 14090 - DNA, 20 bp, Artificial Sequence
  Description of Artificial Sequence: Synthetic oligonucleotide
  Target: DMPK; (+) strand; PAM type: NRG; PAM sequence: TGG
ggcggggtgcagagaggcca

SEQ ID NO: 14091 - DNA, 20 bp, Artificial Sequence
  Description of Artificial Sequence: Synthetic oligonucleotide
  Target: DMPK; (+) strand; PAM type: NRG; PAM sequence: GGG
gcggggtgcagagaggccat

SEQ ID NO: 14092 - DNA, 20 bp, Artificial Sequence
  Description of Artificial Sequence: Synthetic oligonucleotide
  Target: DMPK; (+) strand; PAM type: NRG; PAM sequence: GAG
ggggtgcagagaggccatgg

SEQ ID NO: 14093 - DNA, 20 bp, Artificial Sequence
  Description of Artificial Sequence: Synthetic oligonucleotide
  Target: DMPK; (+) strand; PAM type: NRG; PAM sequence: AGG
gggtgcagagaggccatggg

SEQ ID NO: 14094 - DNA, 20 bp, Artificial Sequence
  Description of Artificial Sequence: Synthetic oligonucleotide
  Target: DMPK; (+) strand; PAM type: NRG; PAM sequence: TGG
gagaggccatgggaggctgt

SEQ ID NO: 14095 - DNA, 20 bp, Artificial Sequence
  Description of Artificial Sequence: Synthetic oligonucleotide
  Target: DMPK; (+) strand; PAM type: NRG; PAM sequence: CAG
aggccatgggaggctgttgg

SEQ ID NO: 14096 - DNA, 20 bp, Artificial Sequence
  Description of Artificial Sequence: Synthetic oligonucleotide
  Target: DMPK; (+) strand; PAM type: NRG; PAM sequence: TAG
atgggaggctgttggcagcc

SEQ ID NO: 14097 - DNA, 20 bp, Artificial Sequence
  Description of Artificial Sequence: Synthetic oligonucleotide
  Target: DMPK; (+) strand; PAM type: NRG; PAM sequence: AAG
cctagcctgctgtgactcct

SEQ ID NO: 14098 - DNA, 20 bp, Artificial Sequence
  Description of Artificial Sequence: Synthetic oligonucleotide
  Target: DMPK; (+) strand; PAM type: NRG; PAM sequence: TGG
ctgctgtgactcctaagcca

SEQ ID NO: 14099 - DNA, 20 bp, Artificial Sequence
  Description of Artificial Sequence: Synthetic oligonucleotide
  Target: DMPK; (+) strand; PAM type: NRG; PAM sequence: GAG
gactcctaagccatggctct

SEQ ID NO: 14100 - DNA, 20 bp, Artificial Sequence
  Description of Artificial Sequence: Synthetic oligonucleotide
  Target: DMPK; (+) strand; PAM type: NRG; PAM sequence: CAG
taagccatggctctgagtca

SEQ ID NO: 14101 - DNA, 20 bp, Artificial Sequence
  Description of Artificial Sequence: Synthetic oligonucleotide
  Target: DMPK; (+) strand; PAM type: NRG; PAM sequence: TAG
gctctgagtcacagccaccc

SEQ ID NO: 14102 - DNA, 20 bp, Artificial Sequence
  Description of Artificial Sequence: Synthetic oligonucleotide
  Target: DMPK; (+) strand; PAM type: NRG; PAM sequence: CAG
ctgaccttactctgcccctc

SEQ ID NO: 14103 - DNA, 20 bp, Artificial Sequence
  Description of Artificial Sequence: Synthetic oligonucleotide
  Target: DMPK; (+) strand; PAM type: NRG; PAM sequence: GAG
gaccttactctgcccctcca

SEQ ID NO: 14104 - DNA, 20 bp, Artificial Sequence
  Description of Artificial Sequence: Synthetic oligonucleotide
  Target: DMPK; (+) strand; PAM type: NRG; PAM sequence: TGG
cttactctgcccctccagag

SEQ ID NO: 14105 - DNA, 20 bp, Artificial Sequence
  Description of Artificial Sequence: Synthetic oligonucleotide
  Target: DMPK; (+) strand; PAM type: NRG; PAM sequence: TGG
actctgcccctccagagtgg

SEQ ID NO: 14106 - DNA, 20 bp, Artificial Sequence
  Description of Artificial Sequence: Synthetic oligonucleotide
  Target: DMPK; (+) strand; PAM type: NRG; PAM sequence: TAG
gcccctccagagtggtggca

SEQ ID NO: 14107 - DNA, 20 bp, Artificial Sequence
  Description of Artificial Sequence: Synthetic oligonucleotide
  Target: DMPK; (+) strand; PAM type: NRG; PAM sequence: AGG
cccctccagagtggtggcat

SEQ ID NO: 14108 - DNA, 20 bp, Artificial Sequence
  Description of Artificial Sequence: Synthetic oligonucleotide
  Target: DMPK; (+) strand; PAM type: NRG; PAM sequence: CAG
tccagagtggtggcatagga

SEQ ID NO: 14109 - DNA, 20 bp, Artificial Sequence
  Description of Artificial Sequence: Synthetic oligonucleotide
  Target: DMPK; (+) strand; PAM type: NRG; PAM sequence: GAG
cagagtggtggcataggaca

SEQ ID NO: 14110 - DNA, 20 bp, Artificial Sequence
  Description of Artificial Sequence: Synthetic oligonucleotide
  Target: DMPK; (+) strand; PAM type: NRG; PAM sequence: CAG
aggacagagaaatgttgccc

SEQ ID NO: 14111 - DNA, 20 bp, Artificial Sequence
  Description of Artificial Sequence: Synthetic oligonucleotide
  Target: DMPK; (+) strand; PAM type: NRG; PAM sequence: AGG
ggacagagaaatgttgcccc

SEQ ID NO: 14112 - DNA, 20 bp, Artificial Sequence
  Description of Artificial Sequence: Synthetic oligonucleotide
  Target: DMPK; (+) strand; PAM type: NRG; PAM sequence: GGG
gacagagaaatgttgcccca

SEQ ID NO: 14113 - DNA, 20 bp, Artificial Sequence
  Description of Artificial Sequence: Synthetic oligonucleotide
  Target: DMPK; (+) strand; PAM type: NRG; PAM sequence: CAG
agaaatgttgccccagggcc

SEQ ID NO: 14114 - DNA, 20 bp, Artificial Sequence
  Description of Artificial Sequence: Synthetic oligonucleotide
  Target: DMPK; (+) strand; PAM type: NRG; PAM sequence: AGG
gaaatgttgccccagggccc

SEQ ID NO: 14115 - DNA, 20 bp, Artificial Sequence
  Description of Artificial Sequence: Synthetic oligonucleotide
  Target: DMPK; (+) strand; PAM type: NRG; PAM sequence: GAG
agggcccaggtccacactct

SEQ ID NO: 14116 - DNA, 20 bp, Artificial Sequence
  Description of Artificial Sequence: Synthetic oligonucleotide
  Target: DMPK; (+) strand; PAM type: NRG; PAM sequence: CAG
caggtccacactctgagccc

SEQ ID NO: 14117 - DNA, 20 bp, Artificial Sequence
  Description of Artificial Sequence: Synthetic oligonucleotide
  Target: DMPK; (+) strand; PAM type: NRG; PAM sequence: AGG
aggtccacactctgagcccc

SEQ ID NO: 14118 - DNA, 20 bp, Artificial Sequence
  Description of Artificial Sequence: Synthetic oligonucleotide
  Target: DMPK; (+) strand; PAM type: NRG; PAM sequence: TGG
ccacactctgagccccagga

SEQ ID NO: 14119 - DNA, 20 bp, Artificial Sequence
  Description of Artificial Sequence: Synthetic oligonucleotide
  Target: DMPK; (+) strand; PAM type: NRG; PAM sequence: GGG
cacactctgagccccaggat

SEQ ID NO: 14120 - DNA, 20 bp, Artificial Sequence
  Description of Artificial Sequence: Synthetic oligonucleotide
  Target: DMPK; (+) strand; PAM type: NRG; PAM sequence: GAG
cactctgagccccaggatgg

SEQ ID NO: 14121 - DNA, 20 bp, Artificial Sequence
  Description of Artificial Sequence: Synthetic oligonucleotide
  Target: DMPK; (+) strand; PAM type: NRG; PAM sequence: AGG
actctgagccccaggatggg

SEQ ID NO: 14122 - DNA, 20 bp, Artificial Sequence
  Description of Artificial Sequence: Synthetic oligonucleotide
  Target: DMPK; (+) strand; PAM type: NRG; PAM sequence: CAG
ctgccatcctgcccccccaa

SEQ ID NO: 14123 - DNA, 20 bp, Artificial Sequence
  Description of Artificial Sequence: Synthetic oligonucleotide
  Target: DMPK; (+) strand; PAM type: NRG; PAM sequence: CAG
catcctgcccccccaacagc

SEQ ID NO: 14124 - DNA, 20 bp, Artificial Sequence
  Description of Artificial Sequence: Synthetic oligonucleotide
  Target: DMPK; (+) strand; PAM type: NRG; PAM sequence: AGG
atcctgcccccccaacagcc

SEQ ID NO: 14125 - DNA, 20 bp, Artificial Sequence
  Description of Artificial Sequence: Synthetic oligonucleotide
  Target: DMPK; (+) strand; PAM type: NRG; PAM sequence: CAG
aacagccaggcctctgtgcc

SEQ ID NO: 14126 - DNA, 20 bp, Artificial Sequence
  Description of Artificial Sequence: Synthetic oligonucleotide
  Target: DMPK; (+) strand; PAM type: NRG; PAM sequence: CAG
ccccacccccaccccatctg

SEQ ID NO: 14127 - DNA, 20 bp, Artificial Sequence
  Description of Artificial Sequence: Synthetic oligonucleotide
  Target: DMPK; (+) strand; PAM type: NRG; PAM sequence: AGG
cccacccccaccccatctgc

SEQ ID NO: 14128 - DNA, 20 bp, Artificial Sequence
  Description of Artificial Sequence: Synthetic oligonucleotide
  Target: DMPK; (+) strand; PAM type: NRG; PAM sequence: GAG
cacccccaccccatctgcag

SEQ ID NO: 14129 - DNA, 20 bp, Artificial Sequence
  Description of Artificial Sequence: Synthetic oligonucleotide
  Target: DMPK; (+) strand; PAM type: NRG; PAM sequence: GAG
accccatctgcaggagcccc

SEQ ID NO: 14130 - DNA, 20 bp, Artificial Sequence
  Description of Artificial Sequence: Synthetic oligonucleotide
  Target: DMPK; (+) strand; PAM type: NRG; PAM sequence: AGG
ccccatctgcaggagccccg

SEQ ID NO: 14131 - DNA, 20 bp, Artificial Sequence
  Description of Artificial Sequence: Synthetic oligonucleotide
  Target: DMPK; (+) strand; PAM type: NRG; PAM sequence: GGG
cccatctgcaggagccccga

SEQ ID NO: 14132 - DNA, 20 bp, Artificial Sequence
  Description of Artificial Sequence: Synthetic oligonucleotide
  Target: DMPK; (+) strand; PAM type: NRG; PAM sequence: TAG
atctgcaggagccccgaggg

SEQ ID NO: 14133 - DNA, 20 bp, Artificial Sequence
  Description of Artificial Sequence: Synthetic oligonucleotide
  Target: DMPK; (+) strand; PAM type: NRG; PAM sequence: AGG
tctgcaggagccccgagggt

SEQ ID NO: 14134 - DNA, 20 bp, Artificial Sequence
  Description of Artificial Sequence: Synthetic oligonucleotide
  Target: DMPK; (+) strand; PAM type: NRG; PAM sequence: AAG
gtaggcactcaccccactgc

SEQ ID NO: 14135 - DNA, 20 bp, Artificial Sequence
  Description of Artificial Sequence: Synthetic oligonucleotide
  Target: DMPK; (+) strand; PAM type: NRG; PAM sequence: AAG
ggcactcaccccactgcaag

SEQ ID NO: 14136 - DNA, 20 bp, Artificial Sequence
  Description of Artificial Sequence: Synthetic oligonucleotide
  Target: DMPK; (+) strand; PAM type: NRG; PAM sequence: CGG
ctcaccccactgcaagaagt

SEQ ID NO: 14137 - DNA, 20 bp, Artificial Sequence
  Description of Artificial Sequence: Synthetic oligonucleotide
  Target: DMPK; (+) strand; PAM type: NRG; PAM sequence: TGG
agtcggccacgtacttgtcc

SEQ ID NO: 14138 - DNA, 20 bp, Artificial Sequence
  Description of Artificial Sequence: Synthetic oligonucleotide
  Target: DMPK; (+) strand; PAM type: NRG; PAM sequence: GGG
gtcggccacgtacttgtcct

SEQ ID NO: 14139 - DNA, 20 bp, Artificial Sequence
  Description of Artificial Sequence: Synthetic oligonucleotide
  Target: DMPK; (+) strand; PAM type: NRG; PAM sequence: CAG
gccacgtacttgtcctgggc

SEQ ID NO: 14140 - DNA, 20 bp, Artificial Sequence
  Description of Artificial Sequence: Synthetic oligonucleotide
  Target: DMPK; (+) strand; PAM type: NRG; PAM sequence: CGG
gtacttgtcctgggccagtt

SEQ ID NO: 14141 - DNA, 20 bp, Artificial Sequence
  Description of Artificial Sequence: Synthetic oligonucleotide
  Target: DMPK; (+) strand; PAM type: NRG; PAM sequence: GAG
acttgtcctgggccagttcg

SEQ ID NO: 14142 - DNA, 20 bp, Artificial Sequence
  Description of Artificial Sequence: Synthetic oligonucleotide
  Target: DMPK; (+) strand; PAM type: NRG; PAM sequence: AGG
cttgtcctgggccagttcgg

SEQ ID NO: 14143 - DNA, 20 bp, Artificial Sequence
  Description of Artificial Sequence: Synthetic oligonucleotide
  Target: DMPK; (+) strand; PAM type: NRG; PAM sequence: CAG
tgggccagttcggaggcgcc

SEQ ID NO: 14144 - DNA, 20 bp, Artificial Sequence
  Description of Artificial Sequence: Synthetic oligonucleotide
  Target: DMPK; (+) strand; PAM type: NRG; PAM sequence: TGG
gttcggaggcgcccagctcc

SEQ ID NO: 14145 - DNA, 20 bp, Artificial Sequence
  Description of Artificial Sequence: Synthetic oligonucleotide
  Target: DMPK; (+) strand; PAM type: NRG; PAM sequence: TGG
cggaggcgcccagctcctgg

SEQ ID NO: 14146 - DNA, 20 bp, Artificial Sequence
  Description of Artificial Sequence: Synthetic oligonucleotide
  Target: DMPK; (+) strand; PAM type: NRG; PAM sequence: CAG
cccagctcctggtggacgcc

SEQ ID NO: 14147 - DNA, 20 bp, Artificial Sequence
  Description of Artificial Sequence: Synthetic oligonucleotide
  Target: DMPK; (+) strand; PAM type: NRG; PAM sequence: AGG
ccagctcctggtggacgccc

SEQ ID NO: 14148 - DNA, 20 bp, Artificial Sequence
  Description of Artificial Sequence: Synthetic oligonucleotide
  Target: DMPK; (+) strand; PAM type: NRG; PAM sequence: GAG
agctcctggtggacgcccag

SEQ ID NO: 14149 - DNA, 20 bp, Artificial Sequence
  Description of Artificial Sequence: Synthetic oligonucleotide
  Target: DMPK; (+) strand; PAM type: NRG; PAM sequence: AAG
tcctggtggacgcccaggag

SEQ ID NO: 14150 - DNA, 20 bp, Artificial Sequence
  Description of Artificial Sequence: Synthetic oligonucleotide
  Target: DMPK; (+) strand; PAM type: NRG; PAM sequence: AGG
cctggtggacgcccaggaga

SEQ ID NO: 14151 - DNA, 20 bp, Artificial Sequence
  Description of Artificial Sequence: Synthetic oligonucleotide
  Target: DMPK; (+) strand; PAM type: NRG; PAM sequence: GAG
tggacgcccaggagaaggtc

SEQ ID NO: 14152 - DNA, 20 bp, Artificial Sequence
  Description of Artificial Sequence: Synthetic oligonucleotide
  Target: DMPK; (+) strand; PAM type: NRG; PAM sequence: CAG
acgcccaggagaaggtcgag

SEQ ID NO: 14153 - DNA, 20 bp, Artificial Sequence
  Description of Artificial Sequence: Synthetic oligonucleotide
  Target: DMPK; (+) strand; PAM type: NRG; PAM sequence: AGG
cgcccaggagaaggtcgagc

SEQ ID NO: 14154 - DNA, 20 bp, Artificial Sequence
  Description of Artificial Sequence: Synthetic oligonucleotide
  Target: DMPK; (+) strand; PAM type: NRG; PAM sequence: GGG
gcccaggagaaggtcgagca

SEQ ID NO: 14155 - DNA, 20 bp, Artificial Sequence
  Description of Artificial Sequence: Synthetic oligonucleotide
  Target: DMPK; (+) strand; PAM type: NRG; PAM sequence: GGG
cccaggagaaggtcgagcag

SEQ ID NO: 14156 - DNA, 20 bp, Artificial Sequence
  Description of Artificial Sequence: Synthetic oligonucleotide
  Target: DMPK; (+) strand; PAM type: NRG; PAM sequence: CAG
agaaggtcgagcaggggctc

SEQ ID NO: 14157 - DNA, 20 bp, Artificial Sequence
  Description of Artificial Sequence: Synthetic oligonucleotide
  Target: DMPK; (+) strand; PAM type: NRG; PAM sequence: CAG
tcgagcaggggctccagccc

SEQ ID NO: 14158 - DNA, 20 bp, Artificial Sequence
  Description of Artificial Sequence: Synthetic oligonucleotide
  Target: DMPK; (+) strand; PAM type: NRG; PAM sequence: AGG
cgagcaggggctccagcccc

SEQ ID NO: 14159 - DNA, 20 bp, Artificial Sequence
  Description of Artificial Sequence: Synthetic oligonucleotide
  Target: DMPK; (+) strand; PAM type: NRG; PAM sequence: AAG
gcaggggctccagccccagg

SEQ ID NO: 14160 - DNA, 20 bp, Artificial Sequence
  Description of Artificial Sequence: Synthetic oligonucleotide
  Target: DMPK; (+) strand; PAM type: NRG; PAM sequence: CGG
ggctccagccccaggaagcc

SEQ ID NO: 14161 - DNA, 20 bp, Artificial Sequence
  Description of Artificial Sequence: Synthetic oligonucleotide
  Target: DMPK; (+) strand; PAM type: NRG; PAM sequence: GGG
gctccagccccaggaagccc

SEQ ID NO: 14162 - DNA, 20 bp, Artificial Sequence
  Description of Artificial Sequence: Synthetic oligonucleotide
  Target: DMPK; (+) strand; PAM type: NRG; PAM sequence: CAG
aggaagcccgggtccaacac

SEQ ID NO: 14163 - DNA, 20 bp, Artificial Sequence
  Description of Artificial Sequence: Synthetic oligonucleotide
  Target: DMPK; (+) strand; PAM type: NRG; PAM sequence: TGG
ccgggtccaacaccagctgc

SEQ ID NO: 14164 - DNA, 20 bp, Artificial Sequence
  Description of Artificial Sequence: Synthetic oligonucleotide
  Target: DMPK; (+) strand; PAM type: NRG; PAM sequence: GAG
gggtccaacaccagctgctg

SEQ ID NO: 14165 - DNA, 20 bp, Artificial Sequence
  Description of Artificial Sequence: Synthetic oligonucleotide
  Target: DMPK; (+) strand; PAM type: NRG; PAM sequence: CAG
accagctgctggagccgcct

SEQ ID NO: 14166 - DNA, 20 bp, Artificial Sequence
  Description of Artificial Sequence: Synthetic oligonucleotide
  Target: DMPK; (+) strand; PAM type: NRG; PAM sequence: CGG
gagccgcctcagccgcacct

SEQ ID NO: 14167 - DNA, 20 bp, Artificial Sequence
  Description of Artificial Sequence: Synthetic oligonucleotide
  Target: DMPK; (+) strand; PAM type: NRG; PAM sequence: TGG
ccgcacctcggctgacatgt

SEQ ID NO: 14168 - DNA, 20 bp, Artificial Sequence
  Description of Artificial Sequence: Synthetic oligonucleotide
  Target: DMPK; (+) strand; PAM type: NRG; PAM sequence: CAG
acctcggctgacatgttgga

SEQ ID NO: 14169 - DNA, 20 bp, Artificial Sequence
  Description of Artificial Sequence: Synthetic oligonucleotide
  Target: DMPK; (+) strand; PAM type: NRG; PAM sequence: AGG
cctcggctgacatgttggac

SEQ ID NO: 14170 - DNA, 20 bp, Artificial Sequence
  Description of Artificial Sequence: Synthetic oligonucleotide
  Target: DMPK; (+) strand; PAM type: NRG; PAM sequence: CAG
cggctgacatgttggacagg

SEQ ID NO: 14171 - DNA, 20 bp, Artificial Sequence
  Description of Artificial Sequence: Synthetic oligonucleotide
  Target: DMPK; (+) strand; PAM type: NRG; PAM sequence: TGG
atgttggacaggcagcacca

SEQ ID NO: 14172 - DNA, 20 bp, Artificial Sequence
  Description of Artificial Sequence: Synthetic oligonucleotide
  Target: DMPK; (+) strand; PAM type: NRG; PAM sequence: CGG
gcagcaccatggcccctccc

SEQ ID NO: 14173 - DNA, 20 bp, Artificial Sequence
  Description of Artificial Sequence: Synthetic oligonucleotide
  Target: DMPK; (+) strand; PAM type: NRG; PAM sequence: GGG
cagcaccatggcccctcccc

SEQ ID NO: 14174 - DNA, 20 bp, Artificial Sequence
  Description of Artificial Sequence: Synthetic oligonucleotide
  Target: DMPK; (+) strand; PAM type: NRG; PAM sequence: CGG
accatggcccctccccgggc

SEQ ID NO: 14175 - DNA, 20 bp, Artificial Sequence
  Description of Artificial Sequence: Synthetic oligonucleotide
  Target: DMPK; (+) strand; PAM type: NRG; PAM sequence: GGG
ccatggcccctccccgggcc

SEQ ID NO: 14176 - DNA, 20 bp, Artificial Sequence
  Description of Artificial Sequence: Synthetic oligonucleotide
  Target: DMPK; (+) strand; PAM type: NRG; PAM sequence: GGG
catggcccctccccgggccg

SEQ ID NO: 14177 - DNA, 20 bp, Artificial Sequence
  Description of Artificial Sequence: Synthetic oligonucleotide
  Target: DMPK; (+) strand; PAM type: NRG; PAM sequence: GGG
atggcccctccccgggccgg

SEQ ID NO: 14178 - DNA, 20 bp, Artificial Sequence
  Description of Artificial Sequence: Synthetic oligonucleotide
  Target: DMPK; (+) strand; PAM type: NRG; PAM sequence: CGG
ccctccccgggccgggggct

SEQ ID NO: 14179 - DNA, 20 bp, Artificial Sequence
  Description of Artificial Sequence: Synthetic oligonucleotide
  Target: DMPK; (+) strand; PAM type: NRG; PAM sequence: GGG
cctccccgggccgggggctc

SEQ ID NO: 14180 - DNA, 20 bp, Artificial Sequence
  Description of Artificial Sequence: Synthetic oligonucleotide
  Target: DMPK; (+) strand; PAM type: NRG; PAM sequence: GGG
ctccccgggccgggggctcg

SEQ ID NO: 14181 - DNA, 20 bp, Artificial Sequence
  Description of Artificial Sequence: Synthetic oligonucleotide
  Target: DMPK; (+) strand; PAM type: NRG; PAM sequence: CAG
ggctcggggtcctcctgtca

SEQ ID NO: 14182 - DNA, 20 bp, Artificial Sequence
  Description of Artificial Sequence: Synthetic oligonucleotide
  Target: DMPK; (+) strand; PAM type: NRG; PAM sequence: AGG
gctcggggtcctcctgtcac

SEQ ID NO: 14183 - DNA, 20 bp, Artificial Sequence
  Description of Artificial Sequence: Synthetic oligonucleotide
  Target: DMPK; (+) strand; PAM type: NRG; PAM sequence: GGG
ctcggggtcctcctgtcaca

SEQ ID NO: 14184 - DNA, 20 bp, Artificial Sequence
  Description of Artificial Sequence: Synthetic oligonucleotide
  Target: DMPK; (+) strand; PAM type: NRG; PAM sequence: TGG
ggtcctcctgtcacagggcc

SEQ ID NO: 14185 - DNA, 20 bp, Artificial Sequence
  Description of Artificial Sequence: Synthetic oligonucleotide
  Target: DMPK; (+) strand; PAM type: NRG; PAM sequence: CAG
cctcctgtcacagggcctgg

SEQ ID NO: 14186 - DNA, 20 bp, Artificial Sequence
  Description of Artificial Sequence: Synthetic oligonucleotide
  Target: DMPK; (+) strand; PAM type: NRG; PAM sequence: CAG
agggcctggcagcccctgtc

SEQ ID NO: 14187 - DNA, 20 bp, Artificial Sequence
  Description of Artificial Sequence: Synthetic oligonucleotide
  Target: DMPK; (+) strand; PAM type: NRG; PAM sequence: AGG
gggcctggcagcccctgtcc

SEQ ID NO: 14188 - DNA, 20 bp, Artificial Sequence
  Description of Artificial Sequence: Synthetic oligonucleotide
  Target: DMPK; (+) strand; PAM type: NRG; PAM sequence: TGG
ggcagcccctgtccaggccc

SEQ ID NO: 14189 - DNA, 20 bp, Artificial Sequence
  Description of Artificial Sequence: Synthetic oligonucleotide
  Target: DMPK; (+) strand; PAM type: NRG; PAM sequence: GAG
cagcccctgtccaggccctg

SEQ ID NO: 14190 - DNA, 20 bp, Artificial Sequence
  Description of Artificial Sequence: Synthetic oligonucleotide
  Target: DMPK; (+) strand; PAM type: NRG; PAM sequence: TGG
ctgtccaggccctggagccc

SEQ ID NO: 14191 - DNA, 20 bp, Artificial Sequence
  Description of Artificial Sequence: Synthetic oligonucleotide
  Target: DMPK; (+) strand; PAM type: NRG; PAM sequence: TGG
gctgcatgtctgcctgtccc

SEQ ID NO: 14192 - DNA, 20 bp, Artificial Sequence
  Description of Artificial Sequence: Synthetic oligonucleotide
  Target: DMPK; (+) strand; PAM type: NRG; PAM sequence: TGG
gcctgtccctggctgtcccc

SEQ ID NO: 14193 - DNA, 20 bp, Artificial Sequence
  Description of Artificial Sequence: Synthetic oligonucleotide
  Target: DMPK; (+) strand; PAM type: NRG; PAM sequence: GGG
cctgtccctggctgtcccct

SEQ ID NO: 14194 - DNA, 20 bp, Artificial Sequence
  Description of Artificial Sequence: Synthetic oligonucleotide
  Target: DMPK; (+) strand; PAM type: NRG; PAM sequence: TGG
ggctgtcccctgggcctctc

SEQ ID NO: 14195 - DNA, 20 bp, Artificial Sequence
  Description of Artificial Sequence: Synthetic oligonucleotide
  Target: DMPK; (+) strand; PAM type: NRG; PAM sequence: CGG
tctctggccacttctctctg

SEQ ID NO: 14196 - DNA, 20 bp, Artificial Sequence
  Description of Artificial Sequence: Synthetic oligonucleotide
  Target: DMPK; (+) strand; PAM type: NRG; PAM sequence: CGG
tggccacttctctctgcggc

SEQ ID NO: 14197 - DNA, 20 bp, Artificial Sequence
  Description of Artificial Sequence: Synthetic oligonucleotide
  Target: DMPK; (+) strand; PAM type: NRG; PAM sequence: GAG
acttctctctgcggccggcc

SEQ ID NO: 14198 - DNA, 20 bp, Artificial Sequence
  Description of Artificial Sequence: Synthetic oligonucleotide
  Target: DMPK; (+) strand; PAM type: NRG; PAM sequence: AGG
cttctctctgcggccggccg

SEQ ID NO: 14199 - DNA, 20 bp, Artificial Sequence
  Description of Artificial Sequence: Synthetic oligonucleotide
  Target: DMPK; (+) strand; PAM type: NRG; PAM sequence: TGG
ctccccttctccccacccct

SEQ ID NO: 14200 - DNA, 20 bp, Artificial Sequence
  Description of Artificial Sequence: Synthetic oligonucleotide
  Target: DMPK; (+) strand; PAM type: NRG; PAM sequence: CAG
cttctccccaccccttggtc

SEQ ID NO: 14201 - DNA, 20 bp, Artificial Sequence
  Description of Artificial Sequence: Synthetic oligonucleotide
  Target: DMPK; (+) strand; PAM type: NRG; PAM sequence: CAG
ccagcccccctcccgcctcc

SEQ ID NO: 14202 - DNA, 20 bp, Artificial Sequence
  Description of Artificial Sequence: Synthetic oligonucleotide
  Target: DMPK; (+) strand; PAM type: NRG; PAM sequence: AAG
tcccagccttaacccctcac

SEQ ID NO: 14203 - DNA, 20 bp, Artificial Sequence
  Description of Artificial Sequence: Synthetic oligonucleotide
  Target: DMPK; (+) strand; PAM type: NRG; PAM sequence: CAG
agccttaacccctcacaagc

SEQ ID NO: 14204 - DNA, 20 bp, Artificial Sequence
  Description of Artificial Sequence: Synthetic oligonucleotide
  Target: DMPK; (+) strand; PAM type: NRG; PAM sequence: AAG
ccctcacaagccagcccccc

SEQ ID NO: 14205 - DNA, 20 bp, Artificial Sequence
  Description of Artificial Sequence: Synthetic oligonucleotide
  Target: DMPK; (+) strand; PAM type: NRG; PAM sequence: CAG
ccccccaagctccctccttc

SEQ ID NO: 14206 - DNA, 20 bp, Artificial Sequence
  Description of Artificial Sequence: Synthetic oligonucleotide
  Target: DMPK; (+) strand; PAM type: NRG; PAM sequence: AGG
cccccaagctccctccttcc

SEQ ID NO: 14207 - DNA, 20 bp, Artificial Sequence
  Description of Artificial Sequence: Synthetic oligonucleotide
  Target: DMPK; (+) strand; PAM type: NRG; PAM sequence: GGG
ccccaagctccctccttcca

SEQ ID NO: 14208 - DNA, 20 bp, Artificial Sequence
  Description of Artificial Sequence: Synthetic oligonucleotide
  Target: DMPK; (+) strand; PAM type: NRG; PAM sequence: CAG
tccctccttccagggccctt

SEQ ID NO: 14209 - DNA, 20 bp, Artificial Sequence
  Description of Artificial Sequence: Synthetic oligonucleotide
  Target: DMPK; (+) strand; PAM type: NRG; PAM sequence: CAG
cagggcccttcagaaccctt

SEQ ID NO: 14210 - DNA, 20 bp, Artificial Sequence
  Description of Artificial Sequence: Synthetic oligonucleotide
  Target: DMPK; (+) strand; PAM type: NRG; PAM sequence: TAG
ccttcagaacccttcagtgc

SEQ ID NO: 14211 - DNA, 20 bp, Artificial Sequence
  Description of Artificial Sequence: Synthetic oligonucleotide
  Target: DMPK; (+) strand; PAM type: NRG; PAM sequence: GAG
ttcagaacccttcagtgcta

SEQ ID NO: 14212 - DNA, 20 bp, Artificial Sequence
  Description of Artificial Sequence: Synthetic oligonucleotide
  Target: DMPK; (+) strand; PAM type: NRG; PAM sequence: TAG
agaacccttcagtgctagag

SEQ ID NO: 14213 - DNA, 20 bp, Artificial Sequence
  Description of Artificial Sequence: Synthetic oligonucleotide
  Target: DMPK; (+) strand; PAM type: NRG; PAM sequence: AGG
gaacccttcagtgctagagt

SEQ ID NO: 14214 - DNA, 20 bp, Artificial Sequence
  Description of Artificial Sequence: Synthetic oligonucleotide
  Target: DMPK; (+) strand; PAM type: NRG; PAM sequence: GGG
aacccttcagtgctagagta

SEQ ID NO: 14215 - DNA, 20 bp, Artificial Sequence
  Description of Artificial Sequence: Synthetic oligonucleotide
  Target: DMPK; (+) strand; PAM type: NRG; PAM sequence: GGG
acccttcagtgctagagtag

SEQ ID NO: 14216 - DNA, 20 bp, Artificial Sequence
  Description of Artificial Sequence: Synthetic oligonucleotide
  Target: DMPK; (+) strand; PAM type: NRG; PAM sequence: GGG
cccttcagtgctagagtagg

SEQ ID NO: 14217 - DNA, 20 bp, Artificial Sequence
  Description of Artificial Sequence: Synthetic oligonucleotide
  Target: DMPK; (+) strand; PAM type: NRG; PAM sequence: TGG
gctagagtagggggaatgca

SEQ ID NO: 14218 - DNA, 20 bp, Artificial Sequence
  Description of Artificial Sequence: Synthetic oligonucleotide
  Target: DMPK; (+) strand; PAM type: NRG; PAM sequence: GAG
tagagtagggggaatgcatg

SEQ ID NO: 14219 - DNA, 20 bp, Artificial Sequence
  Description of Artificial Sequence: Synthetic oligonucleotide
  Target: DMPK; (+) strand; PAM type: NRG; PAM sequence: CAG
ggggaatgcatggagaatct

SEQ ID NO: 14220 - DNA, 20 bp, Artificial Sequence
  Description of Artificial Sequence: Synthetic oligonucleotide
  Target: DMPK; (+) strand; PAM type: NRG; PAM sequence: AAG
cacactgtcaccccaataaa

SEQ ID NO: 14221 - DNA, 20 bp, Artificial Sequence
  Description of Artificial Sequence: Synthetic oligonucleotide
  Target: DMPK; (+) strand; PAM type: NRG; PAM sequence: AGG
acactgtcaccccaataaaa

SEQ ID NO: 14222 - DNA, 20 bp, Artificial Sequence
  Description of Artificial Sequence: Synthetic oligonucleotide
  Target: DMPK; (+) strand; PAM type: NRG; PAM sequence: TAG
ctgtcaccccaataaaaagg

SEQ ID NO: 14223 - DNA, 20 bp, Artificial Sequence
  Description of Artificial Sequence: Synthetic oligonucleotide
  Target: DMPK; (+) strand; PAM type: NRG; PAM sequence: GAG
gtcaccccaataaaaaggta

SEQ ID NO: 14224 - DNA, 20 bp, Artificial Sequence
  Description of Artificial Sequence: Synthetic oligonucleotide
  Target: DMPK; (+) strand; PAM type: NRG; PAM sequence: CAG
cccaataaaaaggtagagca

SEQ ID NO: 14225 - DNA, 20 bp, Artificial Sequence
  Description of Artificial Sequence: Synthetic oligonucleotide
  Target: DMPK; (+) strand; PAM type: NRG; PAM sequence: GAG
caataaaaaggtagagcaca

SEQ ID NO: 14226 - DNA, 20 bp, Artificial Sequence
  Description of Artificial Sequence: Synthetic oligonucleotide
  Target: DMPK; (+) strand; PAM type: NRG; PAM sequence: AGG
aataaaaaggtagagcacag

SEQ ID NO: 14227 - DNA, 20 bp, Artificial Sequence
  Description of Artificial Sequence: Synthetic oligonucleotide
  Target: DMPK; (+) strand; PAM type: NRG; PAM sequence: AAG
aaaaaggtagagcacagagg

SEQ ID NO: 14228 - DNA, 20 bp, Artificial Sequence
  Description of Artificial Sequence: Synthetic oligonucleotide
  Target: DMPK; (+) strand; PAM type: NRG; PAM sequence: CAG
gtagagcacagaggaagcca

SEQ ID NO: 14229 - DNA, 20 bp, Artificial Sequence
  Description of Artificial Sequence: Synthetic oligonucleotide
  Target: DMPK; (+) strand; PAM type: NRG; PAM sequence: AGG
tagagcacagaggaagccac

SEQ ID NO: 14230 - DNA, 20 bp, Artificial Sequence
  Description of Artificial Sequence: Synthetic oligonucleotide
  Target: DMPK; (+) strand; PAM type: NRG; PAM sequence: AAG
ccacaggtgtgatgaatttc

SEQ ID NO: 14231 - DNA, 20 bp, Artificial Sequence
  Description of Artificial Sequence: Synthetic oligonucleotide
  Target: DMPK; (+) strand; PAM type: NRG; PAM sequence: AAG
caggtgtgatgaatttcaag

SEQ ID NO: 14232 - DNA, 20 bp, Artificial Sequence
  Description of Artificial Sequence: Synthetic oligonucleotide
  Target: DMPK; (+) strand; PAM type: NRG; PAM sequence: CAG
gaacctgcccattgctgaaa

SEQ ID NO: 14233 - DNA, 20 bp, Artificial Sequence
  Description of Artificial Sequence: Synthetic oligonucleotide
  Target: DMPK; (+) strand; PAM type: NRG; PAM sequence: AGG
aacctgcccattgctgaaac

SEQ ID NO: 14234 - DNA, 20 bp, Artificial Sequence
  Description of Artificial Sequence: Synthetic oligonucleotide
  Target: DMPK; (+) strand; PAM type: NRG; PAM sequence: GGG
acctgcccattgctgaaaca

SEQ ID NO: 14235 - DNA, 20 bp, Artificial Sequence
  Description of Artificial Sequence: Synthetic oligonucleotide
  Target: DMPK; (+) strand; PAM type: NRG; PAM sequence: GAG
ttgctgaaacagggccaatt

SEQ ID NO: 14236 - DNA, 20 bp, Artificial Sequence
  Description of Artificial Sequence: Synthetic oligonucleotide
  Target: DMPK; (+) strand; PAM type: NRG; PAM sequence: AGG
tgctgaaacagggccaattg

SEQ ID NO: 14237 - DNA, 20 bp, Artificial Sequence
  Description of Artificial Sequence: Synthetic oligonucleotide
  Target: DMPK; (+) strand; PAM type: NRG; PAM sequence: GAG
aaacagggccaattgaggct

SEQ ID NO: 14238 - DNA, 20 bp, Artificial Sequence
  Description of Artificial Sequence: Synthetic oligonucleotide
  Target: DMPK; (+) strand; PAM type: NRG; PAM sequence: CAG
ccaattgaggctgagtgacc

SEQ ID NO: 14239 - DNA, 20 bp, Artificial Sequence
  Description of Artificial Sequence: Synthetic oligonucleotide
  Target: DMPK; (+) strand; PAM type: NRG; PAM sequence: TAG
attgaggctgagtgacccag

SEQ ID NO: 14240 - DNA, 20 bp, Artificial Sequence
  Description of Artificial Sequence: Synthetic oligonucleotide
  Target: DMPK; (+) strand; PAM type: NRG; PAM sequence: AAG
accacccccttgctcccgac

SEQ ID NO: 14241 - DNA, 20 bp, Artificial Sequence
  Description of Artificial Sequence: Synthetic oligonucleotide
  Target: DMPK; (+) strand; PAM type: NRG; PAM sequence: CAG
cccttgctcccgacaagctc

SEQ ID NO: 14242 - DNA, 20 bp, Artificial Sequence
  Description of Artificial Sequence: Synthetic oligonucleotide
  Target: DMPK; (+) strand; PAM type: NRG; PAM sequence: TGG
ctcccgacaagctccagaac

SEQ ID NO: 14243 - DNA, 20 bp, Artificial Sequence
  Description of Artificial Sequence: Synthetic oligonucleotide
  Target: DMPK; (+) strand; PAM type: NRG; PAM sequence: GGG
tcccgacaagctccagaact

SEQ ID NO: 14244 - DNA, 20 bp, Artificial Sequence
  Description of Artificial Sequence: Synthetic oligonucleotide
  Target: DMPK; (+) strand; PAM type: NRG; PAM sequence: GGG
cccgacaagctccagaactg

SEQ ID NO: 14245 - DNA, 20 bp, Artificial Sequence
  Description of Artificial Sequence: Synthetic oligonucleotide
  Target: DMPK; (+) strand; PAM type: NRG; PAM sequence: GGG
ccgacaagctccagaactgg

SEQ ID NO: 14246 - DNA, 20 bp, Artificial Sequence
  Description of Artificial Sequence: Synthetic oligonucleotide
  Target: DMPK; (+) strand; PAM type: NRG; PAM sequence: TAG
caagctccagaactgggggc

SEQ ID NO: 14247 - DNA, 20 bp, Artificial Sequence
  Description of Artificial Sequence: Synthetic oligonucleotide
  Target: DMPK; (+) strand; PAM type: NRG; PAM sequence: AGG
aagctccagaactgggggct

SEQ ID NO: 14248 - DNA, 20 bp, Artificial Sequence
  Description of Artificial Sequence: Synthetic oligonucleotide
  Target: DMPK; (+) strand; PAM type: NRG; PAM sequence: GGG
agctccagaactgggggcta

SEQ ID NO: 14249 - DNA, 20 bp, Artificial Sequence
  Description of Artificial Sequence: Synthetic oligonucleotide
  Target: DMPK; (+) strand; PAM type: NRG; PAM sequence: GGG
gctccagaactgggggctag

SEQ ID NO: 14250 - DNA, 20 bp, Artificial Sequence
  Description of Artificial Sequence: Synthetic oligonucleotide
  Target: DMPK; (+) strand; PAM type: NRG; PAM sequence: GGG
ctccagaactgggggctagg

SEQ ID NO: 14251 - DNA, 20 bp, Artificial Sequence
  Description of Artificial Sequence: Synthetic oligonucleotide
  Target: DMPK; (+) strand; PAM type: NRG; PAM sequence: GAG
agaactgggggctagggggt

SEQ ID NO: 14252 - DNA, 20 bp, Artificial Sequence
  Description of Artificial Sequence: Synthetic oligonucleotide
  Target: DMPK; (+) strand; PAM type: NRG; PAM sequence: AGG
gaactgggggctagggggtg

SEQ ID NO: 14253 - DNA, 20 bp, Artificial Sequence
  Description of Artificial Sequence: Synthetic oligonucleotide
  Target: DMPK; (+) strand; PAM type: NRG; PAM sequence: GGG
aactgggggctagggggtga

SEQ ID NO: 14254 - DNA, 20 bp, Artificial Sequence
  Description of Artificial Sequence: Synthetic oligonucleotide
  Target: DMPK; (+) strand; PAM type: NRG; PAM sequence: TGG
gggggctagggggtgagggc

SEQ ID NO: 14255 - DNA, 20 bp, Artificial Sequence
  Description of Artificial Sequence: Synthetic oligonucleotide
  Target: DMPK; (+) strand; PAM type: NRG; PAM sequence: GGG
ggggctagggggtgagggct

SEQ ID NO: 14256 - DNA, 20 bp, Artificial Sequence
  Description of Artificial Sequence: Synthetic oligonucleotide
  Target: DMPK; (+) strand; PAM type: NRG; PAM sequence: GGG
gggctagggggtgagggctg

SEQ ID NO: 14257 - DNA, 20 bp, Artificial Sequence
  Description of Artificial Sequence: Synthetic oligonucleotide
  Target: DMPK; (+) strand; PAM type: NRG; PAM sequence: GGG
ggctagggggtgagggctgg

SEQ ID NO: 14258 - DNA, 20 bp, Artificial Sequence
  Description of Artificial Sequence: Synthetic oligonucleotide
  Target: DMPK; (+) strand; PAM type: NRG; PAM sequence: TGG
agggggtgagggctgggggt

SEQ ID NO: 14259 - DNA, 20 bp, Artificial Sequence
  Description of Artificial Sequence: Synthetic oligonucleotide
  Target: DMPK; (+) strand; PAM type: NRG; PAM sequence: GGG
gggggtgagggctgggggtt

SEQ ID NO: 14260 - DNA, 20 bp, Artificial Sequence
  Description of Artificial Sequence: Synthetic oligonucleotide
  Target: DMPK; (+) strand; PAM type: NRG; PAM sequence: GGG
ggggtgagggctgggggttg

SEQ ID NO: 14261 - DNA, 20 bp, Artificial Sequence
  Description of Artificial Sequence: Synthetic oligonucleotide
  Target: DMPK; (+) strand; PAM type: NRG; PAM sequence: TGG
tgagggctgggggttggggc

SEQ ID NO: 14262 - DNA, 20 bp, Artificial Sequence
  Description of Artificial Sequence: Synthetic oligonucleotide
  Target: DMPK; (+) strand; PAM type: NRG; PAM sequence: GGG
gagggctgggggttggggct

SEQ ID NO: 14263 - DNA, 20 bp, Artificial Sequence
  Description of Artificial Sequence: Synthetic oligonucleotide
  Target: DMPK; (+) strand; PAM type: NRG; PAM sequence: TGG
ggctgggggttggggctggg

SEQ ID NO: 14264 - DNA, 20 bp, Artificial Sequence
  Description of Artificial Sequence: Synthetic oligonucleotide
  Target: DMPK; (+) strand; PAM type: NRG; PAM sequence: GGG
gctgggggttggggctgggt

SEQ ID NO: 14265 - DNA, 20 bp, Artificial Sequence
  Description of Artificial Sequence: Synthetic oligonucleotide
  Target: DMPK; (+) strand; PAM type: NRG; PAM sequence: GAG
tgggggttggggctgggtgg

SEQ ID NO: 14266 - DNA, 20 bp, Artificial Sequence
  Description of Artificial Sequence: Synthetic oligonucleotide
  Target: DMPK; (+) strand; PAM type: NRG; PAM sequence: AAG
ggttggggctgggtgggaga

SEQ ID NO: 14267 - DNA, 20 bp, Artificial Sequence
  Description of Artificial Sequence: Synthetic oligonucleotide
  Target: DMPK; (+) strand; PAM type: NRG; PAM sequence: AGG
gttggggctgggtgggagaa

SEQ ID NO: 14268 - DNA, 20 bp, Artificial Sequence
  Description of Artificial Sequence: Synthetic oligonucleotide
  Target: DMPK; (+) strand; PAM type: NRG; PAM sequence: GGG
ttggggctgggtgggagaaa

SEQ ID NO: 14269 - DNA, 20 bp, Artificial Sequence
  Description of Artificial Sequence: Synthetic oligonucleotide
  Target: DMPK; (+) strand; PAM type: NRG; PAM sequence: GGG
tggggctgggtgggagaaag

SEQ ID NO: 14270 - DNA, 20 bp, Artificial Sequence
  Description of Artificial Sequence: Synthetic oligonucleotide
  Target: DMPK; (+) strand; PAM type: NRG; PAM sequence: GAG
ctgggtgggagaaaggggtt

SEQ ID NO: 14271 - DNA, 20 bp, Artificial Sequence
  Description of Artificial Sequence: Synthetic oligonucleotide
  Target: DMPK; (+) strand; PAM type: NRG; PAM sequence: AGG
tgggtgggagaaaggggttg

SEQ ID NO: 14272 - DNA, 20 bp, Artificial Sequence
  Description of Artificial Sequence: Synthetic oligonucleotide
  Target: DMPK; (+) strand; PAM type: NRG; PAM sequence: TGG
gggagaaaggggttgaggcc

SEQ ID NO: 14273 - DNA, 20 bp, Artificial Sequence
  Description of Artificial Sequence: Synthetic oligonucleotide
  Target: DMPK; (+) strand; PAM type: NRG; PAM sequence: GGG
ggagaaaggggttgaggcct

SEQ ID NO: 14274 - DNA, 20 bp, Artificial Sequence
  Description of Artificial Sequence: Synthetic oligonucleotide
  Target: DMPK; (+) strand; PAM type: NRG; PAM sequence: AAG
gaaaggggttgaggcctggg

SEQ ID NO: 14275 - DNA, 20 bp, Artificial Sequence
  Description of Artificial Sequence: Synthetic oligonucleotide
  Target: DMPK; (+) strand; PAM type: NRG; PAM sequence: AGG
aaaggggttgaggcctggga

SEQ ID NO: 14276 - DNA, 20 bp, Artificial Sequence
  Description of Artificial Sequence: Synthetic oligonucleotide
  Target: DMPK; (+) strand; PAM type: NRG; PAM sequence: GGG
aaggggttgaggcctgggaa

SEQ ID NO: 14277 - DNA, 20 bp, Artificial Sequence
  Description of Artificial Sequence: Synthetic oligonucleotide
  Target: DMPK; (+) strand; PAM type: NRG; PAM sequence: GGG
aggggttgaggcctgggaag

SEQ ID NO: 14278 - DNA, 20 bp, Artificial Sequence
  Description of Artificial Sequence: Synthetic oligonucleotide
  Target: DMPK; (+) strand; PAM type: NRG; PAM sequence: CGG
gttgaggcctgggaagggga

SEQ ID NO: 14279 - DNA, 20 bp, Artificial Sequence
  Description of Artificial Sequence: Synthetic oligonucleotide
  Target: DMPK; (+) strand; PAM type: NRG; PAM sequence: GGG
ttgaggcctgggaaggggac

SEQ ID NO: 14280 - DNA, 20 bp, Artificial Sequence
  Description of Artificial Sequence: Synthetic oligonucleotide
  Target: DMPK; (+) strand; PAM type: NRG; PAM sequence: GAG
gaggcctgggaaggggacgg

SEQ ID NO: 14281 - DNA, 20 bp, Artificial Sequence
  Description of Artificial Sequence: Synthetic oligonucleotide
  Target: DMPK; (+) strand; PAM type: NRG; PAM sequence: AGG
aggcctgggaaggggacggg

SEQ ID NO: 14282 - DNA, 20 bp, Artificial Sequence
  Description of Artificial Sequence: Synthetic oligonucleotide
  Target: DMPK; (+) strand; PAM type: NRG; PAM sequence: CAG
ctgggaaggggacgggaggc

SEQ ID NO: 14283 - DNA, 20 bp, Artificial Sequence
  Description of Artificial Sequence: Synthetic oligonucleotide
  Target: DMPK; (+) strand; PAM type: NRG; PAM sequence: AGG
tgggaaggggacgggaggcc

SEQ ID NO: 14284 - DNA, 20 bp, Artificial Sequence
  Description of Artificial Sequence: Synthetic oligonucleotide
  Target: DMPK; (+) strand; PAM type: NRG; PAM sequence: GGG
gggaaggggacgggaggcca

SEQ ID NO: 14285 - DNA, 20 bp, Artificial Sequence
  Description of Artificial Sequence: Synthetic oligonucleotide
  Target: DMPK; (+) strand; PAM type: NRG; PAM sequence: CAG
aaggggacgggaggccaggg

SEQ ID NO: 14286 - DNA, 20 bp, Artificial Sequence
  Description of Artificial Sequence: Synthetic oligonucleotide
  Target: DMPK; (+) strand; PAM type: NRG; PAM sequence: TGG
gggaggccagggcagcttct

SEQ ID NO: 14287 - DNA, 20 bp, Artificial Sequence
  Description of Artificial Sequence: Synthetic oligonucleotide
  Target: DMPK; (+) strand; PAM type: NRG; PAM sequence: GGG
ggaggccagggcagcttctt

SEQ ID NO: 14288 - DNA, 20 bp, Artificial Sequence
  Description of Artificial Sequence: Synthetic oligonucleotide
  Target: DMPK; (+) strand; PAM type: NRG; PAM sequence: CAG
gggcagcttcttgggtgact

SEQ ID NO: 14289 - DNA, 20 bp, Artificial Sequence
  Description of Artificial Sequence: Synthetic oligonucleotide
  Target: DMPK; (+) strand; PAM type: NRG; PAM sequence: GAG
gcagcttcttgggtgactca

SEQ ID NO: 14290 - DNA, 20 bp, Artificial Sequence
  Description of Artificial Sequence: Synthetic oligonucleotide
  Target: DMPK; (+) strand; PAM type: NRG; PAM sequence: TGG
cttcttgggtgactcagaga

SEQ ID NO: 14291 - DNA, 20 bp, Artificial Sequence
  Description of Artificial Sequence: Synthetic oligonucleotide
  Target: DMPK; (+) strand; PAM type: NRG; PAM sequence: CGG
ctcagagatggattccgact

SEQ ID NO: 14292 - DNA, 20 bp, Artificial Sequence
  Description of Artificial Sequence: Synthetic oligonucleotide
  Target: DMPK; (+) strand; PAM type: NRG; PAM sequence: CAG
gagatggattccgactcgga

SEQ ID NO: 14293 - DNA, 20 bp, Artificial Sequence
  Description of Artificial Sequence: Synthetic oligonucleotide
  Target: DMPK; (+) strand; PAM type: NRG; PAM sequence: TAG
ccgactcggacagttaaatt

SEQ ID NO: 14294 - DNA, 20 bp, Artificial Sequence
  Description of Artificial Sequence: Synthetic oligonucleotide
  Target: DMPK; (+) strand; PAM type: NRG; PAM sequence: CAG
ggacagttaaatttagccct

SEQ ID NO: 14295 - DNA, 20 bp, Artificial Sequence
  Description of Artificial Sequence: Synthetic oligonucleotide
  Target: DMPK; (+) strand; PAM type: NRG; PAM sequence: AGG
gacagttaaatttagccctc

SEQ ID NO: 14296 - DNA, 20 bp, Artificial Sequence
  Description of Artificial Sequence: Synthetic oligonucleotide
  Target: DMPK; (+) strand; PAM type: NRG; PAM sequence: CAG
tcaggctctctgctttatac

SEQ ID NO: 14297 - DNA, 20 bp, Artificial Sequence
  Description of Artificial Sequence: Synthetic oligonucleotide
  Target: DMPK; (+) strand; PAM type: NRG; PAM sequence: CAG
ttttttttttttttttttcc

SEQ ID NO: 14298 - DNA, 20 bp, Artificial Sequence
  Description of Artificial Sequence: Synthetic oligonucleotide
  Target: DMPK; (+) strand; PAM type: NRG; PAM sequence: AGG
tttttttttttttttttccc

SEQ ID NO: 14299 - DNA, 20 bp, Artificial Sequence
  Description of Artificial Sequence: Synthetic oligonucleotide
  Target: DMPK; (+) strand; PAM type: NRG; PAM sequence: GAG
tttttttttttttttcccag

SEQ ID NO: 14300 - DNA, 20 bp, Artificial Sequence
  Description of Artificial Sequence: Synthetic oligonucleotide
  Target: DMPK; (+) strand; PAM type: NRG; PAM sequence: AGG
ttttttttttttttcccagg

SEQ ID NO: 14301 - DNA, 20 bp, Artificial Sequence
  Description of Artificial Sequence: Synthetic oligonucleotide
  Target: DMPK; (+) strand; PAM type: NRG; PAM sequence: TGG
tttttttttttcccaggagg

SEQ ID NO: 14302 - DNA, 20 bp, Artificial Sequence
  Description of Artificial Sequence: Synthetic oligonucleotide
  Target: DMPK; (+) strand; PAM type: NRG; PAM sequence: GGG
ttttttttttcccaggaggt

SEQ ID NO: 14303 - DNA, 20 bp, Artificial Sequence
  Description of Artificial Sequence: Synthetic oligonucleotide
  Target: DMPK; (+) strand; PAM type: NRG; PAM sequence: GGG
tttttttttcccaggaggtg

SEQ ID NO: 14304 - DNA, 20 bp, Artificial Sequence
  Description of Artificial Sequence: Synthetic oligonucleotide
  Target: DMPK; (+) strand; PAM type: NRG; PAM sequence: AAG
ttttttcccaggaggtgggg

SEQ ID NO: 14305 - DNA, 20 bp, Artificial Sequence
  Description of Artificial Sequence: Synthetic oligonucleotide
  Target: DMPK; (+) strand; PAM type: NRG; PAM sequence: AGG
tttttcccaggaggtgggga

SEQ ID NO: 14306 - DNA, 20 bp, Artificial Sequence
  Description of Artificial Sequence: Synthetic oligonucleotide
  Target: DMPK; (+) strand; PAM type: NRG; PAM sequence: GGG
ttttcccaggaggtggggaa

SEQ ID NO: 14307 - DNA, 20 bp, Artificial Sequence
  Description of Artificial Sequence: Synthetic oligonucleotide
  Target: DMPK; (+) strand; PAM type: NRG; PAM sequence: GGG
tttcccaggaggtggggaag

SEQ ID NO: 14308 - DNA, 20 bp, Artificial Sequence
  Description of Artificial Sequence: Synthetic oligonucleotide
  Target: DMPK; (+) strand; PAM type: NRG; PAM sequence: TGG
cccaggaggtggggaagggg

SEQ ID NO: 14309 - DNA, 20 bp, Artificial Sequence
  Description of Artificial Sequence: Synthetic oligonucleotide
  Target: DMPK; (+) strand; PAM type: NRG; PAM sequence: GAG
ggaggtggggaaggggtggt

SEQ ID NO: 14310 - DNA, 20 bp, Artificial Sequence
  Description of Artificial Sequence: Synthetic oligonucleotide
  Target: DMPK; (+) strand; PAM type: NRG; PAM sequence: AGG
gaggtggggaaggggtggtg

SEQ ID NO: 14311 - DNA, 20 bp, Artificial Sequence
  Description of Artificial Sequence: Synthetic oligonucleotide
  Target: DMPK; (+) strand; PAM type: NRG; PAM sequence: CAG
tggggaaggggtggtgagga

SEQ ID NO: 14312 - DNA, 20 bp, Artificial Sequence
  Description of Artificial Sequence: Synthetic oligonucleotide
  Target: DMPK; (+) strand; PAM type: NRG; PAM sequence: AGG
ggggaaggggtggtgaggac

SEQ ID NO: 14313 - DNA, 20 bp, Artificial Sequence
  Description of Artificial Sequence: Synthetic oligonucleotide
  Target: DMPK; (+) strand; PAM type: NRG; PAM sequence: CAG
aggggtggtgaggacaggac

SEQ ID NO: 14314 - DNA, 20 bp, Artificial Sequence
  Description of Artificial Sequence: Synthetic oligonucleotide
  Target: DMPK; (+) strand; PAM type: NRG; PAM sequence: AGG
ggggtggtgaggacaggacc

SEQ ID NO: 14315 - DNA, 20 bp, Artificial Sequence
  Description of Artificial Sequence: Synthetic oligonucleotide
  Target: DMPK; (+) strand; PAM type: NRG; PAM sequence: GAG
ggtggtgaggacaggaccag

SEQ ID NO: 14316 - DNA, 20 bp, Artificial Sequence
  Description of Artificial Sequence: Synthetic oligonucleotide
  Target: DMPK; (+) strand; PAM type: NRG; PAM sequence: AGG
gtggtgaggacaggaccagg

SEQ ID NO: 14317 - DNA, 20 bp, Artificial Sequence
  Description of Artificial Sequence: Synthetic oligonucleotide
  Target: DMPK; (+) strand; PAM type: NRG; PAM sequence: GGG
tggtgaggacaggaccagga

SEQ ID NO: 14318 - DNA, 20 bp, Artificial Sequence
  Description of Artificial Sequence: Synthetic oligonucleotide
  Target: DMPK; (+) strand; PAM type: NRG; PAM sequence: GGG
ggtgaggacaggaccaggag

SEQ ID NO: 14319 - DNA, 20 bp, Artificial Sequence
  Description of Artificial Sequence: Synthetic oligonucleotide
  Target: DMPK; (+) strand; PAM type: NRG; PAM sequence: GGG
gtgaggacaggaccaggagg

SEQ ID NO: 14320 - DNA, 20 bp, Artificial Sequence
  Description of Artificial Sequence: Synthetic oligonucleotide
  Target: DMPK; (+) strand; PAM type: NRG; PAM sequence: CAG
ggaccaggagggggcaccct

SEQ ID NO: 14321 - DNA, 20 bp, Artificial Sequence
  Description of Artificial Sequence: Synthetic oligonucleotide
  Target: DMPK; (+) strand; PAM type: NRG; PAM sequence: GAG
accaggagggggcaccctca

SEQ ID NO: 14322 - DNA, 20 bp, Artificial Sequence
  Description of Artificial Sequence: Synthetic oligonucleotide
  Target: DMPK; (+) strand; PAM type: NRG; PAM sequence: CAG
gggcaccctcagagcctgaa

SEQ ID NO: 14323 - DNA, 20 bp, Artificial Sequence
  Description of Artificial Sequence: Synthetic oligonucleotide
  Target: DMPK; (+) strand; PAM type: NRG; PAM sequence: AGG
ggcaccctcagagcctgaac

SEQ ID NO: 14324 - DNA, 20 bp, Artificial Sequence
  Description of Artificial Sequence: Synthetic oligonucleotide
  Target: DMPK; (+) strand; PAM type: NRG; PAM sequence: GGG
gcaccctcagagcctgaaca

SEQ ID NO: 14325 - DNA, 20 bp, Artificial Sequence
  Description of Artificial Sequence: Synthetic oligonucleotide
  Target: DMPK; (+) strand; PAM type: NRG; PAM sequence: GGG
caccctcagagcctgaacag

SEQ ID NO: 14326 - DNA, 20 bp, Artificial Sequence
  Description of Artificial Sequence: Synthetic oligonucleotide
  Target: DMPK; (+) strand; PAM type: NRG; PAM sequence: AAG
caggggtgacctgctgccca

SEQ ID NO: 14327 - DNA, 20 bp, Artificial Sequence
  Description of Artificial Sequence: Synthetic oligonucleotide
  Target: DMPK; (+) strand; PAM type: NRG; PAM sequence: AGG
aggggtgacctgctgcccaa

SEQ ID NO: 14328 - DNA, 20 bp, Artificial Sequence
  Description of Artificial Sequence: Synthetic oligonucleotide
  Target: DMPK; (+) strand; PAM type: NRG; PAM sequence: TGG
gtgacctgctgcccaaaggc

SEQ ID NO: 14329 - DNA, 20 bp, Artificial Sequence
  Description of Artificial Sequence: Synthetic oligonucleotide
  Target: DMPK; (+) strand; PAM type: NRG; PAM sequence: GGG
tgacctgctgcccaaaggct

SEQ ID NO: 14330 - DNA, 20 bp, Artificial Sequence
  Description of Artificial Sequence: Synthetic oligonucleotide
  Target: DMPK; (+) strand; PAM type: NRG; PAM sequence: GGG
gacctgctgcccaaaggctg

SEQ ID NO: 14331 - DNA, 20 bp, Artificial Sequence
  Description of Artificial Sequence: Synthetic oligonucleotide
  Target: DMPK; (+) strand; PAM type: NRG; PAM sequence: GGG
acctgctgcccaaaggctgg

SEQ ID NO: 14332 - DNA, 20 bp, Artificial Sequence
  Description of Artificial Sequence: Synthetic oligonucleotide
  Target: DMPK; (+) strand; PAM type: NRG; PAM sequence: GAG
ctgctgcccaaaggctgggg

SEQ ID NO: 14333 - DNA, 20 bp, Artificial Sequence
  Description of Artificial Sequence: Synthetic oligonucleotide
  Target: DMPK; (+) strand; PAM type: NRG; PAM sequence: AGG
tgctgcccaaaggctggggg

SEQ ID NO: 14334 - DNA, 20 bp, Artificial Sequence
  Description of Artificial Sequence: Synthetic oligonucleotide
  Target: DMPK; (+) strand; PAM type: NRG; PAM sequence: AAG
gcccaaaggctgggggagga

SEQ ID NO: 14335 - DNA, 20 bp, Artificial Sequence
  Description of Artificial Sequence: Synthetic oligonucleotide
  Target: DMPK; (+) strand; PAM type: NRG; PAM sequence: TGG
caaaggctgggggaggaaag

SEQ ID NO: 14336 - DNA, 20 bp, Artificial Sequence
  Description of Artificial Sequence: Synthetic oligonucleotide
  Target: DMPK; (+) strand; PAM type: NRG; PAM sequence: TGG
aggctgggggaggaaagtgg

SEQ ID NO: 14337 - DNA, 20 bp, Artificial Sequence
  Description of Artificial Sequence: Synthetic oligonucleotide
  Target: DMPK; (+) strand; PAM type: NRG; PAM sequence: GAG
gctgggggaggaaagtggtg

SEQ ID NO: 14338 - DNA, 20 bp, Artificial Sequence
  Description of Artificial Sequence: Synthetic oligonucleotide
  Target: DMPK; (+) strand; PAM type: NRG; PAM sequence: AAG
gggaggaaagtggtggagcc

SEQ ID NO: 14339 - DNA, 20 bp, Artificial Sequence
  Description of Artificial Sequence: Synthetic oligonucleotide
  Target: DMPK; (+) strand; PAM type: NRG; PAM sequence: TGG
tggtggagccaagccctccc

SEQ ID NO: 14340 - DNA, 20 bp, Artificial Sequence
  Description of Artificial Sequence: Synthetic oligonucleotide
  Target: DMPK; (+) strand; PAM type: NRG; PAM sequence: GGG
ggtggagccaagccctccct

SEQ ID NO: 14341 - DNA, 20 bp, Artificial Sequence
  Description of Artificial Sequence: Synthetic oligonucleotide
  Target: DMPK; (+) strand; PAM type: NRG; PAM sequence: GAG
caagccctccctgggcaaac

SEQ ID NO: 14342 - DNA, 20 bp, Artificial Sequence
  Description of Artificial Sequence: Synthetic oligonucleotide
  Target: DMPK; (+) strand; PAM type: NRG; PAM sequence: TAG
gggcaaacgagaccccaaaa

SEQ ID NO: 14343 - DNA, 20 bp, Artificial Sequence
  Description of Artificial Sequence: Synthetic oligonucleotide
  Target: DMPK; (+) strand; PAM type: NRG; PAM sequence: TGG
gagaccccaaaatagctcct

SEQ ID NO: 14344 - DNA, 20 bp, Artificial Sequence
  Description of Artificial Sequence: Synthetic oligonucleotide
  Target: DMPK; (+) strand; PAM type: NRG; PAM sequence: TGG
caaaatagctccttggcccc

SEQ ID NO: 14345 - DNA, 20 bp, Artificial Sequence
  Description of Artificial Sequence: Synthetic oligonucleotide
  Target: DMPK; (+) strand; PAM type: NRG; PAM sequence: CGG
atagctccttggcccctggc

SEQ ID NO: 14346 - DNA, 20 bp, Artificial Sequence
  Description of Artificial Sequence: Synthetic oligonucleotide
  Target: DMPK; (+) strand; PAM type: NRG; PAM sequence: GGG
tagctccttggcccctggcc

SEQ ID NO: 14347 - DNA, 20 bp, Artificial Sequence
  Description of Artificial Sequence: Synthetic oligonucleotide
  Target: DMPK; (+) strand; PAM type: NRG; PAM sequence: GGG
agctccttggcccctggccg

SEQ ID NO: 14348 - DNA, 20 bp, Artificial Sequence
  Description of Artificial Sequence: Synthetic oligonucleotide
  Target: DMPK; (+) strand; PAM type: NRG; PAM sequence: GAG
ctccttggcccctggccggg

SEQ ID NO: 14349 - DNA, 20 bp, Artificial Sequence
  Description of Artificial Sequence: Synthetic oligonucleotide
  Target: DMPK; (+) strand; PAM type: NRG; PAM sequence: CAG
cggggagccacattcctgcc

SEQ ID NO: 14350 - DNA, 20 bp, Artificial Sequence
  Description of Artificial Sequence: Synthetic oligonucleotide
  Target: DMPK; (+) strand; PAM type: NRG; PAM sequence: AGG
ggggagccacattcctgccc

SEQ ID NO: 14351 - DNA, 20 bp, Artificial Sequence
  Description of Artificial Sequence: Synthetic oligonucleotide
  Target: DMPK; (+) strand; PAM type: NRG; PAM sequence: TGG
agccacattcctgcccaggc

SEQ ID NO: 14352 - DNA, 20 bp, Artificial Sequence
  Description of Artificial Sequence: Synthetic oligonucleotide
  Target: DMPK; (+) strand; PAM type: NRG; PAM sequence: GGG
gccacattcctgcccaggct

SEQ ID NO: 14353 - DNA, 20 bp, Artificial Sequence
  Description of Artificial Sequence: Synthetic oligonucleotide
  Target: DMPK; (+) strand; PAM type: NRG; PAM sequence: TAG
attcctgcccaggctgggat

SEQ ID NO: 14354 - DNA, 20 bp, Artificial Sequence
  Description of Artificial Sequence: Synthetic oligonucleotide
  Target: DMPK; (+) strand; PAM type: NRG; PAM sequence: CAG
gcccaggctgggattagaaa

SEQ ID NO: 14355 - DNA, 20 bp, Artificial Sequence
  Description of Artificial Sequence: Synthetic oligonucleotide
  Target: DMPK; (+) strand; PAM type: NRG; PAM sequence: CGG
gattagaaacagaaacattt

SEQ ID NO: 14356 - DNA, 20 bp, Artificial Sequence
  Description of Artificial Sequence: Synthetic oligonucleotide
  Target: DMPK; (+) strand; PAM type: NRG; PAM sequence: GGG
attagaaacagaaacatttc

SEQ ID NO: 14357 - DNA, 20 bp, Artificial Sequence
  Description of Artificial Sequence: Synthetic oligonucleotide
  Target: DMPK; (+) strand; PAM type: NRG; PAM sequence: GGG
ttagaaacagaaacatttcg

SEQ ID NO: 14358 - DNA, 20 bp, Artificial Sequence
  Description of Artificial Sequence: Synthetic oligonucleotide
  Target: DMPK; (+) strand; PAM type: NRG; PAM sequence: GGG
tagaaacagaaacatttcgg

SEQ ID NO: 14359 - DNA, 20 bp, Artificial Sequence
  Description of Artificial Sequence: Synthetic oligonucleotide
  Target: DMPK; (+) strand; PAM type: NRG; PAM sequence: GGG
agaaacagaaacatttcggg

SEQ ID NO: 14360 - DNA, 20 bp, Artificial Sequence
  Description of Artificial Sequence: Synthetic oligonucleotide
  Target: DMPK; (+) strand; PAM type: NRG; PAM sequence: TGG
aacagaaacatttcgggggg

SEQ ID NO: 14361 - DNA, 20 bp, Artificial Sequence
  Description of Artificial Sequence: Synthetic oligonucleotide
  Target: DMPK; (+) strand; PAM type: NRG; PAM sequence: GAG
cagaaacatttcggggggtg

SEQ ID NO: 14362 - DNA, 20 bp, Artificial Sequence
  Description of Artificial Sequence: Synthetic oligonucleotide
  Target: DMPK; (+) strand; PAM type: NRG; PAM sequence: AGG
agaaacatttcggggggtgg

SEQ ID NO: 14363 - DNA, 20 bp, Artificial Sequence
  Description of Artificial Sequence: Synthetic oligonucleotide
  Target: DMPK; (+) strand; PAM type: NRG; PAM sequence: GGG
gaaacatttcggggggtgga

SEQ ID NO: 14364 - DNA, 20 bp, Artificial Sequence
  Description of Artificial Sequence: Synthetic oligonucleotide
  Target: DMPK; (+) strand; PAM type: NRG; PAM sequence: TGG
acatttcggggggtggaggg

SEQ ID NO: 14365 - DNA, 20 bp, Artificial Sequence
  Description of Artificial Sequence: Synthetic oligonucleotide
  Target: DMPK; (+) strand; PAM type: NRG; PAM sequence: CGG
tcggggggtggagggtggcg

SEQ ID NO: 14366 - DNA, 20 bp, Artificial Sequence
  Description of Artificial Sequence: Synthetic oligonucleotide
  Target: DMPK; (+) strand; PAM type: NRG; PAM sequence: GGG
cggggggtggagggtggcgc

SEQ ID NO: 14367 - DNA, 20 bp, Artificial Sequence
  Description of Artificial Sequence: Synthetic oligonucleotide
  Target: DMPK; (+) strand; PAM type: NRG; PAM sequence: AAG
ggggtggagggtggcgcggg

SEQ ID NO: 14368 - DNA, 20 bp, Artificial Sequence
  Description of Artificial Sequence: Synthetic oligonucleotide
  Target: DMPK; (+) strand; PAM type: NRG; PAM sequence: CGG
gcgggaagacacactccctg

SEQ ID NO: 14369 - DNA, 20 bp, Artificial Sequence
  Description of Artificial Sequence: Synthetic oligonucleotide
  Target: DMPK; (+) strand; PAM type: NRG; PAM sequence: GAG
gacacactccctgcggctcc

SEQ ID NO: 14370 - DNA, 20 bp, Artificial Sequence
  Description of Artificial Sequence: Synthetic oligonucleotide
  Target: DMPK; (+) strand; PAM type: NRG; PAM sequence: GAG
cacactccctgcggctccga

SEQ ID NO: 14371 - DNA, 20 bp, Artificial Sequence
  Description of Artificial Sequence: Synthetic oligonucleotide
  Target: DMPK; (+) strand; PAM type: NRG; PAM sequence: AAG
tccctgcggctccgagagcc

SEQ ID NO: 14372 - DNA, 20 bp, Artificial Sequence
  Description of Artificial Sequence: Synthetic oligonucleotide
  Target: DMPK; (+) strand; PAM type: NRG; PAM sequence: GAG
cctgcggctccgagagccaa

SEQ ID NO: 14373 - DNA, 20 bp, Artificial Sequence
  Description of Artificial Sequence: Synthetic oligonucleotide
  Target: DMPK; (+) strand; PAM type: NRG; PAM sequence: AGG
ctgcggctccgagagccaag

SEQ ID NO: 14374 - DNA, 20 bp, Artificial Sequence
  Description of Artificial Sequence: Synthetic oligonucleotide
  Target: DMPK; (+) strand; PAM type: NRG; PAM sequence: GAG
ccgagagccaagaggaatct

SEQ ID NO: 14375 - DNA, 20 bp, Artificial Sequence
  Description of Artificial Sequence: Synthetic oligonucleotide
  Target: DMPK; (+) strand; PAM type: NRG; PAM sequence: CAG
ggaatctgagctcttctttc

SEQ ID NO: 14376 - DNA, 20 bp, Artificial Sequence
  Description of Artificial Sequence: Synthetic oligonucleotide
  Target: DMPK; (+) strand; PAM type: NRG; PAM sequence: AGG
gaatctgagctcttctttcc

SEQ ID NO: 14377 - DNA, 20 bp, Artificial Sequence
  Description of Artificial Sequence: Synthetic oligonucleotide
  Target: DMPK; (+) strand; PAM type: NRG; PAM sequence: GGG
aatctgagctcttctttcca

SEQ ID NO: 14378 - DNA, 20 bp, Artificial Sequence
  Description of Artificial Sequence: Synthetic oligonucleotide
  Target: DMPK; (+) strand; PAM type: NRG; PAM sequence: TGG
ctgagctcttctttccaggg

SEQ ID NO: 14379 - DNA, 20 bp, Artificial Sequence
  Description of Artificial Sequence: Synthetic oligonucleotide
  Target: DMPK; (+) strand; PAM type: NRG; PAM sequence: CGG
gctcttctttccagggtgga

SEQ ID NO: 14380 - DNA, 20 bp, Artificial Sequence
  Description of Artificial Sequence: Synthetic oligonucleotide
  Target: DMPK; (+) strand; PAM type: NRG; PAM sequence: CAG
ttccagggtggacggttctc

SEQ ID NO: 14381 - DNA, 20 bp, Artificial Sequence
  Description of Artificial Sequence: Synthetic oligonucleotide
  Target: DMPK; (+) strand; PAM type: NRG; PAM sequence: GAG
ccagggtggacggttctcca

SEQ ID NO: 14382 - DNA, 20 bp, Artificial Sequence
  Description of Artificial Sequence: Synthetic oligonucleotide
  Target: DMPK; (+) strand; PAM type: NRG; PAM sequence: TGG
gggtggacggttctccagag

SEQ ID NO: 14383 - DNA, 20 bp, Artificial Sequence
  Description of Artificial Sequence: Synthetic oligonucleotide
  Target: DMPK; (+) strand; PAM type: NRG; PAM sequence: AAG
tggacggttctccagagtgg

SEQ ID NO: 14384 - DNA, 20 bp, Artificial Sequence
  Description of Artificial Sequence: Synthetic oligonucleotide
  Target: DMPK; (+) strand; PAM type: NRG; PAM sequence: CGG
cggttctccagagtggaagt

SEQ ID NO: 14385 - DNA, 20 bp, Artificial Sequence
  Description of Artificial Sequence: Synthetic oligonucleotide
  Target: DMPK; (+) strand; PAM type: NRG; PAM sequence: GGG
ggttctccagagtggaagtc

SEQ ID NO: 14386 - DNA, 20 bp, Artificial Sequence
  Description of Artificial Sequence: Synthetic oligonucleotide
  Target: DMPK; (+) strand; PAM type: NRG; PAM sequence: GGG
gttctccagagtggaagtcg

SEQ ID NO: 14387 - DNA, 20 bp, Artificial Sequence
  Description of Artificial Sequence: Synthetic oligonucleotide
  Target: DMPK; (+) strand; PAM type: NRG; PAM sequence: CGG
tggaagtcggggcctccaac

SEQ ID NO: 14388 - DNA, 20 bp, Artificial Sequence
  Description of Artificial Sequence: Synthetic oligonucleotide
  Target: DMPK; (+) strand; PAM type: NRG; PAM sequence: TGG
gtcggggcctccaaccggcc

SEQ ID NO: 14389 - DNA, 20 bp, Artificial Sequence
  Description of Artificial Sequence: Synthetic oligonucleotide
  Target: DMPK; (+) strand; PAM type: NRG; PAM sequence: GGG
tcggggcctccaaccggcct

SEQ ID NO: 14390 - DNA, 20 bp, Artificial Sequence
  Description of Artificial Sequence: Synthetic oligonucleotide
  Target: DMPK; (+) strand; PAM type: NRG; PAM sequence: GGG
cggggcctccaaccggcctg

SEQ ID NO: 14391 - DNA, 20 bp, Artificial Sequence
  Description of Artificial Sequence: Synthetic oligonucleotide
  Target: DMPK; (+) strand; PAM type: NRG; PAM sequence: TGG
tccaaccggcctggggtgcc

SEQ ID NO: 14392 - DNA, 20 bp, Artificial Sequence
  Description of Artificial Sequence: Synthetic oligonucleotide
  Target: DMPK; (+) strand; PAM type: NRG; PAM sequence: GGG
ccaaccggcctggggtgcct

SEQ ID NO: 14393 - DNA, 20 bp, Artificial Sequence
  Description of Artificial Sequence: Synthetic oligonucleotide
  Target: DMPK; (+) strand; PAM type: NRG; PAM sequence: GAG
gcctggggtgcctgggcctt

SEQ ID NO: 14394 - DNA, 20 bp, Artificial Sequence
  Description of Artificial Sequence: Synthetic oligonucleotide
  Target: DMPK; (+) strand; PAM type: NRG; PAM sequence: GAG
ctggggtgcctgggccttga

SEQ ID NO: 14395 - DNA, 20 bp, Artificial Sequence
  Description of Artificial Sequence: Synthetic oligonucleotide
  Target: DMPK; (+) strand; PAM type: NRG; PAM sequence: AGG
tggggtgcctgggccttgag

SEQ ID NO: 14396 - DNA, 20 bp, Artificial Sequence
  Description of Artificial Sequence: Synthetic oligonucleotide
  Target: DMPK; (+) strand; PAM type: NRG; PAM sequence: GGG
ggggtgcctgggccttgaga

SEQ ID NO: 14397 - DNA, 20 bp, Artificial Sequence
  Description of Artificial Sequence: Synthetic oligonucleotide
  Target: DMPK; (+) strand; PAM type: NRG; PAM sequence: CAG
tgcctgggccttgagagggc

SEQ ID NO: 14398 - DNA, 20 bp, Artificial Sequence
  Description of Artificial Sequence: Synthetic oligonucleotide
  Target: DMPK; (+) strand; PAM type: NRG; PAM sequence: AGG
gcctgggccttgagagggcc

SEQ ID NO: 14399 - DNA, 20 bp, Artificial Sequence
  Description of Artificial Sequence: Synthetic oligonucleotide
  Target: DMPK; (+) strand; PAM type: NRG; PAM sequence: GAG
gccttgagagggccaggcct

SEQ ID NO: 14400 - DNA, 20 bp, Artificial Sequence
  Description of Artificial Sequence: Synthetic oligonucleotide
  Target: DMPK; (+) strand; PAM type: NRG; PAM sequence: TAG
gagggccaggcctgagaaac

SEQ ID NO: 14401 - DNA, 20 bp, Artificial Sequence
  Description of Artificial Sequence: Synthetic oligonucleotide
  Target: DMPK; (+) strand; PAM type: NRG; PAM sequence: AGG
agggccaggcctgagaaact

SEQ ID NO: 14402 - DNA, 20 bp, Artificial Sequence
  Description of Artificial Sequence: Synthetic oligonucleotide
  Target: DMPK; (+) strand; PAM type: NRG; PAM sequence: GAG
ggccaggcctgagaaactag

SEQ ID NO: 14403 - DNA, 20 bp, Artificial Sequence
  Description of Artificial Sequence: Synthetic oligonucleotide
  Target: DMPK; (+) strand; PAM type: NRG; PAM sequence: AGG
gccaggcctgagaaactagg

SEQ ID NO: 14404 - DNA, 20 bp, Artificial Sequence
  Description of Artificial Sequence: Synthetic oligonucleotide
  Target: DMPK; (+) strand; PAM type: NRG; PAM sequence: AAG
ggcctgagaaactaggaggc

SEQ ID NO: 14405 - DNA, 20 bp, Artificial Sequence
  Description of Artificial Sequence: Synthetic oligonucleotide
  Target: DMPK; (+) strand; PAM type: NRG; PAM sequence: AGG
gcctgagaaactaggaggca

SEQ ID NO: 14406 - DNA, 20 bp, Artificial Sequence
  Description of Artificial Sequence: Synthetic oligonucleotide
  Target: DMPK; (+) strand; PAM type: NRG; PAM sequence: GAG
gaaactaggaggcaaggacc

SEQ ID NO: 14407 - DNA, 20 bp, Artificial Sequence
  Description of Artificial Sequence: Synthetic oligonucleotide
  Target: DMPK; (+) strand; PAM type: NRG; PAM sequence: AGG
aaactaggaggcaaggaccg

SEQ ID NO: 14408 - DNA, 20 bp, Artificial Sequence
  Description of Artificial Sequence: Synthetic oligonucleotide
  Target: DMPK; (+) strand; PAM type: NRG; PAM sequence: GAG
actaggaggcaaggaccgag

SEQ ID NO: 14409 - DNA, 20 bp, Artificial Sequence
  Description of Artificial Sequence: Synthetic oligonucleotide
  Target: DMPK; (+) strand; PAM type: NRG; PAM sequence: CAG
aggcaaggaccgaggagtcc

SEQ ID NO: 14410 - DNA, 20 bp, Artificial Sequence
  Description of Artificial Sequence: Synthetic oligonucleotide
  Target: DMPK; (+) strand; PAM type: NRG; PAM sequence: TGG
aaggaccgaggagtcccagc

SEQ ID NO: 14411 - DNA, 20 bp, Artificial Sequence
  Description of Artificial Sequence: Synthetic oligonucleotide
  Target: DMPK; (+) strand; PAM type: NRG; PAM sequence: GGG
aggaccgaggagtcccagct

SEQ ID NO: 14412 - DNA, 20 bp, Artificial Sequence
  Description of Artificial Sequence: Synthetic oligonucleotide
  Target: DMPK; (+) strand; PAM type: NRG; PAM sequence: CAG
accgaggagtcccagctggg

SEQ ID NO: 14413 - DNA, 20 bp, Artificial Sequence
  Description of Artificial Sequence: Synthetic oligonucleotide
  Target: DMPK; (+) strand; PAM type: NRG; PAM sequence: AGG
ccgaggagtcccagctgggc

SEQ ID NO: 14414 - DNA, 20 bp, Artificial Sequence
  Description of Artificial Sequence: Synthetic oligonucleotide
  Target: DMPK; (+) strand; PAM type: NRG; PAM sequence: GGG
cgaggagtcccagctgggca

SEQ ID NO: 14415 - DNA, 20 bp, Artificial Sequence
  Description of Artificial Sequence: Synthetic oligonucleotide
  Target: DMPK; (+) strand; PAM type: NRG; PAM sequence: TGG
agtcccagctgggcagggcc

SEQ ID NO: 14416 - DNA, 20 bp, Artificial Sequence
  Description of Artificial Sequence: Synthetic oligonucleotide
  Target: DMPK; (+) strand; PAM type: NRG; PAM sequence: GGG
gtcccagctgggcagggcct

SEQ ID NO: 14417 - DNA, 20 bp, Artificial Sequence
  Description of Artificial Sequence: Synthetic oligonucleotide
  Target: DMPK; (+) strand; PAM type: NRG; PAM sequence: TGG
tgggcagggcctgggaaacg

SEQ ID NO: 14418 - DNA, 20 bp, Artificial Sequence
  Description of Artificial Sequence: Synthetic oligonucleotide
  Target: DMPK; (+) strand; PAM type: NRG; PAM sequence: TGG
gggcctgggaaacgtggtcc

SEQ ID NO: 14419 - DNA, 20 bp, Artificial Sequence
  Description of Artificial Sequence: Synthetic oligonucleotide
  Target: DMPK; (+) strand; PAM type: NRG; PAM sequence: GGG
ggcctgggaaacgtggtcct

SEQ ID NO: 14420 - DNA, 20 bp, Artificial Sequence
  Description of Artificial Sequence: Synthetic oligonucleotide
  Target: DMPK; (+) strand; PAM type: NRG; PAM sequence: CAG
ctgggaaacgtggtcctggg

SEQ ID NO: 14421 - DNA, 20 bp, Artificial Sequence
  Description of Artificial Sequence: Synthetic oligonucleotide
  Target: DMPK; (+) strand; PAM type: NRG; PAM sequence: GAG
ctgataatttaaaaaacacc

SEQ ID NO: 14422 - DNA, 20 bp, Artificial Sequence
  Description of Artificial Sequence: Synthetic oligonucleotide
  Target: DMPK; (+) strand; PAM type: NRG; PAM sequence: AGG
tgataatttaaaaaacaccg

SEQ ID NO: 14423 - DNA, 20 bp, Artificial Sequence
  Description of Artificial Sequence: Synthetic oligonucleotide
  Target: DMPK; (+) strand; PAM type: NRG; PAM sequence: GAG
aaaacaccgaggactttgat

SEQ ID NO: 14424 - DNA, 20 bp, Artificial Sequence
  Description of Artificial Sequence: Synthetic oligonucleotide
  Target: DMPK; (+) strand; PAM type: NRG; PAM sequence: AGG
aaacaccgaggactttgatg

SEQ ID NO: 14425 - DNA, 20 bp, Artificial Sequence
  Description of Artificial Sequence: Synthetic oligonucleotide
  Target: DMPK; (+) strand; PAM type: NRG; PAM sequence: GGG
aacaccgaggactttgatga

SEQ ID NO: 14426 - DNA, 20 bp, Artificial Sequence
  Description of Artificial Sequence: Synthetic oligonucleotide
  Target: DMPK; (+) strand; PAM type: NRG; PAM sequence: GGG
acaccgaggactttgatgag

SEQ ID NO: 14427 - DNA, 20 bp, Artificial Sequence
  Description of Artificial Sequence: Synthetic oligonucleotide
  Target: DMPK; (+) strand; PAM type: NRG; PAM sequence: TGG
aggactttgatgaggggccc

SEQ ID NO: 14428 - DNA, 20 bp, Artificial Sequence
  Description of Artificial Sequence: Synthetic oligonucleotide
  Target: DMPK; (+) strand; PAM type: NRG; PAM sequence: CGG
ttgatgaggggccctggctg

SEQ ID NO: 14429 - DNA, 20 bp, Artificial Sequence
  Description of Artificial Sequence: Synthetic oligonucleotide
  Target: DMPK; (+) strand; PAM type: NRG; PAM sequence: GGG
tgatgaggggccctggctgc

SEQ ID NO: 14430 - DNA, 20 bp, Artificial Sequence
  Description of Artificial Sequence: Synthetic oligonucleotide
  Target: DMPK; (+) strand; PAM type: NRG; PAM sequence: CAG
tgaggggccctggctgcggg

SEQ ID NO: 14431 - DNA, 20 bp, Artificial Sequence
  Description of Artificial Sequence: Synthetic oligonucleotide
  Target: DMPK; (+) strand; PAM type: NRG; PAM sequence: AGG
gaggggccctggctgcgggc

SEQ ID NO: 14432 - DNA, 20 bp, Artificial Sequence
  Description of Artificial Sequence: Synthetic oligonucleotide
  Target: DMPK; (+) strand; PAM type: NRG; PAM sequence: AAG
ggcaggatgctcttctcccc

SEQ ID NO: 14433 - DNA, 20 bp, Artificial Sequence
  Description of Artificial Sequence: Synthetic oligonucleotide
  Target: DMPK; (+) strand; PAM type: NRG; PAM sequence: GAG
caggatgctcttctccccaa

SEQ ID NO: 14434 - DNA, 20 bp, Artificial Sequence
  Description of Artificial Sequence: Synthetic oligonucleotide
  Target: DMPK; (+) strand; PAM type: NRG; PAM sequence: AGG
aggatgctcttctccccaag

SEQ ID NO: 14435 - DNA, 20 bp, Artificial Sequence
  Description of Artificial Sequence: Synthetic oligonucleotide
  Target: DMPK; (+) strand; PAM type: NRG; PAM sequence: GGG
ggatgctcttctccccaaga

SEQ ID NO: 14436 - DNA, 20 bp, Artificial Sequence
  Description of Artificial Sequence: Synthetic oligonucleotide
  Target: DMPK; (+) strand; PAM type: NRG; PAM sequence: CAG
tccccaagagggtcctgctc

SEQ ID NO: 14437 - DNA, 20 bp, Artificial Sequence
  Description of Artificial Sequence: Synthetic oligonucleotide
  Target: DMPK; (+) strand; PAM type: NRG; PAM sequence: TGG
gagggtcctgctccagccgc

SEQ ID NO: 14438 - DNA, 20 bp, Artificial Sequence
  Description of Artificial Sequence: Synthetic oligonucleotide
  Target: DMPK; (+) strand; PAM type: NRG; PAM sequence: TGG
tcctgctccagccgctggtg

SEQ ID NO: 14439 - DNA, 20 bp, Artificial Sequence
  Description of Artificial Sequence: Synthetic oligonucleotide
  Target: DMPK; (+) strand; PAM type: NRG; PAM sequence: GGG
cctgctccagccgctggtgt

SEQ ID NO: 14440 - DNA, 20 bp, Artificial Sequence
  Description of Artificial Sequence: Synthetic oligonucleotide
  Target: DMPK; (+) strand; PAM type: NRG; PAM sequence: CAG
cagccgctggtgtgggtcac

SEQ ID NO: 14441 - DNA, 20 bp, Artificial Sequence
  Description of Artificial Sequence: Synthetic oligonucleotide
  Target: DMPK; (+) strand; PAM type: NRG; PAM sequence: CAG
gtcaccagttgtgtgactcg

SEQ ID NO: 14442 - DNA, 20 bp, Artificial Sequence
  Description of Artificial Sequence: Synthetic oligonucleotide
  Target: DMPK; (+) strand; PAM type: NRG; PAM sequence: AGG
tcaccagttgtgtgactcgc

SEQ ID NO: 14443 - DNA, 20 bp, Artificial Sequence
  Description of Artificial Sequence: Synthetic oligonucleotide
  Target: DMPK; (+) strand; PAM type: NRG; PAM sequence: TGG
tcgcaggtccgttccctccc

SEQ ID NO: 14444 - DNA, 20 bp, Artificial Sequence
  Description of Artificial Sequence: Synthetic oligonucleotide
  Target: DMPK; (+) strand; PAM type: NRG; PAM sequence: GGG
cgcaggtccgttccctccct

SEQ ID NO: 14445 - DNA, 20 bp, Artificial Sequence
  Description of Artificial Sequence: Synthetic oligonucleotide
  Target: DMPK; (+) strand; PAM type: NRG; PAM sequence: CGG
tccgttccctccctgggctc

SEQ ID NO: 14446 - DNA, 20 bp, Artificial Sequence
  Description of Artificial Sequence: Synthetic oligonucleotide
  Target: DMPK; (+) strand; PAM type: NRG; PAM sequence: AAG
ccggcttttcctgctatgaa

SEQ ID NO: 14447 - DNA, 20 bp, Artificial Sequence
  Description of Artificial Sequence: Synthetic oligonucleotide
  Target: DMPK; (+) strand; PAM type: NRG; PAM sequence: AGG
cggcttttcctgctatgaaa

SEQ ID NO: 14448 - DNA, 20 bp, Artificial Sequence
  Description of Artificial Sequence: Synthetic oligonucleotide
  Target: DMPK; (+) strand; PAM type: NRG; PAM sequence: GGG
ggcttttcctgctatgaaaa

SEQ ID NO: 14449 - DNA, 20 bp, Artificial Sequence
  Description of Artificial Sequence: Synthetic oligonucleotide
  Target: DMPK; (+) strand; PAM type: NRG; PAM sequence: GGG
gcttttcctgctatgaaaag

SEQ ID NO: 14450 - DNA, 20 bp, Artificial Sequence
  Description of Artificial Sequence: Synthetic oligonucleotide
  Target: DMPK; (+) strand; PAM type: NRG; PAM sequence: TGG
tttcctgctatgaaaagggg

SEQ ID NO: 14451 - DNA, 20 bp, Artificial Sequence
  Description of Artificial Sequence: Synthetic oligonucleotide
  Target: DMPK; (+) strand; PAM type: NRG; PAM sequence: GGG
ttcctgctatgaaaaggggt

SEQ ID NO: 14452 - DNA, 20 bp, Artificial Sequence
  Description of Artificial Sequence: Synthetic oligonucleotide
  Target: DMPK; (+) strand; PAM type: NRG; PAM sequence: GAG
cctgctatgaaaaggggtgg

SEQ ID NO: 14453 - DNA, 20 bp, Artificial Sequence
  Description of Artificial Sequence: Synthetic oligonucleotide
  Target: DMPK; (+) strand; PAM type: NRG; PAM sequence: AGG
ctgctatgaaaaggggtggg

SEQ ID NO: 14454 - DNA, 20 bp, Artificial Sequence
  Description of Artificial Sequence: Synthetic oligonucleotide
  Target: DMPK; (+) strand; PAM type: NRG; PAM sequence: TGG
tgaaaaggggtgggaggcgc

SEQ ID NO: 14455 - DNA, 20 bp, Artificial Sequence
  Description of Artificial Sequence: Synthetic oligonucleotide
  Target: DMPK; (+) strand; PAM type: NRG; PAM sequence: GGG
gaaaaggggtgggaggcgct

SEQ ID NO: 14456 - DNA, 20 bp, Artificial Sequence
  Description of Artificial Sequence: Synthetic oligonucleotide
  Target: DMPK; (+) strand; PAM type: NRG; PAM sequence: TGG
aggggtgggaggcgctgggc

SEQ ID NO: 14457 - DNA, 20 bp, Artificial Sequence
  Description of Artificial Sequence: Synthetic oligonucleotide
  Target: DMPK; (+) strand; PAM type: NRG; PAM sequence: GGG
ggggtgggaggcgctgggct

SEQ ID NO: 14458 - DNA, 20 bp, Artificial Sequence
  Description of Artificial Sequence: Synthetic oligonucleotide
  Target: DMPK; (+) strand; PAM type: NRG; PAM sequence: GAG
ggtgggaggcgctgggctgg

SEQ ID NO: 14459 - DNA, 20 bp, Artificial Sequence
  Description of Artificial Sequence: Synthetic oligonucleotide
  Target: DMPK; (+) strand; PAM type: NRG; PAM sequence: CAG
gggaggcgctgggctgggag

SEQ ID NO: 14460 - DNA, 20 bp, Artificial Sequence
  Description of Artificial Sequence: Synthetic oligonucleotide
  Target: DMPK; (+) strand; PAM type: NRG; PAM sequence: AGG
ggaggcgctgggctgggagc

SEQ ID NO: 14461 - DNA, 20 bp, Artificial Sequence
  Description of Artificial Sequence: Synthetic oligonucleotide
  Target: DMPK; (+) strand; PAM type: NRG; PAM sequence: TGG
gcaggcctgcactcctcctc

SEQ ID NO: 14462 - DNA, 20 bp, Artificial Sequence
  Description of Artificial Sequence: Synthetic oligonucleotide
  Target: DMPK; (+) strand; PAM type: NRG; PAM sequence: GGG
caggcctgcactcctcctct

SEQ ID NO: 14463 - DNA, 20 bp, Artificial Sequence
  Description of Artificial Sequence: Synthetic oligonucleotide
  Target: DMPK; (+) strand; PAM type: NRG; PAM sequence: GGG
aggcctgcactcctcctctg

SEQ ID NO: 14464 - DNA, 20 bp, Artificial Sequence
  Description of Artificial Sequence: Synthetic oligonucleotide
  Target: DMPK; (+) strand; PAM type: NRG; PAM sequence: AAG
ctgcactcctcctctgggga

SEQ ID NO: 14465 - DNA, 20 bp, Artificial Sequence
  Description of Artificial Sequence: Synthetic oligonucleotide
  Target: DMPK; (+) strand; PAM type: NRG; PAM sequence: CGG
cactcctcctctggggaaag

SEQ ID NO: 14466 - DNA, 20 bp, Artificial Sequence
  Description of Artificial Sequence: Synthetic oligonucleotide
  Target: DMPK; (+) strand; PAM type: NRG; PAM sequence: TAG
tctggggaaagcggactgcc

SEQ ID NO: 14467 - DNA, 20 bp, Artificial Sequence
  Description of Artificial Sequence: Synthetic oligonucleotide
  Target: DMPK; (+) strand; PAM type: NRG; PAM sequence: CAG
aagcggactgcctagaacca

SEQ ID NO: 14468 - DNA, 20 bp, Artificial Sequence
  Description of Artificial Sequence: Synthetic oligonucleotide
  Target: DMPK; (+) strand; PAM type: NRG; PAM sequence: GAG
gcggactgcctagaaccaca

SEQ ID NO: 14469 - DNA, 20 bp, Artificial Sequence
  Description of Artificial Sequence: Synthetic oligonucleotide
  Target: DMPK; (+) strand; PAM type: NRG; PAM sequence: CAG
agaaccacagagtacacaca

SEQ ID NO: 14470 - DNA, 20 bp, Artificial Sequence
  Description of Artificial Sequence: Synthetic oligonucleotide
  Target: DMPK; (+) strand; PAM type: NRG; PAM sequence: AGG
gaaccacagagtacacacac

SEQ ID NO: 14471 - DNA, 20 bp, Artificial Sequence
  Description of Artificial Sequence: Synthetic oligonucleotide
  Target: DMPK; (+) strand; PAM type: NRG; PAM sequence: AAG
cctctacatcatctcctccg

SEQ ID NO: 14472 - DNA, 20 bp, Artificial Sequence
  Description of Artificial Sequence: Synthetic oligonucleotide
  Target: DMPK; (+) strand; PAM type: NRG; PAM sequence: AGG
ctctacatcatctcctccga

SEQ ID NO: 14473 - DNA, 20 bp, Artificial Sequence
  Description of Artificial Sequence: Synthetic oligonucleotide
  Target: DMPK; (+) strand; PAM type: NRG; PAM sequence: GGG
tctacatcatctcctccgaa

SEQ ID NO: 14474 - DNA, 20 bp, Artificial Sequence
  Description of Artificial Sequence: Synthetic oligonucleotide
  Target: DMPK; (+) strand; PAM type: NRG; PAM sequence: GGG
ctacatcatctcctccgaag

SEQ ID NO: 14475 - DNA, 20 bp, Artificial Sequence
  Description of Artificial Sequence: Synthetic oligonucleotide
  Target: DMPK; (+) strand; PAM type: NRG; PAM sequence: CAG
atcatctcctccgaagggga

SEQ ID NO: 14476 - DNA, 20 bp, Artificial Sequence
  Description of Artificial Sequence: Synthetic oligonucleotide
  Target: DMPK; (+) strand; PAM type: NRG; PAM sequence: GAG
ccgaaggggacagacccgct

SEQ ID NO: 14477 - DNA, 20 bp, Artificial Sequence
  Description of Artificial Sequence: Synthetic oligonucleotide
  Target: DMPK; (+) strand; PAM type: NRG; PAM sequence: CAG
ggacagacccgctgagaaaa

SEQ ID NO: 14478 - DNA, 20 bp, Artificial Sequence
  Description of Artificial Sequence: Synthetic oligonucleotide
  Target: DMPK; (+) strand; PAM type: NRG; PAM sequence: AGG
gacagacccgctgagaaaac

SEQ ID NO: 14479 - DNA, 20 bp, Artificial Sequence
  Description of Artificial Sequence: Synthetic oligonucleotide
  Target: DMPK; (+) strand; PAM type: NRG; PAM sequence: GGG
acagacccgctgagaaaaca

SEQ ID NO: 14480 - DNA, 20 bp, Artificial Sequence
  Description of Artificial Sequence: Synthetic oligonucleotide
  Target: DMPK; (+) strand; PAM type: NRG; PAM sequence: TAG
gctgagaaaacagggaactt

SEQ ID NO: 14481 - DNA, 20 bp, Artificial Sequence
  Description of Artificial Sequence: Synthetic oligonucleotide
  Target: DMPK; (+) strand; PAM type: NRG; PAM sequence: AAG
cagggaactttagtataaat

SEQ ID NO: 14482 - DNA, 20 bp, Artificial Sequence
  Description of Artificial Sequence: Synthetic oligonucleotide
  Target: DMPK; (+) strand; PAM type: NRG; PAM sequence: GAG
gggaactttagtataaataa

SEQ ID NO: 14483 - DNA, 20 bp, Artificial Sequence
  Description of Artificial Sequence: Synthetic oligonucleotide
  Target: DMPK; (+) strand; PAM type: NRG; PAM sequence: AGG
ggaactttagtataaataag

SEQ ID NO: 14484 - DNA, 20 bp, Artificial Sequence
  Description of Artificial Sequence: Synthetic oligonucleotide
  Target: DMPK; (+) strand; PAM type: NRG; PAM sequence: CGG
agtataaataagaggtcctg

SEQ ID NO: 14485 - DNA, 20 bp, Artificial Sequence
  Description of Artificial Sequence: Synthetic oligonucleotide
  Target: DMPK; (+) strand; PAM type: NRG; PAM sequence: GGG
gtataaataagaggtcctgc

SEQ ID NO: 14486 - DNA, 20 bp, Artificial Sequence
  Description of Artificial Sequence: Synthetic oligonucleotide
  Target: DMPK; (+) strand; PAM type: NRG; PAM sequence: CAG
aaataagaggtcctgcggga

SEQ ID NO: 14487 - DNA, 20 bp, Artificial Sequence
  Description of Artificial Sequence: Synthetic oligonucleotide
  Target: DMPK; (+) strand; PAM type: NRG; PAM sequence: AGG
aataagaggtcctgcgggac

SEQ ID NO: 14488 - DNA, 20 bp, Artificial Sequence
  Description of Artificial Sequence: Synthetic oligonucleotide
  Target: DMPK; (+) strand; PAM type: NRG; PAM sequence: GGG
ataagaggtcctgcgggaca

SEQ ID NO: 14489 - DNA, 20 bp, Artificial Sequence
  Description of Artificial Sequence: Synthetic oligonucleotide
  Target: DMPK; (+) strand; PAM type: NRG; PAM sequence: GAG
aagaggtcctgcgggacagg

SEQ ID NO: 14490 - DNA, 20 bp, Artificial Sequence
  Description of Artificial Sequence: Synthetic oligonucleotide
  Target: DMPK; (+) strand; PAM type: NRG; PAM sequence: AGG
agaggtcctgcgggacaggg

SEQ ID NO: 14491 - DNA, 20 bp, Artificial Sequence
  Description of Artificial Sequence: Synthetic oligonucleotide
  Target: DMPK; (+) strand; PAM type: NRG; PAM sequence: GAG
tgcgggacagggaggaacct

SEQ ID NO: 14492 - DNA, 20 bp, Artificial Sequence
  Description of Artificial Sequence: Synthetic oligonucleotide
  Target: DMPK; (+) strand; PAM type: NRG; PAM sequence: AGG
gcgggacagggaggaacctg

SEQ ID NO: 14493 - DNA, 20 bp, Artificial Sequence
  Description of Artificial Sequence: Synthetic oligonucleotide
  Target: DMPK; (+) strand; PAM type: NRG; PAM sequence: GGG
cgggacagggaggaacctga

SEQ ID NO: 14494 - DNA, 20 bp, Artificial Sequence
  Description of Artificial Sequence: Synthetic oligonucleotide
  Target: DMPK; (+) strand; PAM type: NRG; PAM sequence: GGG
gggacagggaggaacctgag

SEQ ID NO: 14495 - DNA, 20 bp, Artificial Sequence
  Description of Artificial Sequence: Synthetic oligonucleotide
  Target: DMPK; (+) strand; PAM type: NRG; PAM sequence: AAG
cataatttaacactcttcaa

SEQ ID NO: 14496 - DNA, 20 bp, Artificial Sequence
  Description of Artificial Sequence: Synthetic oligonucleotide
  Target: DMPK; (+) strand; PAM type: NRG; PAM sequence: CAG
tttaacactcttcaaaagca

SEQ ID NO: 14497 - DNA, 20 bp, Artificial Sequence
  Description of Artificial Sequence: Synthetic oligonucleotide
  Target: DMPK; (+) strand; PAM type: NRG; PAM sequence: TAG
ctcttcaaaagcacagacaa

SEQ ID NO: 14498 - DNA, 20 bp, Artificial Sequence
  Description of Artificial Sequence: Synthetic oligonucleotide
  Target: DMPK; (+) strand; PAM type: NRG; PAM sequence: AAG
tcaaaagcacagacaatagc

SEQ ID NO: 14499 - DNA, 20 bp, Artificial Sequence
  Description of Artificial Sequence: Synthetic oligonucleotide
  Target: DMPK; (+) strand; PAM type: NRG; PAM sequence: AGG
caaaagcacagacaatagca

SEQ ID NO: 14500 - DNA, 20 bp, Artificial Sequence
  Description of Artificial Sequence: Synthetic oligonucleotide
  Target: DMPK; (+) strand; PAM type: NRG; PAM sequence: GGG
aaaagcacagacaatagcaa

SEQ ID NO: 14501 - DNA, 20 bp, Artificial Sequence
  Description of Artificial Sequence: Synthetic oligonucleotide
  Target: DMPK; (+) strand; PAM type: NRG; PAM sequence: CAG
agcacagacaatagcaaggg

SEQ ID NO: 14502 - DNA, 20 bp, Artificial Sequence
  Description of Artificial Sequence: Synthetic oligonucleotide
  Target: DMPK; (+) strand; PAM type: NRG; PAM sequence: TGG
cagacaatagcaagggcagc

SEQ ID NO: 14503 - DNA, 20 bp, Artificial Sequence
  Description of Artificial Sequence: Synthetic oligonucleotide
  Target: DMPK; (+) strand; PAM type: NRG; PAM sequence: GGG
agacaatagcaagggcagct

SEQ ID NO: 14504 - DNA, 20 bp, Artificial Sequence
  Description of Artificial Sequence: Synthetic oligonucleotide
  Target: DMPK; (+) strand; PAM type: NRG; PAM sequence: GGG
gacaatagcaagggcagctg

SEQ ID NO: 14505 - DNA, 20 bp, Artificial Sequence
  Description of Artificial Sequence: Synthetic oligonucleotide
  Target: DMPK; (+) strand; PAM type: NRG; PAM sequence: TGG
aatagcaagggcagctgggg

SEQ ID NO: 14506 - DNA, 20 bp, Artificial Sequence
  Description of Artificial Sequence: Synthetic oligonucleotide
  Target: DMPK; (+) strand; PAM type: NRG; PAM sequence: GGG
atagcaagggcagctggggt

SEQ ID NO: 14507 - DNA, 20 bp, Artificial Sequence
  Description of Artificial Sequence: Synthetic oligonucleotide
  Target: DMPK; (+) strand; PAM type: NRG; PAM sequence: GGG
tagcaagggcagctggggtg

SEQ ID NO: 14508 - DNA, 20 bp, Artificial Sequence
  Description of Artificial Sequence: Synthetic oligonucleotide
  Target: DMPK; (+) strand; PAM type: NRG; PAM sequence: GGG
agcaagggcagctggggtgg

SEQ ID NO: 14509 - DNA, 20 bp, Artificial Sequence
  Description of Artificial Sequence: Synthetic oligonucleotide
  Target: DMPK; (+) strand; PAM type: NRG; PAM sequence: CGG
agggcagctggggtgggggc

SEQ ID NO: 14510 - DNA, 20 bp, Artificial Sequence
  Description of Artificial Sequence: Synthetic oligonucleotide
  Target: DMPK; (+) strand; PAM type: NRG; PAM sequence: GGG
gggcagctggggtgggggcc

SEQ ID NO: 14511 - DNA, 20 bp, Artificial Sequence
  Description of Artificial Sequence: Synthetic oligonucleotide
  Target: DMPK; (+) strand; PAM type: NRG; PAM sequence: GAG
agctggggtgggggccgggc

SEQ ID NO: 14512 - DNA, 20 bp, Artificial Sequence
  Description of Artificial Sequence: Synthetic oligonucleotide
  Target: DMPK; (+) strand; PAM type: NRG; PAM sequence: AGG
gctggggtgggggccgggcg

SEQ ID NO: 14513 - DNA, 20 bp, Artificial Sequence
  Description of Artificial Sequence: Synthetic oligonucleotide
  Target: DMPK; (+) strand; PAM type: NRG; PAM sequence: GGG
ctggggtgggggccgggcga

SEQ ID NO: 14514 - DNA, 20 bp, Artificial Sequence
  Description of Artificial Sequence: Synthetic oligonucleotide
  Target: DMPK; (+) strand; PAM type: NRG; PAM sequence: TGG
ggtgggggccgggcgagggc

SEQ ID NO: 14515 - DNA, 20 bp, Artificial Sequence
  Description of Artificial Sequence: Synthetic oligonucleotide
  Target: DMPK; (+) strand; PAM type: NRG; PAM sequence: CGG
ggcgagggctggaccacccc

SEQ ID NO: 14516 - DNA, 20 bp, Artificial Sequence
  Description of Artificial Sequence: Synthetic oligonucleotide
  Target: DMPK; (+) strand; PAM type: NRG; PAM sequence: GAG
ccggccctgcccactcaact

SEQ ID NO: 14517 - DNA, 20 bp, Artificial Sequence
  Description of Artificial Sequence: Synthetic oligonucleotide
  Target: DMPK; (+) strand; PAM type: NRG; PAM sequence: AGG
cggccctgcccactcaactg

SEQ ID NO: 14518 - DNA, 20 bp, Artificial Sequence
  Description of Artificial Sequence: Synthetic oligonucleotide
  Target: DMPK; (+) strand; PAM type: NRG; PAM sequence: GGG
ggccctgcccactcaactga

SEQ ID NO: 14519 - DNA, 20 bp, Artificial Sequence
  Description of Artificial Sequence: Synthetic oligonucleotide
  Target: DMPK; (+) strand; PAM type: NRG; PAM sequence: GGG
gccctgcccactcaactgag

SEQ ID NO: 14520 - DNA, 20 bp, Artificial Sequence
  Description of Artificial Sequence: Synthetic oligonucleotide
  Target: DMPK; (+) strand; PAM type: NRG; PAM sequence: CAG
ctcaactgaggggcacactg

SEQ ID NO: 14521 - DNA, 20 bp, Artificial Sequence
  Description of Artificial Sequence: Synthetic oligonucleotide
  Target: DMPK; (+) strand; PAM type: NRG; PAM sequence: TGG
tgaggggcacactgcagacc

SEQ ID NO: 14522 - DNA, 20 bp, Artificial Sequence
  Description of Artificial Sequence: Synthetic oligonucleotide
  Target: DMPK; (+) strand; PAM type: NRG; PAM sequence: GGG
gaggggcacactgcagacct

SEQ ID NO: 14523 - DNA, 20 bp, Artificial Sequence
  Description of Artificial Sequence: Synthetic oligonucleotide
  Target: DMPK; (+) strand; PAM type: NRG; PAM sequence: GGG
aggggcacactgcagacctg

SEQ ID NO: 14524 - DNA, 20 bp, Artificial Sequence
  Description of Artificial Sequence: Synthetic oligonucleotide
  Target: DMPK; (+) strand; PAM type: NRG; PAM sequence: TGG
ctgcagacctggggctcttg

SEQ ID NO: 14525 - DNA, 20 bp, Artificial Sequence
  Description of Artificial Sequence: Synthetic oligonucleotide
  Target: DMPK; (+) strand; PAM type: NRG; PAM sequence: CAG
cagacctggggctcttgtgg

SEQ ID NO: 14526 - DNA, 20 bp, Artificial Sequence
  Description of Artificial Sequence: Synthetic oligonucleotide
  Target: DMPK; (+) strand; PAM type: NRG; PAM sequence: AGG
agacctggggctcttgtggc

SEQ ID NO: 14527 - DNA, 20 bp, Artificial Sequence
  Description of Artificial Sequence: Synthetic oligonucleotide
  Target: DMPK; (+) strand; PAM type: NRG; PAM sequence: GGG
gacctggggctcttgtggca

SEQ ID NO: 14528 - DNA, 20 bp, Artificial Sequence
  Description of Artificial Sequence: Synthetic oligonucleotide
  Target: DMPK; (+) strand; PAM type: NRG; PAM sequence: GGG
acctggggctcttgtggcag

SEQ ID NO: 14529 - DNA, 20 bp, Artificial Sequence
  Description of Artificial Sequence: Synthetic oligonucleotide
  Target: DMPK; (+) strand; PAM type: NRG; PAM sequence: CGG
tggggctcttgtggcagggg

SEQ ID NO: 14530 - DNA, 20 bp, Artificial Sequence
  Description of Artificial Sequence: Synthetic oligonucleotide
  Target: DMPK; (+) strand; PAM type: NRG; PAM sequence: GGG
ggggctcttgtggcaggggc

SEQ ID NO: 14531 - DNA, 20 bp, Artificial Sequence
  Description of Artificial Sequence: Synthetic oligonucleotide
  Target: DMPK; (+) strand; PAM type: NRG; PAM sequence: GGG
gggctcttgtggcaggggcg

SEQ ID NO: 14532 - DNA, 20 bp, Artificial Sequence
  Description of Artificial Sequence: Synthetic oligonucleotide
  Target: DMPK; (+) strand; PAM type: NRG; PAM sequence: GAG
gctcttgtggcaggggcggg

SEQ ID NO: 14533 - DNA, 20 bp, Artificial Sequence
  Description of Artificial Sequence: Synthetic oligonucleotide
  Target: DMPK; (+) strand; PAM type: NRG; PAM sequence: CAG
aggggcggggagtctctccc

SEQ ID NO: 14534 - DNA, 20 bp, Artificial Sequence
  Description of Artificial Sequence: Synthetic oligonucleotide
  Target: DMPK; (+) strand; PAM type: NRG; PAM sequence: AGG
ggggcggggagtctctcccc

SEQ ID NO: 14535 - DNA, 20 bp, Artificial Sequence
  Description of Artificial Sequence: Synthetic oligonucleotide
  Target: DMPK; (+) strand; PAM type: NRG; PAM sequence: GAG
ggcggggagtctctccccag

SEQ ID NO: 14536 - DNA, 20 bp, Artificial Sequence
  Description of Artificial Sequence: Synthetic oligonucleotide
  Target: DMPK; (+) strand; PAM type: NRG; PAM sequence: CAG
agtctctccccaggagtgac

SEQ ID NO: 14537 - DNA, 20 bp, Artificial Sequence
  Description of Artificial Sequence: Synthetic oligonucleotide
  Target: DMPK; (+) strand; PAM type: NRG; PAM sequence: TGG
aggagtgaccagtcacatgc

SEQ ID NO: 14538 - DNA, 20 bp, Artificial Sequence
  Description of Artificial Sequence: Synthetic oligonucleotide
  Target: DMPK; (+) strand; PAM type: NRG; PAM sequence: GGG
ggagtgaccagtcacatgct

SEQ ID NO: 14539 - DNA, 20 bp, Artificial Sequence
  Description of Artificial Sequence: Synthetic oligonucleotide
  Target: DMPK; (+) strand; PAM type: NRG; PAM sequence: GGG
gagtgaccagtcacatgctg

SEQ ID NO: 14540 - DNA, 20 bp, Artificial Sequence
  Description of Artificial Sequence: Synthetic oligonucleotide
  Target: DMPK; (+) strand; PAM type: NRG; PAM sequence: CAG
gaccagtcacatgctgggga

SEQ ID NO: 14541 - DNA, 20 bp, Artificial Sequence
  Description of Artificial Sequence: Synthetic oligonucleotide
  Target: DMPK; (+) strand; PAM type: NRG; PAM sequence: AGG
accagtcacatgctggggac

SEQ ID NO: 14542 - DNA, 20 bp, Artificial Sequence
  Description of Artificial Sequence: Synthetic oligonucleotide
  Target: DMPK; (+) strand; PAM type: NRG; PAM sequence: GGG
ccagtcacatgctggggaca

SEQ ID NO: 14543 - DNA, 20 bp, Artificial Sequence
  Description of Artificial Sequence: Synthetic oligonucleotide
  Target: DMPK; (+) strand; PAM type: NRG; PAM sequence: GAG
cacatgctggggacagggat

SEQ ID NO: 14544 - DNA, 20 bp, Artificial Sequence
  Description of Artificial Sequence: Synthetic oligonucleotide
  Target: DMPK; (+) strand; PAM type: NRG; PAM sequence: AGG
acatgctggggacagggatg

SEQ ID NO: 14545 - DNA, 20 bp, Artificial Sequence
  Description of Artificial Sequence: Synthetic oligonucleotide
  Target: DMPK; (+) strand; PAM type: NRG; PAM sequence: GGG
catgctggggacagggatga

SEQ ID NO: 14546 - DNA, 20 bp, Artificial Sequence
  Description of Artificial Sequence: Synthetic oligonucleotide
  Target: DMPK; (+) strand; PAM type: NRG; PAM sequence: CAG
tgagggtaacactgatgttt

SEQ ID NO: 14547 - DNA, 20 bp, Artificial Sequence
  Description of Artificial Sequence: Synthetic oligonucleotide
  Target: DMPK; (+) strand; PAM type: NRG; PAM sequence: GAG
agggtaacactgatgtttca

SEQ ID NO: 14548 - DNA, 20 bp, Artificial Sequence
  Description of Artificial Sequence: Synthetic oligonucleotide
  Target: DMPK; (+) strand; PAM type: NRG; PAM sequence: AGG
gggtaacactgatgtttcag

SEQ ID NO: 14549 - DNA, 20 bp, Artificial Sequence
  Description of Artificial Sequence: Synthetic oligonucleotide
  Target: DMPK; (+) strand; PAM type: NRG; PAM sequence: AAG
taacactgatgtttcagagg

SEQ ID NO: 14550 - DNA, 20 bp, Artificial Sequence
  Description of Artificial Sequence: Synthetic oligonucleotide
  Target: DMPK; (+) strand; PAM type: NRG; PAM sequence: GAG
acactgatgtttcagaggaa

SEQ ID NO: 14551 - DNA, 20 bp, Artificial Sequence
  Description of Artificial Sequence: Synthetic oligonucleotide
  Target: DMPK; (+) strand; PAM type: NRG; PAM sequence: AGG
cactgatgtttcagaggaag

SEQ ID NO: 14552 - DNA, 20 bp, Artificial Sequence
  Description of Artificial Sequence: Synthetic oligonucleotide
  Target: DMPK; (+) strand; PAM type: NRG; PAM sequence: TGG
gaggaagaggtcattgtact

SEQ ID NO: 14553 - DNA, 20 bp, Artificial Sequence
  Description of Artificial Sequence: Synthetic oligonucleotide
  Target: DMPK; (+) strand; PAM type: NRG; PAM sequence: CAG
gaagaggtcattgtacttgg

SEQ ID NO: 14554 - DNA, 20 bp, Artificial Sequence
  Description of Artificial Sequence: Synthetic oligonucleotide
  Target: DMPK; (+) strand; PAM type: NRG; PAM sequence: TGG
gaggtcattgtacttggcag

SEQ ID NO: 14555 - DNA, 20 bp, Artificial Sequence
  Description of Artificial Sequence: Synthetic oligonucleotide
  Target: DMPK; (+) strand; PAM type: NRG; PAM sequence: GGG
aggtcattgtacttggcagt

SEQ ID NO: 14556 - DNA, 20 bp, Artificial Sequence
  Description of Artificial Sequence: Synthetic oligonucleotide
  Target: DMPK; (+) strand; PAM type: NRG; PAM sequence: TGG
tcattgtacttggcagtggg

SEQ ID NO: 14557 - DNA, 20 bp, Artificial Sequence
  Description of Artificial Sequence: Synthetic oligonucleotide
  Target: DMPK; (+) strand; PAM type: NRG; PAM sequence: GGG
cattgtacttggcagtgggt

SEQ ID NO: 14558 - DNA, 20 bp, Artificial Sequence
  Description of Artificial Sequence: Synthetic oligonucleotide
  Target: DMPK; (+) strand; PAM type: NRG; PAM sequence: GGG
attgtacttggcagtgggtg

SEQ ID NO: 14559 - DNA, 20 bp, Artificial Sequence
  Description of Artificial Sequence: Synthetic oligonucleotide
  Target: DMPK; (+) strand; PAM type: NRG; PAM sequence: GGG
ttgtacttggcagtgggtgg

SEQ ID NO: 14560 - DNA, 20 bp, Artificial Sequence
  Description of Artificial Sequence: Synthetic oligonucleotide
  Target: DMPK; (+) strand; PAM type: NRG; PAM sequence: AAG
cttggcagtgggtgggggac

SEQ ID NO: 14561 - DNA, 20 bp, Artificial Sequence
  Description of Artificial Sequence: Synthetic oligonucleotide
  Target: DMPK; (+) strand; PAM type: NRG; PAM sequence: AGG
ttggcagtgggtgggggaca

SEQ ID NO: 14562 - DNA, 20 bp, Artificial Sequence
  Description of Artificial Sequence: Synthetic oligonucleotide
  Target: DMPK; (+) strand; PAM type: NRG; PAM sequence: GAG
agtgggtgggggacaaggct

SEQ ID NO: 14563 - DNA, 20 bp, Artificial Sequence
  Description of Artificial Sequence: Synthetic oligonucleotide
  Target: DMPK; (+) strand; PAM type: NRG; PAM sequence: AGG
gtgggtgggggacaaggctg

SEQ ID NO: 14564 - DNA, 20 bp, Artificial Sequence
  Description of Artificial Sequence: Synthetic oligonucleotide
  Target: DMPK; (+) strand; PAM type: NRG; PAM sequence: AAG
ggggacaaggctgaggccac

SEQ ID NO: 14565 - DNA, 20 bp, Artificial Sequence
  Description of Artificial Sequence: Synthetic oligonucleotide
  Target: DMPK; (+) strand; PAM type: NRG; PAM sequence: AGG
gggacaaggctgaggccaca

SEQ ID NO: 14566 - DNA, 20 bp, Artificial Sequence
  Description of Artificial Sequence: Synthetic oligonucleotide
  Target: DMPK; (+) strand; PAM type: NRG; PAM sequence: GGG
ggacaaggctgaggccacaa

SEQ ID NO: 14567 - DNA, 20 bp, Artificial Sequence
  Description of Artificial Sequence: Synthetic oligonucleotide
  Target: DMPK; (+) strand; PAM type: NRG; PAM sequence: CGG
gctattacatcgcccgtgtc

SEQ ID NO: 14568 - DNA, 20 bp, Artificial Sequence
  Description of Artificial Sequence: Synthetic oligonucleotide
  Target: DMPK; (+) strand; PAM type: NRG; PAM sequence: GGG
ctattacatcgcccgtgtcc

SEQ ID NO: 14569 - DNA, 20 bp, Artificial Sequence
  Description of Artificial Sequence: Synthetic oligonucleotide
  Target: DMPK; (+) strand; PAM type: NRG; PAM sequence: CAG
tacatcgcccgtgtccgggc

SEQ ID NO: 14570 - DNA, 20 bp, Artificial Sequence
  Description of Artificial Sequence: Synthetic oligonucleotide
  Target: DMPK; (+) strand; PAM type: NRG; PAM sequence: TGG
cgcccgtgtccgggccagtc

SEQ ID NO: 14571 - DNA, 20 bp, Artificial Sequence
  Description of Artificial Sequence: Synthetic oligonucleotide
  Target: DMPK; (+) strand; PAM type: NRG; PAM sequence: GGG
gcccgtgtccgggccagtct

SEQ ID NO: 14572 - DNA, 20 bp, Artificial Sequence
  Description of Artificial Sequence: Synthetic oligonucleotide
  Target: DMPK; (+) strand; PAM type: NRG; PAM sequence: GGG
cccgtgtccgggccagtctg

SEQ ID NO: 14573 - DNA, 20 bp, Artificial Sequence
  Description of Artificial Sequence: Synthetic oligonucleotide
  Target: DMPK; (+) strand; PAM type: NRG; PAM sequence: GGG
ccgtgtccgggccagtctgg

SEQ ID NO: 14574 - DNA, 20 bp, Artificial Sequence
  Description of Artificial Sequence: Synthetic oligonucleotide
  Target: DMPK; (+) strand; PAM type: NRG; PAM sequence: GGG
cgtgtccgggccagtctggg

SEQ ID NO: 14575 - DNA, 20 bp, Artificial Sequence
  Description of Artificial Sequence: Synthetic oligonucleotide
  Target: DMPK; (+) strand; PAM type: NRG; PAM sequence: CAG
gggggcccccaaattttgtg

SEQ ID NO: 14576 - DNA, 20 bp, Artificial Sequence
  Description of Artificial Sequence: Synthetic oligonucleotide
  Target: DMPK; (+) strand; PAM type: NRG; PAM sequence: AGG
ggggcccccaaattttgtgc

SEQ ID NO: 14577 - DNA, 20 bp, Artificial Sequence
  Description of Artificial Sequence: Synthetic oligonucleotide
  Target: DMPK; (+) strand; PAM type: NRG; PAM sequence: TGG
gcccccaaattttgtgcagg

SEQ ID NO: 14578 - DNA, 20 bp, Artificial Sequence
  Description of Artificial Sequence: Synthetic oligonucleotide
  Target: DMPK; (+) strand; PAM type: NRG; PAM sequence: GGG
cccccaaattttgtgcaggt

SEQ ID NO: 14579 - DNA, 20 bp, Artificial Sequence
  Description of Artificial Sequence: Synthetic oligonucleotide
  Target: DMPK; (+) strand; PAM type: NRG; PAM sequence: GGG
ccccaaattttgtgcaggtg

SEQ ID NO: 14580 - DNA, 20 bp, Artificial Sequence
  Description of Artificial Sequence: Synthetic oligonucleotide
  Target: DMPK; (+) strand; PAM type: NRG; PAM sequence: GGG
cccaaattttgtgcaggtgg

SEQ ID NO: 14581 - DNA, 20 bp, Artificial Sequence
  Description of Artificial Sequence: Synthetic oligonucleotide
  Target: DMPK; (+) strand; PAM type: NRG; PAM sequence: GGG
ccaaattttgtgcaggtggg

SEQ ID NO: 14582 - DNA, 20 bp, Artificial Sequence
  Description of Artificial Sequence: Synthetic oligonucleotide
  Target: DMPK; (+) strand; PAM type: NRG; PAM sequence: TGG
ttttgtgcaggtggggggac

SEQ ID NO: 14583 - DNA, 20 bp, Artificial Sequence
  Description of Artificial Sequence: Synthetic oligonucleotide
  Target: DMPK; (+) strand; PAM type: NRG; PAM sequence: GAG
ttgtgcaggtggggggactg

SEQ ID NO: 14584 - DNA, 20 bp, Artificial Sequence
  Description of Artificial Sequence: Synthetic oligonucleotide
  Target: DMPK; (+) strand; PAM type: NRG; PAM sequence: CAG
tgcaggtggggggactggag

SEQ ID NO: 14585 - DNA, 20 bp, Artificial Sequence
  Description of Artificial Sequence: Synthetic oligonucleotide
  Target: DMPK; (+) strand; PAM type: NRG; PAM sequence: TGG
ctggagcagtccatccatca

SEQ ID NO: 14586 - DNA, 20 bp, Artificial Sequence
  Description of Artificial Sequence: Synthetic oligonucleotide
  Target: DMPK; (+) strand; PAM type: NRG; PAM sequence: TAG
agcagtccatccatcatggt

SEQ ID NO: 14587 - DNA, 20 bp, Artificial Sequence
  Description of Artificial Sequence: Synthetic oligonucleotide
  Target: DMPK; (+) strand; PAM type: NRG; PAM sequence: GAG
ttgttaatacgttgatctgt

SEQ ID NO: 14588 - DNA, 20 bp, Artificial Sequence
  Description of Artificial Sequence: Synthetic oligonucleotide
  Target: DMPK; (+) strand; PAM type: NRG; PAM sequence: AGG
tgttaatacgttgatctgtg

SEQ ID NO: 14589 - DNA, 20 bp, Artificial Sequence
  Description of Artificial Sequence: Synthetic oligonucleotide
  Target: DMPK; (+) strand; PAM type: NRG; PAM sequence: CAG
aatacgttgatctgtgaggt

SEQ ID NO: 14590 - DNA, 20 bp, Artificial Sequence
  Description of Artificial Sequence: Synthetic oligonucleotide
  Target: DMPK; (+) strand; PAM type: NRG; PAM sequence: CAG
acgttgatctgtgaggtcag

SEQ ID NO: 14591 - DNA, 20 bp, Artificial Sequence
  Description of Artificial Sequence: Synthetic oligonucleotide
  Target: DMPK; (+) strand; PAM type: NRG; PAM sequence: AGG
cgttgatctgtgaggtcagc

SEQ ID NO: 14592 - DNA, 20 bp, Artificial Sequence
  Description of Artificial Sequence: Synthetic oligonucleotide
  Target: DMPK; (+) strand; PAM type: NRG; PAM sequence: GGG
gttgatctgtgaggtcagca

SEQ ID NO: 14593 - DNA, 20 bp, Artificial Sequence
  Description of Artificial Sequence: Synthetic oligonucleotide
  Target: DMPK; (+) strand; PAM type: NRG; PAM sequence: GAG
tgatctgtgaggtcagcagg

SEQ ID NO: 14594 - DNA, 20 bp, Artificial Sequence
  Description of Artificial Sequence: Synthetic oligonucleotide
  Target: DMPK; (+) strand; PAM type: NRG; PAM sequence: AGG
gatctgtgaggtcagcaggg

SEQ ID NO: 14595 - DNA, 20 bp, Artificial Sequence
  Description of Artificial Sequence: Synthetic oligonucleotide
  Target: DMPK; (+) strand; PAM type: NRG; PAM sequence: GGG
atctgtgaggtcagcaggga

SEQ ID NO: 14596 - DNA, 20 bp, Artificial Sequence
  Description of Artificial Sequence: Synthetic oligonucleotide
  Target: DMPK; (+) strand; PAM type: NRG; PAM sequence: TGG
gaggtcagcagggagggtta

SEQ ID NO: 14597 - DNA, 20 bp, Artificial Sequence
  Description of Artificial Sequence: Synthetic oligonucleotide
  Target: DMPK; (+) strand; PAM type: NRG; PAM sequence: TAG
tcagcagggagggttatggc

SEQ ID NO: 14598 - DNA, 20 bp, Artificial Sequence
  Description of Artificial Sequence: Synthetic oligonucleotide
  Target: DMPK; (+) strand; PAM type: NRG; PAM sequence: AGG
cagcagggagggttatggct

SEQ ID NO: 14599 - DNA, 20 bp, Artificial Sequence
  Description of Artificial Sequence: Synthetic oligonucleotide
  Target: DMPK; (+) strand; PAM type: NRG; PAM sequence: GAG
gcagggagggttatggctag

SEQ ID NO: 14600 - DNA, 20 bp, Artificial Sequence
  Description of Artificial Sequence: Synthetic oligonucleotide
  Target: DMPK; (+) strand; PAM type: NRG; PAM sequence: AGG
cagggagggttatggctagg

SEQ ID NO: 14601 - DNA, 20 bp, Artificial Sequence
  Description of Artificial Sequence: Synthetic oligonucleotide
  Target: DMPK; (+) strand; PAM type: NRG; PAM sequence: TGG
gagggttatggctaggaggc

SEQ ID NO: 14602 - DNA, 20 bp, Artificial Sequence
  Description of Artificial Sequence: Synthetic oligonucleotide
  Target: DMPK; (+) strand; PAM type: NRG; PAM sequence: GGG
agggttatggctaggaggct

SEQ ID NO: 14603 - DNA, 20 bp, Artificial Sequence
  Description of Artificial Sequence: Synthetic oligonucleotide
  Target: DMPK; (+) strand; PAM type: NRG; PAM sequence: GGG
gggttatggctaggaggctg

SEQ ID NO: 14604 - DNA, 20 bp, Artificial Sequence
  Description of Artificial Sequence: Synthetic oligonucleotide
  Target: DMPK; (+) strand; PAM type: NRG; PAM sequence: GGG
ggttatggctaggaggctgg

SEQ ID NO: 14605 - DNA, 20 bp, Artificial Sequence
  Description of Artificial Sequence: Synthetic oligonucleotide
  Target: DMPK; (+) strand; PAM type: NRG; PAM sequence: TGG
tggctaggaggctgggggca

SEQ ID NO: 14606 - DNA, 20 bp, Artificial Sequence
  Description of Artificial Sequence: Synthetic oligonucleotide
  Target: DMPK; (+) strand; PAM type: NRG; PAM sequence: GGG
ggctaggaggctgggggcat

SEQ ID NO: 14607 - DNA, 20 bp, Artificial Sequence
  Description of Artificial Sequence: Synthetic oligonucleotide
  Target: DMPK; (+) strand; PAM type: NRG; PAM sequence: GGG
gctaggaggctgggggcatg

SEQ ID NO: 14608 - DNA, 20 bp, Artificial Sequence
  Description of Artificial Sequence: Synthetic oligonucleotide
  Target: DMPK; (+) strand; PAM type: NRG; PAM sequence: TGG
ggaggctgggggcatggggt

SEQ ID NO: 14609 - DNA, 20 bp, Artificial Sequence
  Description of Artificial Sequence: Synthetic oligonucleotide
  Target: DMPK; (+) strand; PAM type: NRG; PAM sequence: GGG
gaggctgggggcatggggtt

SEQ ID NO: 14610 - DNA, 20 bp, Artificial Sequence
  Description of Artificial Sequence: Synthetic oligonucleotide
  Target: DMPK; (+) strand; PAM type: NRG; PAM sequence: GGG
aggctgggggcatggggttg

SEQ ID NO: 14611 - DNA, 20 bp, Artificial Sequence
  Description of Artificial Sequence: Synthetic oligonucleotide
  Target: DMPK; (+) strand; PAM type: NRG; PAM sequence: GGG
ggctgggggcatggggttgg

SEQ ID NO: 14612 - DNA, 20 bp, Artificial Sequence
  Description of Artificial Sequence: Synthetic oligonucleotide
  Target: DMPK; (+) strand; PAM type: NRG; PAM sequence: GGG
gctgggggcatggggttggg

SEQ ID NO: 14613 - DNA, 20 bp, Artificial Sequence
  Description of Artificial Sequence: Synthetic oligonucleotide
  Target: DMPK; (+) strand; PAM type: NRG; PAM sequence: GGG
ctgggggcatggggttgggg

SEQ ID NO: 14614 - DNA, 20 bp, Artificial Sequence
  Description of Artificial Sequence: Synthetic oligonucleotide
  Target: DMPK; (+) strand; PAM type: NRG; PAM sequence: TGG
ttgggggggcccgatatcca

SEQ ID NO: 14615 - DNA, 20 bp, Artificial Sequence
  Description of Artificial Sequence: Synthetic oligonucleotide
  Target: DMPK; (+) strand; PAM type: NRG; PAM sequence: CGG
cttcacaccactgtgccact

SEQ ID NO: 14616 - DNA, 20 bp, Artificial Sequence
  Description of Artificial Sequence: Synthetic oligonucleotide
  Target: DMPK; (+) strand; PAM type: NRG; PAM sequence: GGG
ttcacaccactgtgccactc

SEQ ID NO: 14617 - DNA, 20 bp, Artificial Sequence
  Description of Artificial Sequence: Synthetic oligonucleotide
  Target: DMPK; (+) strand; PAM type: NRG; PAM sequence: GGG
tcacaccactgtgccactcg

SEQ ID NO: 14618 - DNA, 20 bp, Artificial Sequence
  Description of Artificial Sequence: Synthetic oligonucleotide
  Target: DMPK; (+) strand; PAM type: NRG; PAM sequence: GAG
acaccactgtgccactcggg

SEQ ID NO: 14619 - DNA, 20 bp, Artificial Sequence
  Description of Artificial Sequence: Synthetic oligonucleotide
  Target: DMPK; (+) strand; PAM type: NRG; PAM sequence: TGG
gtgccactcggggagttgcc

SEQ ID NO: 14620 - DNA, 20 bp, Artificial Sequence
  Description of Artificial Sequence: Synthetic oligonucleotide
  Target: DMPK; (+) strand; PAM type: NRG; PAM sequence: TGG
cactcggggagttgcctggt

SEQ ID NO: 14621 - DNA, 20 bp, Artificial Sequence
  Description of Artificial Sequence: Synthetic oligonucleotide
  Target: DMPK; (+) strand; PAM type: NRG; PAM sequence: GGG
actcggggagttgcctggtt

SEQ ID NO: 14622 - DNA, 20 bp, Artificial Sequence
  Description of Artificial Sequence: Synthetic oligonucleotide
  Target: DMPK; (+) strand; PAM type: NRG; PAM sequence: GAG
tcggggagttgcctggttgg

SEQ ID NO: 14623 - DNA, 20 bp, Artificial Sequence
  Description of Artificial Sequence: Synthetic oligonucleotide
  Target: DMPK; (+) strand; PAM type: NRG; PAM sequence: AGG
cggggagttgcctggttggg

SEQ ID NO: 14624 - DNA, 20 bp, Artificial Sequence
  Description of Artificial Sequence: Synthetic oligonucleotide
  Target: DMPK; (+) strand; PAM type: NRG; PAM sequence: GAG
gggagttgcctggttgggag

SEQ ID NO: 14625 - DNA, 20 bp, Artificial Sequence
  Description of Artificial Sequence: Synthetic oligonucleotide
  Target: DMPK; (+) strand; PAM type: NRG; PAM sequence: TGG
ctggttgggaggagatgccc

SEQ ID NO: 14626 - DNA, 20 bp, Artificial Sequence
  Description of Artificial Sequence: Synthetic oligonucleotide
  Target: DMPK; (+) strand; PAM type: NRG; PAM sequence: GGG
tggttgggaggagatgccct

SEQ ID NO: 14627 - DNA, 20 bp, Artificial Sequence
  Description of Artificial Sequence: Synthetic oligonucleotide
  Target: DMPK; (+) strand; PAM type: NRG; PAM sequence: GGG
ggttgggaggagatgccctg

SEQ ID NO: 14628 - DNA, 20 bp, Artificial Sequence
  Description of Artificial Sequence: Synthetic oligonucleotide
  Target: DMPK; (+) strand; PAM type: NRG; PAM sequence: AAG
tgggaggagatgccctgggg

SEQ ID NO: 14629 - DNA, 20 bp, Artificial Sequence
  Description of Artificial Sequence: Synthetic oligonucleotide
  Target: DMPK; (+) strand; PAM type: NRG; PAM sequence: GAG
ggagatgccctggggaagat

SEQ ID NO: 14630 - DNA, 20 bp, Artificial Sequence
  Description of Artificial Sequence: Synthetic oligonucleotide
  Target: DMPK; (+) strand; PAM type: NRG; PAM sequence: GAG
agatgccctggggaagatga

SEQ ID NO: 14631 - DNA, 20 bp, Artificial Sequence
  Description of Artificial Sequence: Synthetic oligonucleotide
  Target: DMPK; (+) strand; PAM type: NRG; PAM sequence: AGG
gatgccctggggaagatgag

SEQ ID NO: 14632 - DNA, 20 bp, Artificial Sequence
  Description of Artificial Sequence: Synthetic oligonucleotide
  Target: DMPK; (+) strand; PAM type: NRG; PAM sequence: GGG
atgccctggggaagatgaga

SEQ ID NO: 14633 - DNA, 20 bp, Artificial Sequence
  Description of Artificial Sequence: Synthetic oligonucleotide
  Target: DMPK; (+) strand; PAM type: NRG; PAM sequence: GAG
gccctggggaagatgagagg

SEQ ID NO: 14634 - DNA, 20 bp, Artificial Sequence
  Description of Artificial Sequence: Synthetic oligonucleotide
  Target: DMPK; (+) strand; PAM type: NRG; PAM sequence: GAG
cctggggaagatgagaggga

SEQ ID NO: 14635 - DNA, 20 bp, Artificial Sequence
  Description of Artificial Sequence: Synthetic oligonucleotide
  Target: DMPK; (+) strand; PAM type: NRG; PAM sequence: TGG
gggaagatgagagggagaga

SEQ ID NO: 14636 - DNA, 20 bp, Artificial Sequence
  Description of Artificial Sequence: Synthetic oligonucleotide
  Target: DMPK; (+) strand; PAM type: NRG; PAM sequence: GGG
ggaagatgagagggagagat

SEQ ID NO: 14637 - DNA, 20 bp, Artificial Sequence
  Description of Artificial Sequence: Synthetic oligonucleotide
  Target: DMPK; (+) strand; PAM type: NRG; PAM sequence: GAG
aagatgagagggagagatgg

SEQ ID NO: 14638 - DNA, 20 bp, Artificial Sequence
  Description of Artificial Sequence: Synthetic oligonucleotide
  Target: DMPK; (+) strand; PAM type: NRG; PAM sequence: AGG
agatgagagggagagatggg

SEQ ID NO: 14639 - DNA, 20 bp, Artificial Sequence
  Description of Artificial Sequence: Synthetic oligonucleotide
  Target: DMPK; (+) strand; PAM type: NRG; PAM sequence: GGG
gatgagagggagagatggga

SEQ ID NO: 14640 - DNA, 20 bp, Artificial Sequence
  Description of Artificial Sequence: Synthetic oligonucleotide
  Target: DMPK; (+) strand; PAM type: NRG; PAM sequence: GGG
atgagagggagagatgggag

SEQ ID NO: 14641 - DNA, 20 bp, Artificial Sequence
  Description of Artificial Sequence: Synthetic oligonucleotide
  Target: DMPK; (+) strand; PAM type: NRG; PAM sequence: TAG
gagggagagatgggaggggt

SEQ ID NO: 14642 - DNA, 20 bp, Artificial Sequence
  Description of Artificial Sequence: Synthetic oligonucleotide
  Target: DMPK; (+) strand; PAM type: NRG; PAM sequence: GAG
gggagagatgggaggggtta

SEQ ID NO: 14643 - DNA, 20 bp, Artificial Sequence
  Description of Artificial Sequence: Synthetic oligonucleotide
  Target: DMPK; (+) strand; PAM type: NRG; PAM sequence: TGG
gggaggggttagagaccacc

SEQ ID NO: 14644 - DNA, 20 bp, Artificial Sequence
  Description of Artificial Sequence: Synthetic oligonucleotide
  Target: DMPK; (+) strand; PAM type: NRG; PAM sequence: GGG
ggaggggttagagaccacct

SEQ ID NO: 14645 - DNA, 20 bp, Artificial Sequence
  Description of Artificial Sequence: Synthetic oligonucleotide
  Target: DMPK; (+) strand; PAM type: NRG; PAM sequence: CAG
gttagagaccacctgggctt

SEQ ID NO: 14646 - DNA, 20 bp, Artificial Sequence
  Description of Artificial Sequence: Synthetic oligonucleotide
  Target: DMPK; (+) strand; PAM type: NRG; PAM sequence: CAG
gagaccacctgggcttcagc

SEQ ID NO: 14647 - DNA, 20 bp, Artificial Sequence
  Description of Artificial Sequence: Synthetic oligonucleotide
  Target: DMPK; (+) strand; PAM type: NRG; PAM sequence: AAG
cctgggcttcagccagtgtc

SEQ ID NO: 14648 - DNA, 20 bp, Artificial Sequence
  Description of Artificial Sequence: Synthetic oligonucleotide
  Target: DMPK; (+) strand; PAM type: NRG; PAM sequence: AGG
ctgggcttcagccagtgtca

SEQ ID NO: 14649 - DNA, 20 bp, Artificial Sequence
  Description of Artificial Sequence: Synthetic oligonucleotide
  Target: DMPK; (+) strand; PAM type: NRG; PAM sequence: GGG
tgggcttcagccagtgtcaa

SEQ ID NO: 14650 - DNA, 20 bp, Artificial Sequence
  Description of Artificial Sequence: Synthetic oligonucleotide
  Target: DMPK; (+) strand; PAM type: NRG; PAM sequence: GGG
gggcttcagccagtgtcaag

SEQ ID NO: 14651 - DNA, 20 bp, Artificial Sequence
  Description of Artificial Sequence: Synthetic oligonucleotide
  Target: DMPK; (+) strand; PAM type: NRG; PAM sequence: GAG
gcttcagccagtgtcaaggg

SEQ ID NO: 14652 - DNA, 20 bp, Artificial Sequence
  Description of Artificial Sequence: Synthetic oligonucleotide
  Target: DMPK; (+) strand; PAM type: NRG; PAM sequence: AGG
cttcagccagtgtcaagggg

SEQ ID NO: 14653 - DNA, 20 bp, Artificial Sequence
  Description of Artificial Sequence: Synthetic oligonucleotide
  Target: DMPK; (+) strand; PAM type: NRG; PAM sequence: GGG
ttcagccagtgtcaagggga

SEQ ID NO: 14654 - DNA, 20 bp, Artificial Sequence
  Description of Artificial Sequence: Synthetic oligonucleotide
  Target: DMPK; (+) strand; PAM type: NRG; PAM sequence: GAG
cagccagtgtcaaggggagg

SEQ ID NO: 14655 - DNA, 20 bp, Artificial Sequence
  Description of Artificial Sequence: Synthetic oligonucleotide
  Target: DMPK; (+) strand; PAM type: NRG; PAM sequence: CAG
cagtgtcaaggggagggagc

SEQ ID NO: 14656 - DNA, 20 bp, Artificial Sequence
  Description of Artificial Sequence: Synthetic oligonucleotide
  Target: DMPK; (+) strand; PAM type: NRG; PAM sequence: CAG
tcaaggggagggagccagcc

SEQ ID NO: 14657 - DNA, 20 bp, Artificial Sequence
  Description of Artificial Sequence: Synthetic oligonucleotide
  Target: DMPK; (+) strand; PAM type: NRG; PAM sequence: GAG
aaggggagggagccagccca

SEQ ID NO: 14658 - DNA, 20 bp, Artificial Sequence
  Description of Artificial Sequence: Synthetic oligonucleotide
  Target: DMPK; (+) strand; PAM type: NRG; PAM sequence: AAG
gagccagcccagagtcccca

SEQ ID NO: 14659 - DNA, 20 bp, Artificial Sequence
  Description of Artificial Sequence: Synthetic oligonucleotide
  Target: DMPK; (+) strand; PAM type: NRG; PAM sequence: TGG
ccccaaagctgctgccaccc

SEQ ID NO: 14660 - DNA, 20 bp, Artificial Sequence
  Description of Artificial Sequence: Synthetic oligonucleotide
  Target: DMPK; (+) strand; PAM type: NRG; PAM sequence: TGG
tgccaccctggccttgccct

SEQ ID NO: 14661 - DNA, 20 bp, Artificial Sequence
  Description of Artificial Sequence: Synthetic oligonucleotide
  Target: DMPK; (+) strand; PAM type: NRG; PAM sequence: GGG
gccaccctggccttgccctt

SEQ ID NO: 14662 - DNA, 20 bp, Artificial Sequence
  Description of Artificial Sequence: Synthetic oligonucleotide
  Target: DMPK; (+) strand; PAM type: NRG; PAM sequence: TAG
ccttgcccttgggtccgccc

SEQ ID NO: 14663 - DNA, 20 bp, Artificial Sequence
  Description of Artificial Sequence: Synthetic oligonucleotide
  Target: DMPK; (+) strand; PAM type: NRG; PAM sequence: CAG
tgggtccgccctagaccccc

SEQ ID NO: 14664 - DNA, 20 bp, Artificial Sequence
  Description of Artificial Sequence: Synthetic oligonucleotide
  Target: DMPK; (+) strand; PAM type: NRG; PAM sequence: GAG
ggtccgccctagacccccca

SEQ ID NO: 14665 - DNA, 20 bp, Artificial Sequence
  Description of Artificial Sequence: Synthetic oligonucleotide
  Target: DMPK; (+) strand; PAM type: NRG; PAM sequence: AGG
gtccgccctagaccccccag

SEQ ID NO: 14666 - DNA, 20 bp, Artificial Sequence
  Description of Artificial Sequence: Synthetic oligonucleotide
  Target: DMPK; (+) strand; PAM type: NRG; PAM sequence: TAG
ccccccagaggccactgctc

SEQ ID NO: 14667 - DNA, 20 bp, Artificial Sequence
  Description of Artificial Sequence: Synthetic oligonucleotide
  Target: DMPK; (+) strand; PAM type: NRG; PAM sequence: AGG
cccccagaggccactgctct

SEQ ID NO: 14668 - DNA, 20 bp, Artificial Sequence
  Description of Artificial Sequence: Synthetic oligonucleotide
  Target: DMPK; (+) strand; PAM type: NRG; PAM sequence: TGG
cagaggccactgctctaggc

SEQ ID NO: 14669 - DNA, 20 bp, Artificial Sequence
  Description of Artificial Sequence: Synthetic oligonucleotide
  Target: DMPK; (+) strand; PAM type: NRG; PAM sequence: GGG
agaggccactgctctaggct

SEQ ID NO: 14670 - DNA, 20 bp, Artificial Sequence
  Description of Artificial Sequence: Synthetic oligonucleotide
  Target: DMPK; (+) strand; PAM type: NRG; PAM sequence: TAG
taggctgggaacttgcatct

SEQ ID NO: 14671 - DNA, 20 bp, Artificial Sequence
  Description of Artificial Sequence: Synthetic oligonucleotide
  Target: DMPK; (+) strand; PAM type: NRG; PAM sequence: TAG
ctgggaacttgcatcttagc

SEQ ID NO: 14672 - DNA, 20 bp, Artificial Sequence
  Description of Artificial Sequence: Synthetic oligonucleotide
  Target: DMPK; (+) strand; PAM type: NRG; PAM sequence: TGG
tcttagctagcttcctgtcc

SEQ ID NO: 14673 - DNA, 20 bp, Artificial Sequence
  Description of Artificial Sequence: Synthetic oligonucleotide
  Target: DMPK; (+) strand; PAM type: NRG; PAM sequence: CAG
tagctagcttcctgtcctgg

SEQ ID NO: 14674 - DNA, 20 bp, Artificial Sequence
  Description of Artificial Sequence: Synthetic oligonucleotide
  Target: DMPK; (+) strand; PAM type: NRG; PAM sequence: CAG
tagcttcctgtcctggcagt

SEQ ID NO: 14675 - DNA, 20 bp, Artificial Sequence
  Description of Artificial Sequence: Synthetic oligonucleotide
  Target: DMPK; (+) strand; PAM type: NRG; PAM sequence: AAG
gcactttcacgcaataatca

SEQ ID NO: 14676 - DNA, 20 bp, Artificial Sequence
  Description of Artificial Sequence: Synthetic oligonucleotide
  Target: DMPK; (+) strand; PAM type: NRG; PAM sequence: TGG
cacgcaataatcaaagtcct

SEQ ID NO: 14677 - DNA, 20 bp, Artificial Sequence
  Description of Artificial Sequence: Synthetic oligonucleotide
  Target: DMPK; (+) strand; PAM type: NRG; PAM sequence: CGG
gcaataatcaaagtccttgg

SEQ ID NO: 14678 - DNA, 20 bp, Artificial Sequence
  Description of Artificial Sequence: Synthetic oligonucleotide
  Target: DMPK; (+) strand; PAM type: NRG; PAM sequence: GAG
caaagtccttggcggatcct

SEQ ID NO: 14679 - DNA, 20 bp, Artificial Sequence
  Description of Artificial Sequence: Synthetic oligonucleotide
  Target: DMPK; (+) strand; PAM type: NRG; PAM sequence: GAG
gtccttggcggatcctgagt

SEQ ID NO: 14680 - DNA, 20 bp, Artificial Sequence
  Description of Artificial Sequence: Synthetic oligonucleotide
  Target: DMPK; (+) strand; PAM type: NRG; PAM sequence: TGG
gcggatcctgagtgagacca

SEQ ID NO: 14681 - DNA, 20 bp, Artificial Sequence
  Description of Artificial Sequence: Synthetic oligonucleotide
  Target: DMPK; (+) strand; PAM type: NRG; PAM sequence: GGG
cggatcctgagtgagaccat

SEQ ID NO: 14682 - DNA, 20 bp, Artificial Sequence
  Description of Artificial Sequence: Synthetic oligonucleotide
  Target: DMPK; (+) strand; PAM type: NRG; PAM sequence: GGG
ggatcctgagtgagaccatg

SEQ ID NO: 14683 - DNA, 20 bp, Artificial Sequence
  Description of Artificial Sequence: Synthetic oligonucleotide
  Target: DMPK; (+) strand; PAM type: NRG; PAM sequence: AAG
cctgagtgagaccatggggt

SEQ ID NO: 14684 - DNA, 20 bp, Artificial Sequence
  Description of Artificial Sequence: Synthetic oligonucleotide
  Target: DMPK; (+) strand; PAM type: NRG; PAM sequence: AGG
ctgagtgagaccatggggta

SEQ ID NO: 14685 - DNA, 20 bp, Artificial Sequence
  Description of Artificial Sequence: Synthetic oligonucleotide
  Target: DMPK; (+) strand; PAM type: NRG; PAM sequence: GGG
tgagtgagaccatggggtaa

SEQ ID NO: 14686 - DNA, 20 bp, Artificial Sequence
  Description of Artificial Sequence: Synthetic oligonucleotide
  Target: DMPK; (+) strand; PAM type: NRG; PAM sequence: AAG
tgagaccatggggtaagggt

SEQ ID NO: 14687 - DNA, 20 bp, Artificial Sequence
  Description of Artificial Sequence: Synthetic oligonucleotide
  Target: DMPK; (+) strand; PAM type: NRG; PAM sequence: AGG
gagaccatggggtaagggta

SEQ ID NO: 14688 - DNA, 20 bp, Artificial Sequence
  Description of Artificial Sequence: Synthetic oligonucleotide
  Target: DMPK; (+) strand; PAM type: NRG; PAM sequence: GGG
agaccatggggtaagggtaa

SEQ ID NO: 14689 - DNA, 20 bp, Artificial Sequence
  Description of Artificial Sequence: Synthetic oligonucleotide
  Target: DMPK; (+) strand; PAM type: NRG; PAM sequence: TGG
ccatggggtaagggtaaggg

SEQ ID NO: 14690 - DNA, 20 bp, Artificial Sequence
  Description of Artificial Sequence: Synthetic oligonucleotide
  Target: DMPK; (+) strand; PAM type: NRG; PAM sequence: GGG
catggggtaagggtaagggt

SEQ ID NO: 14691 - DNA, 20 bp, Artificial Sequence
  Description of Artificial Sequence: Synthetic oligonucleotide
  Target: DMPK; (+) strand; PAM type: NRG; PAM sequence: GAG
tggggtaagggtaagggtgg

SEQ ID NO: 14692 - DNA, 20 bp, Artificial Sequence
  Description of Artificial Sequence: Synthetic oligonucleotide
  Target: DMPK; (+) strand; PAM type: NRG; PAM sequence: AGG
ggggtaagggtaagggtggg

SEQ ID NO: 14693 - DNA, 20 bp, Artificial Sequence
  Description of Artificial Sequence: Synthetic oligonucleotide
  Target: DMPK; (+) strand; PAM type: NRG; PAM sequence: GGG
gggtaagggtaagggtggga

SEQ ID NO: 14694 - DNA, 20 bp, Artificial Sequence
  Description of Artificial Sequence: Synthetic oligonucleotide
  Target: DMPK; (+) strand; PAM type: NRG; PAM sequence: GGG
ggtaagggtaagggtgggag

SEQ ID NO: 14695 - DNA, 20 bp, Artificial Sequence
  Description of Artificial Sequence: Synthetic oligonucleotide
  Target: DMPK; (+) strand; PAM type: NRG; PAM sequence: GAG
taagggtaagggtgggaggg

SEQ ID NO: 14696 - DNA, 20 bp, Artificial Sequence
  Description of Artificial Sequence: Synthetic oligonucleotide
  Target: DMPK; (+) strand; PAM type: NRG; PAM sequence: AGG
aagggtaagggtgggagggg

SEQ ID NO: 14697 - DNA, 20 bp, Artificial Sequence
  Description of Artificial Sequence: Synthetic oligonucleotide
  Target: DMPK; (+) strand; PAM type: NRG; PAM sequence: GGG
agggtaagggtgggagggga

SEQ ID NO: 14698 - DNA, 20 bp, Artificial Sequence
  Description of Artificial Sequence: Synthetic oligonucleotide
  Target: DMPK; (+) strand; PAM type: NRG; PAM sequence: GGG
gggtaagggtgggaggggag

SEQ ID NO: 14699 - DNA, 20 bp, Artificial Sequence
  Description of Artificial Sequence: Synthetic oligonucleotide
  Target: DMPK; (+) strand; PAM type: NRG; PAM sequence: GGG
ggtaagggtgggaggggagg

SEQ ID NO: 14700 - DNA, 20 bp, Artificial Sequence
  Description of Artificial Sequence: Synthetic oligonucleotide
  Target: DMPK; (+) strand; PAM type: NRG; PAM sequence: TGG
gtgggaggggagggggaaac

SEQ ID NO: 14701 - DNA, 20 bp, Artificial Sequence
  Description of Artificial Sequence: Synthetic oligonucleotide
  Target: DMPK; (+) strand; PAM type: NRG; PAM sequence: GAG
gggaggggagggggaaactg

SEQ ID NO: 14702 - DNA, 20 bp, Artificial Sequence
  Description of Artificial Sequence: Synthetic oligonucleotide
  Target: DMPK; (+) strand; PAM type: NRG; PAM sequence: TGG
actggagctcccttctaact

SEQ ID NO: 14703 - DNA, 20 bp, Artificial Sequence
  Description of Artificial Sequence: Synthetic oligonucleotide
  Target: DMPK; (+) strand; PAM type: NRG; PAM sequence: GGG
ctggagctcccttctaactt

SEQ ID NO: 14704 - DNA, 20 bp, Artificial Sequence
  Description of Artificial Sequence: Synthetic oligonucleotide
  Target: DMPK; (+) strand; PAM type: NRG; PAM sequence: GAG
ggagctcccttctaacttgg

SEQ ID NO: 14705 - DNA, 20 bp, Artificial Sequence
  Description of Artificial Sequence: Synthetic oligonucleotide
  Target: DMPK; (+) strand; PAM type: NRG; PAM sequence: AGG
gagctcccttctaacttggg

SEQ ID NO: 14706 - DNA, 20 bp, Artificial Sequence
  Description of Artificial Sequence: Synthetic oligonucleotide
  Target: DMPK; (+) strand; PAM type: NRG; PAM sequence: GGG
agctcccttctaacttggga

SEQ ID NO: 14707 - DNA, 20 bp, Artificial Sequence
  Description of Artificial Sequence: Synthetic oligonucleotide
  Target: DMPK; (+) strand; PAM type: NRG; PAM sequence: GAG
tctaacttgggagggaccct

SEQ ID NO: 14708 - DNA, 20 bp, Artificial Sequence
  Description of Artificial Sequence: Synthetic oligonucleotide
  Target: DMPK; (+) strand; PAM type: NRG; PAM sequence: AGG
ctaacttgggagggaccctg

SEQ ID NO: 14709 - DNA, 20 bp, Artificial Sequence
  Description of Artificial Sequence: Synthetic oligonucleotide
  Target: DMPK; (+) strand; PAM type: NRG; PAM sequence: TGG
tgggagggaccctgaggtgc

SEQ ID NO: 14710 - DNA, 20 bp, Artificial Sequence
  Description of Artificial Sequence: Synthetic oligonucleotide
  Target: DMPK; (+) strand; PAM type: NRG; PAM sequence: GGG
gggagggaccctgaggtgct

SEQ ID NO: 14711 - DNA, 20 bp, Artificial Sequence
  Description of Artificial Sequence: Synthetic oligonucleotide
  Target: DMPK; (+) strand; PAM type: NRG; PAM sequence: GGG
ggagggaccctgaggtgctg

SEQ ID NO: 14712 - DNA, 20 bp, Artificial Sequence
  Description of Artificial Sequence: Synthetic oligonucleotide
  Target: DMPK; (+) strand; PAM type: NRG; PAM sequence: AAG
ggaccctgaggtgctgggga

SEQ ID NO: 14713 - DNA, 20 bp, Artificial Sequence
  Description of Artificial Sequence: Synthetic oligonucleotide
  Target: DMPK; (+) strand; PAM type: NRG; PAM sequence: CAG
gaggtgctggggaaagaact

SEQ ID NO: 14714 - DNA, 20 bp, Artificial Sequence
  Description of Artificial Sequence: Synthetic oligonucleotide
  Target: DMPK; (+) strand; PAM type: NRG; PAM sequence: AGG
aggtgctggggaaagaactc

SEQ ID NO: 14715 - DNA, 20 bp, Artificial Sequence
  Description of Artificial Sequence: Synthetic oligonucleotide
  Target: DMPK; (+) strand; PAM type: NRG; PAM sequence: GGG
ggtgctggggaaagaactca

SEQ ID NO: 14716 - DNA, 20 bp, Artificial Sequence
  Description of Artificial Sequence: Synthetic oligonucleotide
  Target: DMPK; (+) strand; PAM type: NRG; PAM sequence: CAG
ctggggaaagaactcaggga

SEQ ID NO: 14717 - DNA, 20 bp, Artificial Sequence
  Description of Artificial Sequence: Synthetic oligonucleotide
  Target: DMPK; (+) strand; PAM type: NRG; PAM sequence: TGG
tacctctaccactgacttgc

SEQ ID NO: 14718 - DNA, 20 bp, Artificial Sequence
  Description of Artificial Sequence: Synthetic oligonucleotide
  Target: DMPK; (+) strand; PAM type: NRG; PAM sequence: GGG
acctctaccactgacttgct

SEQ ID NO: 14719 - DNA, 20 bp, Artificial Sequence
  Description of Artificial Sequence: Synthetic oligonucleotide
  Target: DMPK; (+) strand; PAM type: NRG; PAM sequence: TGG
cactgacttgctgggtgacc

SEQ ID NO: 14720 - DNA, 20 bp, Artificial Sequence
  Description of Artificial Sequence: Synthetic oligonucleotide
  Target: DMPK; (+) strand; PAM type: NRG; PAM sequence: GGG
actgacttgctgggtgacct

SEQ ID NO: 14721 - DNA, 20 bp, Artificial Sequence
  Description of Artificial Sequence: Synthetic oligonucleotide
  Target: DMPK; (+) strand; PAM type: NRG; PAM sequence: TGG
gccaacttccttcccctgtc

SEQ ID NO: 14722 - DNA, 20 bp, Artificial Sequence
  Description of Artificial Sequence: Synthetic oligonucleotide
  Target: DMPK; (+) strand; PAM type: NRG; PAM sequence: GGG
ccaacttccttcccctgtct

SEQ ID NO: 14723 - DNA, 20 bp, Artificial Sequence
  Description of Artificial Sequence: Synthetic oligonucleotide
  Target: DMPK; (+) strand; PAM type: NRG; PAM sequence: CGG
tccttcccctgtctgggcct

SEQ ID NO: 14724 - DNA, 20 bp, Artificial Sequence
  Description of Artificial Sequence: Synthetic oligonucleotide
  Target: DMPK; (+) strand; PAM type: NRG; PAM sequence: CGG
gtctcctcgtctgtgaacta

SEQ ID NO: 14725 - DNA, 20 bp, Artificial Sequence
  Description of Artificial Sequence: Synthetic oligonucleotide
  Target: DMPK; (+) strand; PAM type: NRG; PAM sequence: GAG
ctcctcgtctgtgaactacg

SEQ ID NO: 14726 - DNA, 20 bp, Artificial Sequence
  Description of Artificial Sequence: Synthetic oligonucleotide
  Target: DMPK; (+) strand; PAM type: NRG; PAM sequence: CAG
tcgtctgtgaactacggaga

SEQ ID NO: 14727 - DNA, 20 bp, Artificial Sequence
  Description of Artificial Sequence: Synthetic oligonucleotide
  Target: DMPK; (+) strand; PAM type: NRG; PAM sequence: GAG
gtctgtgaactacggagaca

SEQ ID NO: 14728 - DNA, 20 bp, Artificial Sequence
  Description of Artificial Sequence: Synthetic oligonucleotide
  Target: DMPK; (+) strand; PAM type: NRG; PAM sequence: AGG
tctgtgaactacggagacag

SEQ ID NO: 14729 - DNA, 20 bp, Artificial Sequence
  Description of Artificial Sequence: Synthetic oligonucleotide
  Target: DMPK; (+) strand; PAM type: NRG; PAM sequence: GGG
ctgtgaactacggagacaga

SEQ ID NO: 14730 - DNA, 20 bp, Artificial Sequence
  Description of Artificial Sequence: Synthetic oligonucleotide
  Target: DMPK; (+) strand; PAM type: NRG; PAM sequence: GGG
tgtgaactacggagacagag

SEQ ID NO: 14731 - DNA, 20 bp, Artificial Sequence
  Description of Artificial Sequence: Synthetic oligonucleotide
  Target: DMPK; (+) strand; PAM type: NRG; PAM sequence: TAG
ggagacagaggggtctcttt

SEQ ID NO: 14732 - DNA, 20 bp, Artificial Sequence
  Description of Artificial Sequence: Synthetic oligonucleotide
  Target: DMPK; (+) strand; PAM type: NRG; PAM sequence: AGG
gagacagaggggtctctttt

SEQ ID NO: 14733 - DNA, 20 bp, Artificial Sequence
  Description of Artificial Sequence: Synthetic oligonucleotide
  Target: DMPK; (+) strand; PAM type: NRG; PAM sequence: CAG
ggtctcttttaggactcaac

SEQ ID NO: 14734 - DNA, 20 bp, Artificial Sequence
  Description of Artificial Sequence: Synthetic oligonucleotide
  Target: DMPK; (+) strand; PAM type: NRG; PAM sequence: GAG
atcccaccactcttgcctct

SEQ ID NO: 14735 - DNA, 20 bp, Artificial Sequence
  Description of Artificial Sequence: Synthetic oligonucleotide
  Target: DMPK; (+) strand; PAM type: NRG; PAM sequence: CAG
actcttgcctctgagtcact

SEQ ID NO: 14736 - DNA, 20 bp, Artificial Sequence
  Description of Artificial Sequence: Synthetic oligonucleotide
  Target: DMPK; (+) strand; PAM type: NRG; PAM sequence: AAG
gtcactcagactgtgctctc

SEQ ID NO: 14737 - DNA, 20 bp, Artificial Sequence
  Description of Artificial Sequence: Synthetic oligonucleotide
  Target: DMPK; (+) strand; PAM type: NRG; PAM sequence: TAG
cagactgtgctctcaagttc

SEQ ID NO: 14738 - DNA, 20 bp, Artificial Sequence
  Description of Artificial Sequence: Synthetic oligonucleotide
  Target: DMPK; (+) strand; PAM type: NRG; PAM sequence: AGG
agactgtgctctcaagttct

SEQ ID NO: 14739 - DNA, 20 bp, Artificial Sequence
  Description of Artificial Sequence: Synthetic oligonucleotide
  Target: DMPK; (+) strand; PAM type: NRG; PAM sequence: GGG
gactgtgctctcaagttcta

SEQ ID NO: 14740 - DNA, 20 bp, Artificial Sequence
  Description of Artificial Sequence: Synthetic oligonucleotide
  Target: DMPK; (+) strand; PAM type: NRG; PAM sequence: CAG
gctctcaagttctagggact

SEQ ID NO: 14741 - DNA, 20 bp, Artificial Sequence
  Description of Artificial Sequence: Synthetic oligonucleotide
  Target: DMPK; (+) strand; PAM type: NRG; PAM sequence: AGG
ctctcaagttctagggactc

SEQ ID NO: 14742 - DNA, 20 bp, Artificial Sequence
  Description of Artificial Sequence: Synthetic oligonucleotide
  Target: DMPK; (+) strand; PAM type: NRG; PAM sequence: GAG
gactctacgattccaaaact

SEQ ID NO: 14743 - DNA, 20 bp, Artificial Sequence
  Description of Artificial Sequence: Synthetic oligonucleotide
  Target: DMPK; (+) strand; PAM type: NRG; PAM sequence: AGG
actctacgattccaaaactg

SEQ ID NO: 14744 - DNA, 20 bp, Artificial Sequence
  Description of Artificial Sequence: Synthetic oligonucleotide
  Target: DMPK; (+) strand; PAM type: NRG; PAM sequence: GAG
gattccaaaactgaggatct

SEQ ID NO: 14745 - DNA, 20 bp, Artificial Sequence
  Description of Artificial Sequence: Synthetic oligonucleotide
  Target: DMPK; (+) strand; PAM type: NRG; PAM sequence: AGG
attccaaaactgaggatctg

SEQ ID NO: 14746 - DNA, 20 bp, Artificial Sequence
  Description of Artificial Sequence: Synthetic oligonucleotide
  Target: DMPK; (+) strand; PAM type: NRG; PAM sequence: AAG
aactgaggatctgaggaacc

SEQ ID NO: 14747 - DNA, 20 bp, Artificial Sequence
  Description of Artificial Sequence: Synthetic oligonucleotide
  Target: DMPK; (+) strand; PAM type: NRG; PAM sequence: CGG
ggatctgaggaaccaagcca

SEQ ID NO: 14748 - DNA, 20 bp, Artificial Sequence
  Description of Artificial Sequence: Synthetic oligonucleotide
  Target: DMPK; (+) strand; PAM type: NRG; PAM sequence: CAG
aggaaccaagccacggcctc

SEQ ID NO: 14749 - DNA, 20 bp, Artificial Sequence
  Description of Artificial Sequence: Synthetic oligonucleotide
  Target: DMPK; (+) strand; PAM type: NRG; PAM sequence: AGG
ggaaccaagccacggcctcc

SEQ ID NO: 14750 - DNA, 20 bp, Artificial Sequence
  Description of Artificial Sequence: Synthetic oligonucleotide
  Target: DMPK; (+) strand; PAM type: NRG; PAM sequence: TGG
agccacggcctccaggaccc

SEQ ID NO: 14751 - DNA, 20 bp, Artificial Sequence
  Description of Artificial Sequence: Synthetic oligonucleotide
  Target: DMPK; (+) strand; PAM type: NRG; PAM sequence: GGG
gccacggcctccaggaccct

SEQ ID NO: 14752 - DNA, 20 bp, Artificial Sequence
  Description of Artificial Sequence: Synthetic oligonucleotide
  Target: DMPK; (+) strand; PAM type: NRG; PAM sequence: GAG
ctccaggaccctgggcaact

SEQ ID NO: 14753 - DNA, 20 bp, Artificial Sequence
  Description of Artificial Sequence: Synthetic oligonucleotide
  Target: DMPK; (+) strand; PAM type: NRG; PAM sequence: AAG
gaccctgggcaactgagtcc

SEQ ID NO: 14754 - DNA, 20 bp, Artificial Sequence
  Description of Artificial Sequence: Synthetic oligonucleotide
  Target: DMPK; (+) strand; PAM type: NRG; PAM sequence: AAG
ggcaactgagtccaagccct

SEQ ID NO: 14755 - DNA, 20 bp, Artificial Sequence
  Description of Artificial Sequence: Synthetic oligonucleotide
  Target: DMPK; (+) strand; PAM type: NRG; PAM sequence: AAG
aactgagtccaagccctaag

SEQ ID NO: 14756 - DNA, 20 bp, Artificial Sequence
  Description of Artificial Sequence: Synthetic oligonucleotide
  Target: DMPK; (+) strand; PAM type: NRG; PAM sequence: GAG
agtccaagccctaagaagct

SEQ ID NO: 14757 - DNA, 20 bp, Artificial Sequence
  Description of Artificial Sequence: Synthetic oligonucleotide
  Target: DMPK; (+) strand; PAM type: NRG; PAM sequence: AAG
cctaagaagctgagacaccc

SEQ ID NO: 14758 - DNA, 20 bp, Artificial Sequence
  Description of Artificial Sequence: Synthetic oligonucleotide
  Target: DMPK; (+) strand; PAM type: NRG; PAM sequence: GAG
gaagctgagacacccaagac

SEQ ID NO: 14759 - DNA, 20 bp, Artificial Sequence
  Description of Artificial Sequence: Synthetic oligonucleotide
  Target: DMPK; (+) strand; PAM type: NRG; PAM sequence: AAG
aagacgagctccgaacttac

SEQ ID NO: 14760 - DNA, 20 bp, Artificial Sequence
  Description of Artificial Sequence: Synthetic oligonucleotide
  Target: DMPK; (+) strand; PAM type: NRG; PAM sequence: CAG
gctccgaacttacaagatgc

SEQ ID NO: 14761 - DNA, 20 bp, Artificial Sequence
  Description of Artificial Sequence: Synthetic oligonucleotide
  Target: DMPK; (+) strand; PAM type: NRG; PAM sequence: AGG
ctccgaacttacaagatgcc

SEQ ID NO: 14762 - DNA, 20 bp, Artificial Sequence
  Description of Artificial Sequence: Synthetic oligonucleotide
  Target: DMPK; (+) strand; PAM type: NRG; PAM sequence: CAG
ctatgaccttcccaacgcca

SEQ ID NO: 14763 - DNA, 20 bp, Artificial Sequence
  Description of Artificial Sequence: Synthetic oligonucleotide
  Target: DMPK; (+) strand; PAM type: NRG; PAM sequence: CAG
tcccaacgccacagcccacc

SEQ ID NO: 14764 - DNA, 20 bp, Artificial Sequence
  Description of Artificial Sequence: Synthetic oligonucleotide
  Target: DMPK; (+) strand; PAM type: NRG; PAM sequence: AGG
cccaacgccacagcccaccc

SEQ ID NO: 14765 - DNA, 20 bp, Artificial Sequence
  Description of Artificial Sequence: Synthetic oligonucleotide
  Target: DMPK; (+) strand; PAM type: NRG; PAM sequence: GAG
caacgccacagcccacccag

SEQ ID NO: 14766 - DNA, 20 bp, Artificial Sequence
  Description of Artificial Sequence: Synthetic oligonucleotide
  Target: DMPK; (+) strand; PAM type: NRG; PAM sequence: AGG
aacgccacagcccacccagg

SEQ ID NO: 14767 - DNA, 20 bp, Artificial Sequence
  Description of Artificial Sequence: Synthetic oligonucleotide
  Target: DMPK; (+) strand; PAM type: NRG; PAM sequence: AAG
ccacagcccacccaggaggc

SEQ ID NO: 14768 - DNA, 20 bp, Artificial Sequence
  Description of Artificial Sequence: Synthetic oligonucleotide
  Target: DMPK; (+) strand; PAM type: NRG; PAM sequence: CAG
tccacccactgcccatccta

SEQ ID NO: 14769 - DNA, 20 bp, Artificial Sequence
  Description of Artificial Sequence: Synthetic oligonucleotide
  Target: DMPK; (+) strand; PAM type: NRG; PAM sequence: AGG
ccacccactgcccatcctac

SEQ ID NO: 14770 - DNA, 20 bp, Artificial Sequence
  Description of Artificial Sequence: Synthetic oligonucleotide
  Target: DMPK; (+) strand; PAM type: NRG; PAM sequence: AAG
catcctacaggctctgttct

SEQ ID NO: 14771 - DNA, 20 bp, Artificial Sequence
  Description of Artificial Sequence: Synthetic oligonucleotide
  Target: DMPK; (+) strand; PAM type: NRG; PAM sequence: GAG
tcctacaggctctgttctaa

SEQ ID NO: 14772 - DNA, 20 bp, Artificial Sequence
  Description of Artificial Sequence: Synthetic oligonucleotide
  Target: DMPK; (+) strand; PAM type: NRG; PAM sequence: AGG
cctacaggctctgttctaag

SEQ ID NO: 14773 - DNA, 20 bp, Artificial Sequence
  Description of Artificial Sequence: Synthetic oligonucleotide
  Target: DMPK; (+) strand; PAM type: NRG; PAM sequence: GAG
gctctgttctaagaggtgat

SEQ ID NO: 14774 - DNA, 20 bp, Artificial Sequence
  Description of Artificial Sequence: Synthetic oligonucleotide
  Target: DMPK; (+) strand; PAM type: NRG; PAM sequence: TGG
tgttctaagaggtgatgagt

SEQ ID NO: 14775 - DNA, 20 bp, Artificial Sequence
  Description of Artificial Sequence: Synthetic oligonucleotide
  Target: DMPK; (+) strand; PAM type: NRG; PAM sequence: GAG
ttctaagaggtgatgagttg

SEQ ID NO: 14776 - DNA, 20 bp, Artificial Sequence
  Description of Artificial Sequence: Synthetic oligonucleotide
  Target: DMPK; (+) strand; PAM type: NRG; PAM sequence: AGG
tctaagaggtgatgagttgg

SEQ ID NO: 14777 - DNA, 20 bp, Artificial Sequence
  Description of Artificial Sequence: Synthetic oligonucleotide
  Target: DMPK; (+) strand; PAM type: NRG; PAM sequence: CAG
agaggtgatgagttggaggt

SEQ ID NO: 14778 - DNA, 20 bp, Artificial Sequence
  Description of Artificial Sequence: Synthetic oligonucleotide
  Target: DMPK; (+) strand; PAM type: NRG; PAM sequence: GAG
aggtgatgagttggaggtca

SEQ ID NO: 14779 - DNA, 20 bp, Artificial Sequence
  Description of Artificial Sequence: Synthetic oligonucleotide
  Target: DMPK; (+) strand; PAM type: NRG; PAM sequence: AGG
ggtgatgagttggaggtcag

SEQ ID NO: 14780 - DNA, 20 bp, Artificial Sequence
  Description of Artificial Sequence: Synthetic oligonucleotide
  Target: DMPK; (+) strand; PAM type: NRG; PAM sequence: GGG
gtgatgagttggaggtcaga

SEQ ID NO: 14781 - DNA, 20 bp, Artificial Sequence
  Description of Artificial Sequence: Synthetic oligonucleotide
  Target: DMPK; (+) strand; PAM type: NRG; PAM sequence: GGG
tgatgagttggaggtcagag

SEQ ID NO: 14782 - DNA, 20 bp, Artificial Sequence
  Description of Artificial Sequence: Synthetic oligonucleotide
  Target: DMPK; (+) strand; PAM type: NRG; PAM sequence: GGG
gatgagttggaggtcagagg

SEQ ID NO: 14783 - DNA, 20 bp, Artificial Sequence
  Description of Artificial Sequence: Synthetic oligonucleotide
  Target: DMPK; (+) strand; PAM type: NRG; PAM sequence: CAG
gagttggaggtcagaggggg

SEQ ID NO: 14784 - DNA, 20 bp, Artificial Sequence
  Description of Artificial Sequence: Synthetic oligonucleotide
  Target: DMPK; (+) strand; PAM type: NRG; PAM sequence: CAG
agagggggcagtgacttgtc

SEQ ID NO: 14785 - DNA, 20 bp, Artificial Sequence
  Description of Artificial Sequence: Synthetic oligonucleotide
  Target: DMPK; (+) strand; PAM type: NRG; PAM sequence: AGG
gagggggcagtgacttgtcc

SEQ ID NO: 14786 - DNA, 20 bp, Artificial Sequence
  Description of Artificial Sequence: Synthetic oligonucleotide
  Target: DMPK; (+) strand; PAM type: NRG; PAM sequence: GGG
agggggcagtgacttgtcca

SEQ ID NO: 14787 - DNA, 20 bp, Artificial Sequence
  Description of Artificial Sequence: Synthetic oligonucleotide
  Target: DMPK; (+) strand; PAM type: NRG; PAM sequence: CAG
cagtgacttgtccagggtca

SEQ ID NO: 14788 - DNA, 20 bp, Artificial Sequence
  Description of Artificial Sequence: Synthetic oligonucleotide
  Target: DMPK; (+) strand; PAM type: NRG; PAM sequence: GAG
gtgacttgtccagggtcaca

SEQ ID NO: 14789 - DNA, 20 bp, Artificial Sequence
  Description of Artificial Sequence: Synthetic oligonucleotide
  Target: DMPK; (+) strand; PAM type: NRG; PAM sequence: AGG
tgacttgtccagggtcacag

SEQ ID NO: 14790 - DNA, 20 bp, Artificial Sequence
  Description of Artificial Sequence: Synthetic oligonucleotide
  Target: DMPK; (+) strand; PAM type: NRG; PAM sequence: GGG
gacttgtccagggtcacaga

SEQ ID NO: 14791 - DNA, 20 bp, Artificial Sequence
  Description of Artificial Sequence: Synthetic oligonucleotide
  Target: DMPK; (+) strand; PAM type: NRG; PAM sequence: GAG
cttgtccagggtcacagagg

SEQ ID NO: 14792 - DNA, 20 bp, Artificial Sequence
  Description of Artificial Sequence: Synthetic oligonucleotide
  Target: DMPK; (+) strand; PAM type: NRG; PAM sequence: TGG
gtccagggtcacagagggag

SEQ ID NO: 14793 - DNA, 20 bp, Artificial Sequence
  Description of Artificial Sequence: Synthetic oligonucleotide
  Target: DMPK; (+) strand; PAM type: NRG; PAM sequence: GGG
tccagggtcacagagggagt

SEQ ID NO: 14794 - DNA, 20 bp, Artificial Sequence
  Description of Artificial Sequence: Synthetic oligonucleotide
  Target: DMPK; (+) strand; PAM type: NRG; PAM sequence: TGG
ggtcacagagggagtgggac

SEQ ID NO: 14795 - DNA, 20 bp, Artificial Sequence
  Description of Artificial Sequence: Synthetic oligonucleotide
  Target: DMPK; (+) strand; PAM type: NRG; PAM sequence: CAG
gagggagtgggactggaacc

SEQ ID NO: 14796 - DNA, 20 bp, Artificial Sequence
  Description of Artificial Sequence: Synthetic oligonucleotide
  Target: DMPK; (+) strand; PAM type: NRG; PAM sequence: AGG
agggagtgggactggaaccc

SEQ ID NO: 14797 - DNA, 20 bp, Artificial Sequence
  Description of Artificial Sequence: Synthetic oligonucleotide
  Target: DMPK; (+) strand; PAM type: NRG; PAM sequence: TGG
gtgggactggaacccaggcc

SEQ ID NO: 14798 - DNA, 20 bp, Artificial Sequence
  Description of Artificial Sequence: Synthetic oligonucleotide
  Target: DMPK; (+) strand; PAM type: NRG; PAM sequence: GGG
tgggactggaacccaggcct

SEQ ID NO: 14799 - DNA, 20 bp, Artificial Sequence
  Description of Artificial Sequence: Synthetic oligonucleotide
  Target: DMPK; (+) strand; PAM type: NRG; PAM sequence: CAG
gaacccaggcctgggattcc

SEQ ID NO: 14800 - DNA, 20 bp, Artificial Sequence
  Description of Artificial Sequence: Synthetic oligonucleotide
  Target: DMPK; (+) strand; PAM type: NRG; PAM sequence: CAG
ggattcccagcctgtgcctt

SEQ ID NO: 14801 - DNA, 20 bp, Artificial Sequence
  Description of Artificial Sequence: Synthetic oligonucleotide
  Target: DMPK; (+) strand; PAM type: NRG; PAM sequence: CAG
ttcccagcctgtgccttcag

SEQ ID NO: 14802 - DNA, 20 bp, Artificial Sequence
  Description of Artificial Sequence: Synthetic oligonucleotide
  Target: DMPK; (+) strand; PAM type: NRG; PAM sequence: AGG
tcccagcctgtgccttcagc

SEQ ID NO: 14803 - DNA, 20 bp, Artificial Sequence
  Description of Artificial Sequence: Synthetic oligonucleotide
  Target: DMPK; (+) strand; PAM type: NRG; PAM sequence: GAG
ccagcctgtgccttcagcag

SEQ ID NO: 14804 - DNA, 20 bp, Artificial Sequence
  Description of Artificial Sequence: Synthetic oligonucleotide
  Target: DMPK; (+) strand; PAM type: NRG; PAM sequence: AGG
cagcctgtgccttcagcagg

SEQ ID NO: 14805 - DNA, 20 bp, Artificial Sequence
  Description of Artificial Sequence: Synthetic oligonucleotide
  Target: DMPK; (+) strand; PAM type: NRG; PAM sequence: CAG
tgtgccttcagcaggaggct

SEQ ID NO: 14806 - DNA, 20 bp, Artificial Sequence
  Description of Artificial Sequence: Synthetic oligonucleotide
  Target: DMPK; (+) strand; PAM type: NRG; PAM sequence: GAG
cagcaggaggctcagatcct

SEQ ID NO: 14807 - DNA, 20 bp, Artificial Sequence
  Description of Artificial Sequence: Synthetic oligonucleotide
  Target: DMPK; (+) strand; PAM type: NRG; PAM sequence: CAG
gaggctcagatcctgagtcc

SEQ ID NO: 14808 - DNA, 20 bp, Artificial Sequence
  Description of Artificial Sequence: Synthetic oligonucleotide
  Target: DMPK; (+) strand; PAM type: NRG; PAM sequence: CAG
cagatcctgagtcccagacc

SEQ ID NO: 14809 - DNA, 20 bp, Artificial Sequence
  Description of Artificial Sequence: Synthetic oligonucleotide
  Target: DMPK; (+) strand; PAM type: NRG; PAM sequence: AGG
agatcctgagtcccagaccc

SEQ ID NO: 14810 - DNA, 20 bp, Artificial Sequence
  Description of Artificial Sequence: Synthetic oligonucleotide
  Target: DMPK; (+) strand; PAM type: NRG; PAM sequence: TGG
cctgagtcccagacccaggc

SEQ ID NO: 14811 - DNA, 20 bp, Artificial Sequence
  Description of Artificial Sequence: Synthetic oligonucleotide
  Target: DMPK; (+) strand; PAM type: NRG; PAM sequence: CAG
gagtcccagacccaggctgg

SEQ ID NO: 14812 - DNA, 20 bp, Artificial Sequence
  Description of Artificial Sequence: Synthetic oligonucleotide
  Target: DMPK; (+) strand; PAM type: NRG; PAM sequence: CAG
caggctggcagccatgccca

SEQ ID NO: 14813 - DNA, 20 bp, Artificial Sequence
  Description of Artificial Sequence: Synthetic oligonucleotide
  Target: DMPK; (+) strand; PAM type: NRG; PAM sequence: AGG
aggctggcagccatgcccac

SEQ ID NO: 14814 - DNA, 20 bp, Artificial Sequence
  Description of Artificial Sequence: Synthetic oligonucleotide
  Target: DMPK; (+) strand; PAM type: NRG; PAM sequence: GAG
gcagccatgcccacaggctt

SEQ ID NO: 14815 - DNA, 20 bp, Artificial Sequence
  Description of Artificial Sequence: Synthetic oligonucleotide
  Target: DMPK; (+) strand; PAM type: NRG; PAM sequence: TAG
cacaggcttgagctcgcccc

SEQ ID NO: 14816 - DNA, 20 bp, Artificial Sequence
  Description of Artificial Sequence: Synthetic oligonucleotide
  Target: DMPK; (+) strand; PAM type: NRG; PAM sequence: TGG
cttgagctcgcccctagttt

SEQ ID NO: 14817 - DNA, 20 bp, Artificial Sequence
  Description of Artificial Sequence: Synthetic oligonucleotide
  Target: DMPK; (+) strand; PAM type: NRG; PAM sequence: AAG
tcgcccctagttttggcctg

SEQ ID NO: 14818 - DNA, 20 bp, Artificial Sequence
  Description of Artificial Sequence: Synthetic oligonucleotide
  Target: DMPK; (+) strand; PAM type: NRG; PAM sequence: AAG
ttggcctgaagtactcaaaa

SEQ ID NO: 14819 - DNA, 20 bp, Artificial Sequence
  Description of Artificial Sequence: Synthetic oligonucleotide
  Target: DMPK; (+) strand; PAM type: NRG; PAM sequence: CAG
aagtttcacgatttaaaaaa

SEQ ID NO: 14820 - DNA, 20 bp, Artificial Sequence
  Description of Artificial Sequence: Synthetic oligonucleotide
  Target: DMPK; (+) strand; PAM type: NRG; PAM sequence: CAG
tttaaaaaacagatgttcaa

SEQ ID NO: 14821 - DNA, 20 bp, Artificial Sequence
  Description of Artificial Sequence: Synthetic oligonucleotide
  Target: DMPK; (+) strand; PAM type: NRG; PAM sequence: TAG
aaacagatgttcaacagaaa

SEQ ID NO: 14822 - DNA, 20 bp, Artificial Sequence
  Description of Artificial Sequence: Synthetic oligonucleotide
  Target: DMPK; (+) strand; PAM type: NRG; PAM sequence: TGG
tgttcaacagaaatagattc

SEQ ID NO: 14823 - DNA, 20 bp, Artificial Sequence
  Description of Artificial Sequence: Synthetic oligonucleotide
  Target: DMPK; (+) strand; PAM type: NRG; PAM sequence: GAG
acagaaatagattctggttc

SEQ ID NO: 14824 - DNA, 20 bp, Artificial Sequence
  Description of Artificial Sequence: Synthetic oligonucleotide
  Target: DMPK; (+) strand; PAM type: NRG; PAM sequence: CAG
atagattctggttcgagtga

SEQ ID NO: 14825 - DNA, 20 bp, Artificial Sequence
  Description of Artificial Sequence: Synthetic oligonucleotide
  Target: DMPK; (+) strand; PAM type: NRG; PAM sequence: AGG
tagattctggttcgagtgac

SEQ ID NO: 14826 - DNA, 20 bp, Artificial Sequence
  Description of Artificial Sequence: Synthetic oligonucleotide
  Target: DMPK; (+) strand; PAM type: NRG; PAM sequence: CAG
attctggttcgagtgacagg

SEQ ID NO: 14827 - DNA, 20 bp, Artificial Sequence
  Description of Artificial Sequence: Synthetic oligonucleotide
  Target: DMPK; (+) strand; PAM type: NRG; PAM sequence: AAG
tggttcgagtgacaggcagt

SEQ ID NO: 14828 - DNA, 20 bp, Artificial Sequence
  Description of Artificial Sequence: Synthetic oligonucleotide
  Target: DMPK; (+) strand; PAM type: NRG; PAM sequence: TGG
gagtgacaggcagtaagacc

SEQ ID NO: 14829 - DNA, 20 bp, Artificial Sequence
  Description of Artificial Sequence: Synthetic oligonucleotide
  Target: DMPK; (+) strand; PAM type: NRG; PAM sequence: TGG
ggcagtaagacctggccatg

SEQ ID NO: 14830 - DNA, 20 bp, Artificial Sequence
  Description of Artificial Sequence: Synthetic oligonucleotide
  Target: DMPK; (+) strand; PAM type: NRG; PAM sequence: GGG
gcagtaagacctggccatgt

SEQ ID NO: 14831 - DNA, 20 bp, Artificial Sequence
  Description of Artificial Sequence: Synthetic oligonucleotide
  Target: DMPK; (+) strand; PAM type: NRG; PAM sequence: GGG
cagtaagacctggccatgtg

SEQ ID NO: 14832 - DNA, 20 bp, Artificial Sequence
  Description of Artificial Sequence: Synthetic oligonucleotide
  Target: DMPK; (+) strand; PAM type: NRG; PAM sequence: CAG
ggggcccatctgctgccctt

SEQ ID NO: 14833 - DNA, 20 bp, Artificial Sequence
  Description of Artificial Sequence: Synthetic oligonucleotide
  Target: DMPK; (+) strand; PAM type: NRG; PAM sequence: CGG
cccatctgctgcccttcaga

SEQ ID NO: 14834 - DNA, 20 bp, Artificial Sequence
  Description of Artificial Sequence: Synthetic oligonucleotide
  Target: DMPK; (+) strand; PAM type: NRG; PAM sequence: CAG
tctgctgcccttcagacggc

SEQ ID NO: 14835 - DNA, 20 bp, Artificial Sequence
  Description of Artificial Sequence: Synthetic oligonucleotide
  Target: DMPK; (+) strand; PAM type: NRG; PAM sequence: TGG
gcccttcagacggccagcct

SEQ ID NO: 14836 - DNA, 20 bp, Artificial Sequence
  Description of Artificial Sequence: Synthetic oligonucleotide
  Target: DMPK; (+) strand; PAM type: NRG; PAM sequence: TAG
gccttggatgccccaattcc

SEQ ID NO: 14837 - DNA, 20 bp, Artificial Sequence
  Description of Artificial Sequence: Synthetic oligonucleotide
  Target: DMPK; (+) strand; PAM type: NRG; PAM sequence: TGG
tggatgccccaattcctagc

SEQ ID NO: 14838 - DNA, 20 bp, Artificial Sequence
  Description of Artificial Sequence: Synthetic oligonucleotide
  Target: DMPK; (+) strand; PAM type: NRG; PAM sequence: TAG
tctttctgctgcctgctgcc

SEQ ID NO: 14839 - DNA, 20 bp, Artificial Sequence
  Description of Artificial Sequence: Synthetic oligonucleotide
  Target: DMPK; (+) strand; PAM type: NRG; PAM sequence: AGG
ctttctgctgcctgctgcct

SEQ ID NO: 14840 - DNA, 20 bp, Artificial Sequence
  Description of Artificial Sequence: Synthetic oligonucleotide
  Target: DMPK; (+) strand; PAM type: NRG; PAM sequence: GGG
tttctgctgcctgctgccta

SEQ ID NO: 14841 - DNA, 20 bp, Artificial Sequence
  Description of Artificial Sequence: Synthetic oligonucleotide
  Target: DMPK; (+) strand; PAM type: NRG; PAM sequence: TAG
tgctgcctgctgcctagggc

SEQ ID NO: 14842 - DNA, 20 bp, Artificial Sequence
  Description of Artificial Sequence: Synthetic oligonucleotide
  Target: DMPK; (+) strand; PAM type: NRG; PAM sequence: AAG
gggctagaccccctcactct

SEQ ID NO: 14843 - DNA, 20 bp, Artificial Sequence
  Description of Artificial Sequence: Synthetic oligonucleotide
  Target: DMPK; (+) strand; PAM type: NRG; PAM sequence: AGG
ggctagaccccctcactcta

SEQ ID NO: 14844 - DNA, 20 bp, Artificial Sequence
  Description of Artificial Sequence: Synthetic oligonucleotide
  Target: DMPK; (+) strand; PAM type: NRG; PAM sequence: GAG
ccccctcactctaaggatct

SEQ ID NO: 14845 - DNA, 20 bp, Artificial Sequence
  Description of Artificial Sequence: Synthetic oligonucleotide
  Target: DMPK; (+) strand; PAM type: NRG; PAM sequence: GAG
ccctcactctaaggatctga

SEQ ID NO: 14846 - DNA, 20 bp, Artificial Sequence
  Description of Artificial Sequence: Synthetic oligonucleotide
  Target: DMPK; (+) strand; PAM type: NRG; PAM sequence: AGG
cctcactctaaggatctgag

SEQ ID NO: 14847 - DNA, 20 bp, Artificial Sequence
  Description of Artificial Sequence: Synthetic oligonucleotide
  Target: DMPK; (+) strand; PAM type: NRG; PAM sequence: GAG
gatctgagaggtcttgtact

SEQ ID NO: 14848 - DNA, 20 bp, Artificial Sequence
  Description of Artificial Sequence: Synthetic oligonucleotide
  Target: DMPK; (+) strand; PAM type: NRG; PAM sequence: AAG
aggtcttgtactgagacact

SEQ ID NO: 14849 - DNA, 20 bp, Artificial Sequence
  Description of Artificial Sequence: Synthetic oligonucleotide
  Target: DMPK; (+) strand; PAM type: NRG; PAM sequence: TGG
ctgagacactaagatttccc

SEQ ID NO: 14850 - DNA, 20 bp, Artificial Sequence
  Description of Artificial Sequence: Synthetic oligonucleotide
  Target: DMPK; (+) strand; PAM type: NRG; PAM sequence: CGG
cctggcttcccctcacccca

SEQ ID NO: 14851 - DNA, 20 bp, Artificial Sequence
  Description of Artificial Sequence: Synthetic oligonucleotide
  Target: DMPK; (+) strand; PAM type: NRG; PAM sequence: GAG
tggcttcccctcaccccacg

SEQ ID NO: 14852 - DNA, 20 bp, Artificial Sequence
  Description of Artificial Sequence: Synthetic oligonucleotide
  Target: DMPK; (+) strand; PAM type: NRG; PAM sequence: CAG
ttcccctcaccccacggagc

SEQ ID NO: 14853 - DNA, 20 bp, Artificial Sequence
  Description of Artificial Sequence: Synthetic oligonucleotide
  Target: DMPK; (+) strand; PAM type: NRG; PAM sequence: GAG
cccctcaccccacggagcca

SEQ ID NO: 14854 - DNA, 20 bp, Artificial Sequence
  Description of Artificial Sequence: Synthetic oligonucleotide
  Target: DMPK; (+) strand; PAM type: NRG; PAM sequence: AGG
ccctcaccccacggagccag

SEQ ID NO: 14855 - DNA, 20 bp, Artificial Sequence
  Description of Artificial Sequence: Synthetic oligonucleotide
  Target: DMPK; (+) strand; PAM type: NRG; PAM sequence: CAG
cacggagccagaggctgtga

SEQ ID NO: 14856 - DNA, 20 bp, Artificial Sequence
  Description of Artificial Sequence: Synthetic oligonucleotide
  Target: DMPK; (+) strand; PAM type: NRG; PAM sequence: AAG
cagaggctgtgacagcaaca

SEQ ID NO: 14857 - DNA, 20 bp, Artificial Sequence
  Description of Artificial Sequence: Synthetic oligonucleotide
  Target: DMPK; (+) strand; PAM type: NRG; PAM sequence: AAG
atgcctgcctcttcccacga

SEQ ID NO: 14858 - DNA, 20 bp, Artificial Sequence
  Description of Artificial Sequence: Synthetic oligonucleotide
  Target: DMPK; (+) strand; PAM type: NRG; PAM sequence: AGG
tgcctgcctcttcccacgaa

SEQ ID NO: 14859 - DNA, 20 bp, Artificial Sequence
  Description of Artificial Sequence: Synthetic oligonucleotide
  Target: DMPK; (+) strand; PAM type: NRG; PAM sequence: CAG
cttcccacgaaaggtcctgc

SEQ ID NO: 14860 - DNA, 20 bp, Artificial Sequence
  Description of Artificial Sequence: Synthetic oligonucleotide
  Target: DMPK; (+) strand; PAM type: NRG; PAM sequence: AGG
ttcccacgaaaggtcctgcc

SEQ ID NO: 14861 - DNA, 20 bp, Artificial Sequence
  Description of Artificial Sequence: Synthetic oligonucleotide
  Target: DMPK; (+) strand; PAM type: NRG; PAM sequence: CGG
gaaaggtcctgccaggtccc

SEQ ID NO: 14862 - DNA, 20 bp, Artificial Sequence
  Description of Artificial Sequence: Synthetic oligonucleotide
  Target: DMPK; (+) strand; PAM type: NRG; PAM sequence: CAG
aggtcctgccaggtccccgg

SEQ ID NO: 14863 - DNA, 20 bp, Artificial Sequence
  Description of Artificial Sequence: Synthetic oligonucleotide
  Target: DMPK; (+) strand; PAM type: NRG; PAM sequence: AGG
ggtcctgccaggtccccggc

SEQ ID NO: 14864 - DNA, 20 bp, Artificial Sequence
  Description of Artificial Sequence: Synthetic oligonucleotide
  Target: DMPK; (+) strand; PAM type: NRG; PAM sequence: TGG
ctgccaggtccccggcaggc

SEQ ID NO: 14865 - DNA, 20 bp, Artificial Sequence
  Description of Artificial Sequence: Synthetic oligonucleotide
  Target: DMPK; (+) strand; PAM type: NRG; PAM sequence: TGG
aggtccccggcaggctggtg

SEQ ID NO: 14866 - DNA, 20 bp, Artificial Sequence
  Description of Artificial Sequence: Synthetic oligonucleotide
  Target: DMPK; (+) strand; PAM type: NRG; PAM sequence: GGG
ggtccccggcaggctggtgt

SEQ ID NO: 14867 - DNA, 20 bp, Artificial Sequence
  Description of Artificial Sequence: Synthetic oligonucleotide
  Target: DMPK; (+) strand; PAM type: NRG; PAM sequence: GGG
gtccccggcaggctggtgtg

SEQ ID NO: 14868 - DNA, 20 bp, Artificial Sequence
  Description of Artificial Sequence: Synthetic oligonucleotide
  Target: DMPK; (+) strand; PAM type: NRG; PAM sequence: CGG
gggccactcaccgccttgcc

SEQ ID NO: 14869 - DNA, 20 bp, Artificial Sequence
  Description of Artificial Sequence: Synthetic oligonucleotide
  Target: DMPK; (+) strand; PAM type: NRG; PAM sequence: CGG
cactcaccgccttgcccggc

SEQ ID NO: 14870 - DNA, 20 bp, Artificial Sequence
  Description of Artificial Sequence: Synthetic oligonucleotide
  Target: DMPK; (+) strand; PAM type: NRG; PAM sequence: GGG
actcaccgccttgcccggcc

SEQ ID NO: 14871 - DNA, 20 bp, Artificial Sequence
  Description of Artificial Sequence: Synthetic oligonucleotide
  Target: DMPK; (+) strand; PAM type: NRG; PAM sequence: CAG
ccgccttgcccggccgggcc

SEQ ID NO: 14872 - DNA, 20 bp, Artificial Sequence
  Description of Artificial Sequence: Synthetic oligonucleotide
  Target: DMPK; (+) strand; PAM type: NRG; PAM sequence: AGG
cgccttgcccggccgggccc

SEQ ID NO: 14873 - DNA, 20 bp, Artificial Sequence
  Description of Artificial Sequence: Synthetic oligonucleotide
  Target: DMPK; (+) strand; PAM type: NRG; PAM sequence: CAG
tgcccggccgggcccaggtg

SEQ ID NO: 14874 - DNA, 20 bp, Artificial Sequence
  Description of Artificial Sequence: Synthetic oligonucleotide
  Target: DMPK; (+) strand; PAM type: NRG; PAM sequence: GAG
ggccgggcccaggtgcagat

SEQ ID NO: 14875 - DNA, 20 bp, Artificial Sequence
  Description of Artificial Sequence: Synthetic oligonucleotide
  Target: DMPK; (+) strand; PAM type: NRG; PAM sequence: AGG
gccgggcccaggtgcagatg

SEQ ID NO: 14876 - DNA, 20 bp, Artificial Sequence
  Description of Artificial Sequence: Synthetic oligonucleotide
  Target: DMPK; (+) strand; PAM type: NRG; PAM sequence: TGG
aggtgcagatgaggccctcc

SEQ ID NO: 14877 - DNA, 20 bp, Artificial Sequence
  Description of Artificial Sequence: Synthetic oligonucleotide
  Target: DMPK; (+) strand; PAM type: NRG; PAM sequence: CAG
tgcagatgaggccctcctgg

SEQ ID NO: 14878 - DNA, 20 bp, Artificial Sequence
  Description of Artificial Sequence: Synthetic oligonucleotide
  Target: DMPK; (+) strand; PAM type: NRG; PAM sequence: AGG
gcagatgaggccctcctggc

SEQ ID NO: 14879 - DNA, 20 bp, Artificial Sequence
  Description of Artificial Sequence: Synthetic oligonucleotide
  Target: DMPK; (+) strand; PAM type: NRG; PAM sequence: CAG
gatgaggccctcctggcagg

SEQ ID NO: 14880 - DNA, 20 bp, Artificial Sequence
  Description of Artificial Sequence: Synthetic oligonucleotide
  Target: DMPK; (+) strand; PAM type: NRG; PAM sequence: CAG
cctggcaggcagtgatgatg

SEQ ID NO: 14881 - DNA, 20 bp, Artificial Sequence
  Description of Artificial Sequence: Synthetic oligonucleotide
  Target: DMPK; (+) strand; PAM type: NRG; PAM sequence: CAG
gcagtgatgatgcagtcctc

SEQ ID NO: 14882 - DNA, 20 bp, Artificial Sequence
  Description of Artificial Sequence: Synthetic oligonucleotide
  Target: DMPK; (+) strand; PAM type: NRG; PAM sequence: AGG
cagtgatgatgcagtcctcc

SEQ ID NO: 14883 - DNA, 20 bp, Artificial Sequence
  Description of Artificial Sequence: Synthetic oligonucleotide
  Target: DMPK; (+) strand; PAM type: NRG; PAM sequence: CAG
atgatgcagtcctccaggaa

SEQ ID NO: 14884 - DNA, 20 bp, Artificial Sequence
  Description of Artificial Sequence: Synthetic oligonucleotide
  Target: DMPK; (+) strand; PAM type: NRG; PAM sequence: AGG
tgatgcagtcctccaggaac

SEQ ID NO: 14885 - DNA, 20 bp, Artificial Sequence
  Description of Artificial Sequence: Synthetic oligonucleotide
  Target: DMPK; (+) strand; PAM type: NRG; PAM sequence: GAG
atgcagtcctccaggaacag

SEQ ID NO: 14886 - DNA, 20 bp, Artificial Sequence
  Description of Artificial Sequence: Synthetic oligonucleotide
  Target: DMPK; (+) strand; PAM type: NRG; PAM sequence: AGG
tgcagtcctccaggaacagg

SEQ ID NO: 14887 - DNA, 20 bp, Artificial Sequence
  Description of Artificial Sequence: Synthetic oligonucleotide
  Target: DMPK; (+) strand; PAM type: NRG; PAM sequence: GAG
tccaggaacaggaggactgt

SEQ ID NO: 14888 - DNA, 20 bp, Artificial Sequence
  Description of Artificial Sequence: Synthetic oligonucleotide
  Target: DMPK; (+) strand; PAM type: NRG; PAM sequence: TGG
ggaggactgtgagccgctcc

SEQ ID NO: 14889 - DNA, 20 bp, Artificial Sequence
  Description of Artificial Sequence: Synthetic oligonucleotide
  Target: DMPK; (+) strand; PAM type: NRG; PAM sequence: GGG
gaggactgtgagccgctcct

SEQ ID NO: 14890 - DNA, 20 bp, Artificial Sequence
  Description of Artificial Sequence: Synthetic oligonucleotide
  Target: DMPK; (+) strand; PAM type: NRG; PAM sequence: AAG
tgggcgatcttcttgcacac

SEQ ID NO: 14891 - DNA, 20 bp, Artificial Sequence
  Description of Artificial Sequence: Synthetic oligonucleotide
  Target: DMPK; (+) strand; PAM type: NRG; PAM sequence: AGG
gggcgatcttcttgcacaca

SEQ ID NO: 14892 - DNA, 20 bp, Artificial Sequence
  Description of Artificial Sequence: Synthetic oligonucleotide
  Target: DMPK; (+) strand; PAM type: NRG; PAM sequence: GGG
ggcgatcttcttgcacacaa

SEQ ID NO: 14893 - DNA, 20 bp, Artificial Sequence
  Description of Artificial Sequence: Synthetic oligonucleotide
  Target: DMPK; (+) strand; PAM type: NRG; PAM sequence: GGG
gcgatcttcttgcacacaag

SEQ ID NO: 14894 - DNA, 20 bp, Artificial Sequence
  Description of Artificial Sequence: Synthetic oligonucleotide
  Target: DMPK; (+) strand; PAM type: NRG; PAM sequence: CAG
ttcttgcacacaaggggctc

SEQ ID NO: 14895 - DNA, 20 bp, Artificial Sequence
  Description of Artificial Sequence: Synthetic oligonucleotide
  Target: DMPK; (+) strand; PAM type: NRG; PAM sequence: CAG
ttgcacacaaggggctccag

SEQ ID NO: 14896 - DNA, 20 bp, Artificial Sequence
  Description of Artificial Sequence: Synthetic oligonucleotide
  Target: DMPK; (+) strand; PAM type: NRG; PAM sequence: AGG
tgcacacaaggggctccagc

SEQ ID NO: 14897 - DNA, 20 bp, Artificial Sequence
  Description of Artificial Sequence: Synthetic oligonucleotide
  Target: DMPK; (+) strand; PAM type: NRG; PAM sequence: GGG
gcacacaaggggctccagca

SEQ ID NO: 14898 - DNA, 20 bp, Artificial Sequence
  Description of Artificial Sequence: Synthetic oligonucleotide
  Target: DMPK; (+) strand; PAM type: NRG; PAM sequence: GGG
cacacaaggggctccagcag

SEQ ID NO: 14899 - DNA, 20 bp, Artificial Sequence
  Description of Artificial Sequence: Synthetic oligonucleotide
  Target: DMPK; (+) strand; PAM type: NRG; PAM sequence: TGG
gctccagcaggggcacctcg

SEQ ID NO: 14900 - DNA, 20 bp, Artificial Sequence
  Description of Artificial Sequence: Synthetic oligonucleotide
  Target: DMPK; (+) strand; PAM type: NRG; PAM sequence: CGG
aggggcacctcgtggatgcg

SEQ ID NO: 14901 - DNA, 20 bp, Artificial Sequence
  Description of Artificial Sequence: Synthetic oligonucleotide
  Target: DMPK; (+) strand; PAM type: NRG; PAM sequence: GGG
ggggcacctcgtggatgcgc

SEQ ID NO: 14902 - DNA, 20 bp, Artificial Sequence
  Description of Artificial Sequence: Synthetic oligonucleotide
  Target: DMPK; (+) strand; PAM type: NRG; PAM sequence: CAG
acctcgtggatgcgcgggca

SEQ ID NO: 14903 - DNA, 20 bp, Artificial Sequence
  Description of Artificial Sequence: Synthetic oligonucleotide
  Target: DMPK; (+) strand; PAM type: NRG; PAM sequence: CAG
gtggatgcgcgggcacagcg

SEQ ID NO: 14904 - DNA, 20 bp, Artificial Sequence
  Description of Artificial Sequence: Synthetic oligonucleotide
  Target: DMPK; (+) strand; PAM type: NRG; PAM sequence: CAG
cgcgggcacagcgcagtgcc

SEQ ID NO: 14905 - DNA, 20 bp, Artificial Sequence
  Description of Artificial Sequence: Synthetic oligonucleotide
  Target: DMPK; (+) strand; PAM type: NRG; PAM sequence: TGG
cagcgcagtgcccagcacct

SEQ ID NO: 14906 - DNA, 20 bp, Artificial Sequence
  Description of Artificial Sequence: Synthetic oligonucleotide
  Target: DMPK; (+) strand; PAM type: NRG; PAM sequence: CGG
cgcagtgcccagcaccttgg

SEQ ID NO: 14907 - DNA, 20 bp, Artificial Sequence
  Description of Artificial Sequence: Synthetic oligonucleotide
  Target: DMPK; (+) strand; PAM type: NRG; PAM sequence: GGG
gcagtgcccagcaccttggc

SEQ ID NO: 14908 - DNA, 20 bp, Artificial Sequence
  Description of Artificial Sequence: Synthetic oligonucleotide
  Target: DMPK; (+) strand; PAM type: NRG; PAM sequence: GGG
cagtgcccagcaccttggcg

SEQ ID NO: 14909 - DNA, 20 bp, Artificial Sequence
  Description of Artificial Sequence: Synthetic oligonucleotide
  Target: DMPK; (+) strand; PAM type: NRG; PAM sequence: CAG
cccagcaccttggcggggtc

SEQ ID NO: 14910 - DNA, 20 bp, Artificial Sequence
  Description of Artificial Sequence: Synthetic oligonucleotide
  Target: DMPK; (+) strand; PAM type: NRG; PAM sequence: AGG
ccagcaccttggcggggtcc

SEQ ID NO: 14911 - DNA, 20 bp, Artificial Sequence
  Description of Artificial Sequence: Synthetic oligonucleotide
  Target: DMPK; (+) strand; PAM type: NRG; PAM sequence: CGG
gcaccttggcggggtccagg

SEQ ID NO: 14912 - DNA, 20 bp, Artificial Sequence
  Description of Artificial Sequence: Synthetic oligonucleotide
  Target: DMPK; (+) strand; PAM type: NRG; PAM sequence: CGG
tggcggggtccaggcggctg

SEQ ID NO: 14913 - DNA, 20 bp, Artificial Sequence
  Description of Artificial Sequence: Synthetic oligonucleotide
  Target: DMPK; (+) strand; PAM type: NRG; PAM sequence: GGG
ggcggggtccaggcggctgc

SEQ ID NO: 14914 - DNA, 20 bp, Artificial Sequence
  Description of Artificial Sequence: Synthetic oligonucleotide
  Target: DMPK; (+) strand; PAM type: NRG; PAM sequence: GGG
gcggggtccaggcggctgcg

SEQ ID NO: 14915 - DNA, 20 bp, Artificial Sequence
  Description of Artificial Sequence: Synthetic oligonucleotide
  Target: DMPK; (+) strand; PAM type: NRG; PAM sequence: CAG
gtccaggcggctgcggggaa

SEQ ID NO: 14916 - DNA, 20 bp, Artificial Sequence
  Description of Artificial Sequence: Synthetic oligonucleotide
  Target: DMPK; (+) strand; PAM type: NRG; PAM sequence: AGG
tccaggcggctgcggggaac

SEQ ID NO: 14917 - DNA, 20 bp, Artificial Sequence
  Description of Artificial Sequence: Synthetic oligonucleotide
  Target: DMPK; (+) strand; PAM type: NRG; PAM sequence: GGG
ccaggcggctgcggggaaca

SEQ ID NO: 14918 - DNA, 20 bp, Artificial Sequence
  Description of Artificial Sequence: Synthetic oligonucleotide
  Target: DMPK; (+) strand; PAM type: NRG; PAM sequence: TGG
gctgcggggaacagggccgc

SEQ ID NO: 14919 - DNA, 20 bp, Artificial Sequence
  Description of Artificial Sequence: Synthetic oligonucleotide
  Target: DMPK; (+) strand; PAM type: NRG; PAM sequence: GGG
ctgcggggaacagggccgct

SEQ ID NO: 14920 - DNA, 20 bp, Artificial Sequence
  Description of Artificial Sequence: Synthetic oligonucleotide
  Target: DMPK; (+) strand; PAM type: NRG; PAM sequence: CGG
cactgccgccactgccaccc

SEQ ID NO: 14921 - DNA, 20 bp, Artificial Sequence
  Description of Artificial Sequence: Synthetic oligonucleotide
  Target: DMPK; (+) strand; PAM type: NRG; PAM sequence: CAG
ccaccccggctgatgttgcc

SEQ ID NO: 14922 - DNA, 20 bp, Artificial Sequence
  Description of Artificial Sequence: Synthetic oligonucleotide
  Target: DMPK; (+) strand; PAM type: NRG; PAM sequence: AGG
caccccggctgatgttgccc

SEQ ID NO: 14923 - DNA, 20 bp, Artificial Sequence
  Description of Artificial Sequence: Synthetic oligonucleotide
  Target: DMPK; (+) strand; PAM type: NRG; PAM sequence: TGG
ggctgatgttgcccaggctg

SEQ ID NO: 14924 - DNA, 20 bp, Artificial Sequence
  Description of Artificial Sequence: Synthetic oligonucleotide
  Target: DMPK; (+) strand; PAM type: NRG; PAM sequence: TAG
tgatgttgcccaggctgtgg

SEQ ID NO: 14925 - DNA, 20 bp, Artificial Sequence
  Description of Artificial Sequence: Synthetic oligonucleotide
  Target: DMPK; (+) strand; PAM type: NRG; PAM sequence: CGG
tgtgctccttctctgccccc

SEQ ID NO: 14926 - DNA, 20 bp, Artificial Sequence
  Description of Artificial Sequence: Synthetic oligonucleotide
  Target: DMPK; (+) strand; PAM type: NRG; PAM sequence: CAG
ccccggtcccgccgctcctg

SEQ ID NO: 14927 - DNA, 20 bp, Artificial Sequence
  Description of Artificial Sequence: Synthetic oligonucleotide
  Target: DMPK; (+) strand; PAM type: NRG; PAM sequence: GAG
tcccgccgctcctgcagtgt

SEQ ID NO: 14928 - DNA, 20 bp, Artificial Sequence
  Description of Artificial Sequence: Synthetic oligonucleotide
  Target: DMPK; (+) strand; PAM type: NRG; PAM sequence: TGG
ccgctcctgcagtgtgagcg

SEQ ID NO: 14929 - DNA, 20 bp, Artificial Sequence
  Description of Artificial Sequence: Synthetic oligonucleotide
  Target: DMPK; (+) strand; PAM type: NRG; PAM sequence: AAG
cctgcagtgtgagcgtggcg

SEQ ID NO: 14930 - DNA, 20 bp, Artificial Sequence
  Description of Artificial Sequence: Synthetic oligonucleotide
  Target: DMPK; (+) strand; PAM type: NRG; PAM sequence: CGG
gcagtgtgagcgtggcgaag

SEQ ID NO: 14931 - DNA, 20 bp, Artificial Sequence
  Description of Artificial Sequence: Synthetic oligonucleotide
  Target: DMPK; (+) strand; PAM type: NRG; PAM sequence: TGG
gcgaagcggccaatgctgaa

SEQ ID NO: 14932 - DNA, 20 bp, Artificial Sequence
  Description of Artificial Sequence: Synthetic oligonucleotide
  Target: DMPK; (+) strand; PAM type: NRG; PAM sequence: CAG
gccaatgctgaatggtgtgc

SEQ ID NO: 14933 - DNA, 20 bp, Artificial Sequence
  Description of Artificial Sequence: Synthetic oligonucleotide
  Target: DMPK; (+) strand; PAM type: NRG; PAM sequence: AGG
ccaatgctgaatggtgtgcc

SEQ ID NO: 14934 - DNA, 20 bp, Artificial Sequence
  Description of Artificial Sequence: Synthetic oligonucleotide
  Target: DMPK; (+) strand; PAM type: NRG; PAM sequence: CGG
ccaggctctgccgccacacc

SEQ ID NO: 14935 - DNA, 20 bp, Artificial Sequence
  Description of Artificial Sequence: Synthetic oligonucleotide
  Target: DMPK; (+) strand; PAM type: NRG; PAM sequence: GGG
caggctctgccgccacaccc

SEQ ID NO: 14936 - DNA, 20 bp, Artificial Sequence
  Description of Artificial Sequence: Synthetic oligonucleotide
  Target: DMPK; (+) strand; PAM type: NRG; PAM sequence: CAG
gccgcccgccttgcccccgc

SEQ ID NO: 14937 - DNA, 20 bp, Artificial Sequence
  Description of Artificial Sequence: Synthetic oligonucleotide
  Target: DMPK; (+) strand; PAM type: NRG; PAM sequence: TGG
cccgccttgcccccgccagc

SEQ ID NO: 14938 - DNA, 20 bp, Artificial Sequence
  Description of Artificial Sequence: Synthetic oligonucleotide
  Target: DMPK; (+) strand; PAM type: NRG; PAM sequence: GGG
ccgccttgcccccgccagct

SEQ ID NO: 14939 - DNA, 20 bp, Artificial Sequence
  Description of Artificial Sequence: Synthetic oligonucleotide
  Target: DMPK; (+) strand; PAM type: NRG; PAM sequence: CGG
ttgcccccgccagctgggtg

SEQ ID NO: 14940 - DNA, 20 bp, Artificial Sequence
  Description of Artificial Sequence: Synthetic oligonucleotide
  Target: DMPK; (+) strand; PAM type: NRG; PAM sequence: GGG
tgcccccgccagctgggtgc

SEQ ID NO: 14941 - DNA, 20 bp, Artificial Sequence
  Description of Artificial Sequence: Synthetic oligonucleotide
  Target: DMPK; (+) strand; PAM type: NRG; PAM sequence: GAG
cccccgccagctgggtgcgg

SEQ ID NO: 14942 - DNA, 20 bp, Artificial Sequence
  Description of Artificial Sequence: Synthetic oligonucleotide
  Target: DMPK; (+) strand; PAM type: NRG; PAM sequence: TGG
agctgggtgcgggagactgt

SEQ ID NO: 14943 - DNA, 20 bp, Artificial Sequence
  Description of Artificial Sequence: Synthetic oligonucleotide
  Target: DMPK; (+) strand; PAM type: NRG; PAM sequence: GAG
ctgggtgcgggagactgttg

SEQ ID NO: 14944 - DNA, 20 bp, Artificial Sequence
  Description of Artificial Sequence: Synthetic oligonucleotide
  Target: DMPK; (+) strand; PAM type: NRG; PAM sequence: CGG
ggtgcgggagactgttggag

SEQ ID NO: 14945 - DNA, 20 bp, Artificial Sequence
  Description of Artificial Sequence: Synthetic oligonucleotide
  Target: DMPK; (+) strand; PAM type: NRG; PAM sequence: GGG
gtgcgggagactgttggagc

SEQ ID NO: 14946 - DNA, 20 bp, Artificial Sequence
  Description of Artificial Sequence: Synthetic oligonucleotide
  Target: DMPK; (+) strand; PAM type: NRG; PAM sequence: CAG
gggagactgttggagcggga

SEQ ID NO: 14947 - DNA, 20 bp, Artificial Sequence
  Description of Artificial Sequence: Synthetic oligonucleotide
  Target: DMPK; (+) strand; PAM type: NRG; PAM sequence: GAG
gactgttggagcgggacagc

SEQ ID NO: 14948 - DNA, 20 bp, Artificial Sequence
  Description of Artificial Sequence: Synthetic oligonucleotide
  Target: DMPK; (+) strand; PAM type: NRG; PAM sequence: GAG
gttggagcgggacagcgagc

SEQ ID NO: 14949 - DNA, 20 bp, Artificial Sequence
  Description of Artificial Sequence: Synthetic oligonucleotide
  Target: DMPK; (+) strand; PAM type: NRG; PAM sequence: AGG
ttggagcgggacagcgagcg

SEQ ID NO: 14950 - DNA, 20 bp, Artificial Sequence
  Description of Artificial Sequence: Synthetic oligonucleotide
  Target: DMPK; (+) strand; PAM type: NRG; PAM sequence: CAG
gagcgggacagcgagcgagg

SEQ ID NO: 14951 - DNA, 20 bp, Artificial Sequence
  Description of Artificial Sequence: Synthetic oligonucleotide
  Target: DMPK; (+) strand; PAM type: NRG; PAM sequence: AGG
agcgggacagcgagcgaggc

SEQ ID NO: 14952 - DNA, 20 bp, Artificial Sequence
  Description of Artificial Sequence: Synthetic oligonucleotide
  Target: DMPK; (+) strand; PAM type: NRG; PAM sequence: GGG
gcgggacagcgagcgaggca

SEQ ID NO: 14953 - DNA, 20 bp, Artificial Sequence
  Description of Artificial Sequence: Synthetic oligonucleotide
  Target: DMPK; (+) strand; PAM type: NRG; PAM sequence: GGG
cgggacagcgagcgaggcag

SEQ ID NO: 14954 - DNA, 20 bp, Artificial Sequence
  Description of Artificial Sequence: Synthetic oligonucleotide
  Target: DMPK; (+) strand; PAM type: NRG; PAM sequence: GGG
gggacagcgagcgaggcagg

SEQ ID NO: 14955 - DNA, 20 bp, Artificial Sequence
  Description of Artificial Sequence: Synthetic oligonucleotide
  Target: DMPK; (+) strand; PAM type: NRG; PAM sequence: TGG
agcgagcgaggcagggggcc

SEQ ID NO: 14956 - DNA, 20 bp, Artificial Sequence
  Description of Artificial Sequence: Synthetic oligonucleotide
  Target: DMPK; (+) strand; PAM type: NRG; PAM sequence: GGG
gcgagcgaggcagggggcct

SEQ ID NO: 14957 - DNA, 20 bp, Artificial Sequence
  Description of Artificial Sequence: Synthetic oligonucleotide
  Target: DMPK; (+) strand; PAM type: NRG; PAM sequence: CAG
gcgaggcagggggcctgggc

SEQ ID NO: 14958 - DNA, 20 bp, Artificial Sequence
  Description of Artificial Sequence: Synthetic oligonucleotide
  Target: DMPK; (+) strand; PAM type: NRG; PAM sequence: AGG
cgaggcagggggcctgggcc

SEQ ID NO: 14959 - DNA, 20 bp, Artificial Sequence
  Description of Artificial Sequence: Synthetic oligonucleotide
  Target: DMPK; (+) strand; PAM type: NRG; PAM sequence: GAG
ggccaggctcgccacccctc

SEQ ID NO: 14960 - DNA, 20 bp, Artificial Sequence
  Description of Artificial Sequence: Synthetic oligonucleotide
  Target: DMPK; (+) strand; PAM type: NRG; PAM sequence: TGG
ctcgccacccctcgagctgc

SEQ ID NO: 14961 - DNA, 20 bp, Artificial Sequence
  Description of Artificial Sequence: Synthetic oligonucleotide
  Target: DMPK; (+) strand; PAM type: NRG; PAM sequence: CGG
gccacccctcgagctgctgg

SEQ ID NO: 14962 - DNA, 20 bp, Artificial Sequence
  Description of Artificial Sequence: Synthetic oligonucleotide
  Target: DMPK; (+) strand; PAM type: NRG; PAM sequence: CGG
cccctcgagctgctggcggc

SEQ ID NO: 14963 - DNA, 20 bp, Artificial Sequence
  Description of Artificial Sequence: Synthetic oligonucleotide
  Target: DMPK; (+) strand; PAM type: NRG; PAM sequence: TGG
ctcgagctgctggcggccgg

SEQ ID NO: 14964 - DNA, 20 bp, Artificial Sequence
  Description of Artificial Sequence: Synthetic oligonucleotide
  Target: DMPK; (+) strand; PAM type: NRG; PAM sequence: TGG
gctgctggcggccggtggcg

SEQ ID NO: 14965 - DNA, 20 bp, Artificial Sequence
  Description of Artificial Sequence: Synthetic oligonucleotide
  Target: DMPK; (+) strand; PAM type: NRG; PAM sequence: CAG
ggcggccggtggcgtggtgc

SEQ ID NO: 14966 - DNA, 20 bp, Artificial Sequence
  Description of Artificial Sequence: Synthetic oligonucleotide
  Target: DMPK; (+) strand; PAM type: NRG; PAM sequence: AGG
gcggccggtggcgtggtgcc

SEQ ID NO: 14967 - DNA, 20 bp, Artificial Sequence
  Description of Artificial Sequence: Synthetic oligonucleotide
  Target: DMPK; (+) strand; PAM type: NRG; PAM sequence: CAG
tggcgtggtgccaggtgtgc

SEQ ID NO: 14968 - DNA, 20 bp, Artificial Sequence
  Description of Artificial Sequence: Synthetic oligonucleotide
  Target: DMPK; (+) strand; PAM type: NRG; PAM sequence: AGG
ggcgtggtgccaggtgtgcc

SEQ ID NO: 14969 - DNA, 20 bp, Artificial Sequence
  Description of Artificial Sequence: Synthetic oligonucleotide
  Target: DMPK; (+) strand; PAM type: NRG; PAM sequence: GGG
gcgtggtgccaggtgtgcca

SEQ ID NO: 14970 - DNA, 20 bp, Artificial Sequence
  Description of Artificial Sequence: Synthetic oligonucleotide
  Target: DMPK; (+) strand; PAM type: NRG; PAM sequence: GAG
gtggtgccaggtgtgccagg

SEQ ID NO: 14971 - DNA, 20 bp, Artificial Sequence
  Description of Artificial Sequence: Synthetic oligonucleotide
  Target: DMPK; (+) strand; PAM type: NRG; PAM sequence: AGG
tggtgccaggtgtgccaggg

SEQ ID NO: 14972 - DNA, 20 bp, Artificial Sequence
  Description of Artificial Sequence: Synthetic oligonucleotide
  Target: DMPK; (+) strand; PAM type: NRG; PAM sequence: GGG
ggtgccaggtgtgccaggga

SEQ ID NO: 14973 - DNA, 20 bp, Artificial Sequence
  Description of Artificial Sequence: Synthetic oligonucleotide
  Target: DMPK; (+) strand; PAM type: NRG; PAM sequence: CGG
caggtgtgccagggagggtg

SEQ ID NO: 14974 - DNA, 20 bp, Artificial Sequence
  Description of Artificial Sequence: Synthetic oligonucleotide
  Target: DMPK; (+) strand; PAM type: NRG; PAM sequence: GGG
aggtgtgccagggagggtgc

SEQ ID NO: 14975 - DNA, 20 bp, Artificial Sequence
  Description of Artificial Sequence: Synthetic oligonucleotide
  Target: DMPK; (+) strand; PAM type: NRG; PAM sequence: CGG
tgccagggagggtgcgggtg

SEQ ID NO: 14976 - DNA, 20 bp, Artificial Sequence
  Description of Artificial Sequence: Synthetic oligonucleotide
  Target: DMPK; (+) strand; PAM type: NRG; PAM sequence: GGG
gccagggagggtgcgggtgc

SEQ ID NO: 14977 - DNA, 20 bp, Artificial Sequence
  Description of Artificial Sequence: Synthetic oligonucleotide
  Target: DMPK; (+) strand; PAM type: NRG; PAM sequence: CAG
gggagggtgcgggtgcgggc

SEQ ID NO: 14978 - DNA, 20 bp, Artificial Sequence
  Description of Artificial Sequence: Synthetic oligonucleotide
  Target: DMPK; (+) strand; PAM type: NRG; PAM sequence: AGG
ggagggtgcgggtgcgggcc

SEQ ID NO: 14979 - DNA, 20 bp, Artificial Sequence
  Description of Artificial Sequence: Synthetic oligonucleotide
  Target: DMPK; (+) strand; PAM type: NRG; PAM sequence: GGG
gagggtgcgggtgcgggcca

SEQ ID NO: 14980 - DNA, 20 bp, Artificial Sequence
  Description of Artificial Sequence: Synthetic oligonucleotide
  Target: DMPK; (+) strand; PAM type: NRG; PAM sequence: GGG
agggtgcgggtgcgggccag

SEQ ID NO: 14981 - DNA, 20 bp, Artificial Sequence
  Description of Artificial Sequence: Synthetic oligonucleotide
  Target: DMPK; (+) strand; PAM type: NRG; PAM sequence: GGG
gggtgcgggtgcgggccagg

SEQ ID NO: 14982 - DNA, 20 bp, Artificial Sequence
  Description of Artificial Sequence: Synthetic oligonucleotide
  Target: DMPK; (+) strand; PAM type: NRG; PAM sequence: GGG
ggtgcgggtgcgggccaggg

SEQ ID NO: 14983 - DNA, 20 bp, Artificial Sequence
  Description of Artificial Sequence: Synthetic oligonucleotide
  Target: DMPK; (+) strand; PAM type: NRG; PAM sequence: GGG
gtgcgggtgcgggccagggg

SEQ ID NO: 14984 - DNA, 20 bp, Artificial Sequence
  Description of Artificial Sequence: Synthetic oligonucleotide
  Target: DMPK; (+) strand; PAM type: NRG; PAM sequence: GGG
tgcgggtgcgggccaggggg

SEQ ID NO: 14985 - DNA, 20 bp, Artificial Sequence
  Description of Artificial Sequence: Synthetic oligonucleotide
  Target: DMPK; (+) strand; PAM type: NRG; PAM sequence: CGG
gtgcgggccaggggggggtg

SEQ ID NO: 14986 - DNA, 20 bp, Artificial Sequence
  Description of Artificial Sequence: Synthetic oligonucleotide
  Target: DMPK; (+) strand; PAM type: NRG; PAM sequence: GGG
tgcgggccaggggggggtgc

SEQ ID NO: 14987 - DNA, 20 bp, Artificial Sequence
  Description of Artificial Sequence: Synthetic oligonucleotide
  Target: DMPK; (+) strand; PAM type: NRG; PAM sequence: TAG
gggccaggggggggtgcggg

SEQ ID NO: 14988 - DNA, 20 bp, Artificial Sequence
  Description of Artificial Sequence: Synthetic oligonucleotide
  Target: DMPK; (+) strand; PAM type: NRG; PAM sequence: GAG
gccaggggggggtgcgggta

SEQ ID NO: 14989 - DNA, 20 bp, Artificial Sequence
  Description of Artificial Sequence: Synthetic oligonucleotide
  Target: DMPK; (+) strand; PAM type: NRG; PAM sequence: CAG
gtgcgggtagagcacgtctt

SEQ ID NO: 14990 - DNA, 20 bp, Artificial Sequence
  Description of Artificial Sequence: Synthetic oligonucleotide
  Target: DMPK; (+) strand; PAM type: NRG; PAM sequence: GAG
gggtagagcacgtcttcagt

SEQ ID NO: 14991 - DNA, 20 bp, Artificial Sequence
  Description of Artificial Sequence: Synthetic oligonucleotide
  Target: DMPK; (+) strand; PAM type: NRG; PAM sequence: AGG
ggtagagcacgtcttcagtg

SEQ ID NO: 14992 - DNA, 20 bp, Artificial Sequence
  Description of Artificial Sequence: Synthetic oligonucleotide
  Target: DMPK; (+) strand; PAM type: NRG; PAM sequence: CAG
acgtcttcagtgaggtccca

SEQ ID NO: 14993 - DNA, 20 bp, Artificial Sequence
  Description of Artificial Sequence: Synthetic oligonucleotide
  Target: DMPK; (+) strand; PAM type: NRG; PAM sequence: AGG
cgtcttcagtgaggtcccac

SEQ ID NO: 14994 - DNA, 20 bp, Artificial Sequence
  Description of Artificial Sequence: Synthetic oligonucleotide
  Target: DMPK; (+) strand; PAM type: NRG; PAM sequence: CAG
cttcagtgaggtcccacagg

SEQ ID NO: 14995 - DNA, 20 bp, Artificial Sequence
  Description of Artificial Sequence: Synthetic oligonucleotide
  Target: DMPK; (+) strand; PAM type: NRG; PAM sequence: TGG
acaggcagaactgcgtgtcc

SEQ ID NO: 14996 - DNA, 20 bp, Artificial Sequence
  Description of Artificial Sequence: Synthetic oligonucleotide
  Target: DMPK; (+) strand; PAM type: NRG; PAM sequence: GAG
actgcgtgtcctggcccgcc

SEQ ID NO: 14997 - DNA, 20 bp, Artificial Sequence
  Description of Artificial Sequence: Synthetic oligonucleotide
  Target: DMPK; (+) strand; PAM type: NRG; PAM sequence: AAG
tgtcctggcccgccgagcca

SEQ ID NO: 14998 - DNA, 20 bp, Artificial Sequence
  Description of Artificial Sequence: Synthetic oligonucleotide
  Target: DMPK; (+) strand; PAM type: NRG; PAM sequence: CGG
cctggcccgccgagccaaag

SEQ ID NO: 14999 - DNA, 20 bp, Artificial Sequence
  Description of Artificial Sequence: Synthetic oligonucleotide
  Target: DMPK; (+) strand; PAM type: NRG; PAM sequence: AAG
gcccgccgagccaaagcggt

SEQ ID NO: 15000 - DNA, 20 bp, Artificial Sequence
  Description of Artificial Sequence: Synthetic oligonucleotide
  Target: DMPK; (+) strand; PAM type: NRG; PAM sequence: TGG
cgagccaaagcggtaagtaa

SEQ ID NO: 15001 - DNA, 20 bp, Artificial Sequence
  Description of Artificial Sequence: Synthetic oligonucleotide
  Target: DMPK; (+) strand; PAM type: NRG; PAM sequence: GAG
agccaaagcggtaagtaatg

SEQ ID NO: 15002 - DNA, 20 bp, Artificial Sequence
  Description of Artificial Sequence: Synthetic oligonucleotide
  Target: DMPK; (+) strand; PAM type: NRG; PAM sequence: CAG
aaagcggtaagtaatggagc

SEQ ID NO: 15003 - DNA, 20 bp, Artificial Sequence
  Description of Artificial Sequence: Synthetic oligonucleotide
  Target: DMPK; (+) strand; PAM type: NRG; PAM sequence: TGG
gtaagtaatggagccagcct

SEQ ID NO: 15004 - DNA, 20 bp, Artificial Sequence
  Description of Artificial Sequence: Synthetic oligonucleotide
  Target: DMPK; (+) strand; PAM type: NRG; PAM sequence: GGG
taagtaatggagccagcctt

SEQ ID NO: 15005 - DNA, 20 bp, Artificial Sequence
  Description of Artificial Sequence: Synthetic oligonucleotide
  Target: DMPK; (+) strand; PAM type: NRG; PAM sequence: CAG
gtaatggagccagccttggg

SEQ ID NO: 15006 - DNA, 20 bp, Artificial Sequence
  Description of Artificial Sequence: Synthetic oligonucleotide
  Target: DMPK; (+) strand; PAM type: NRG; PAM sequence: TGG
atggagccagccttgggcag

SEQ ID NO: 15007 - DNA, 20 bp, Artificial Sequence
  Description of Artificial Sequence: Synthetic oligonucleotide
  Target: DMPK; (+) strand; PAM type: NRG; PAM sequence: GAG
ggagccagccttgggcagtg

SEQ ID NO: 15008 - DNA, 20 bp, Artificial Sequence
  Description of Artificial Sequence: Synthetic oligonucleotide
  Target: DMPK; (+) strand; PAM type: NRG; PAM sequence: GAG
agccagccttgggcagtgga

SEQ ID NO: 15009 - DNA, 20 bp, Artificial Sequence
  Description of Artificial Sequence: Synthetic oligonucleotide
  Target: DMPK; (+) strand; PAM type: NRG; PAM sequence: GAG
ccagccttgggcagtggaga

SEQ ID NO: 15010 - DNA, 20 bp, Artificial Sequence
  Description of Artificial Sequence: Synthetic oligonucleotide
  Target: DMPK; (+) strand; PAM type: NRG; PAM sequence: CGG
gccttgggcagtggagagag

SEQ ID NO: 15011 - DNA, 20 bp, Artificial Sequence
  Description of Artificial Sequence: Synthetic oligonucleotide
  Target: DMPK; (+) strand; PAM type: NRG; PAM sequence: GGG
ccttgggcagtggagagagc

SEQ ID NO: 15012 - DNA, 20 bp, Artificial Sequence
  Description of Artificial Sequence: Synthetic oligonucleotide
  Target: DMPK; (+) strand; PAM type: NRG; PAM sequence: GGG
cttgggcagtggagagagcg

SEQ ID NO: 15013 - DNA, 20 bp, Artificial Sequence
  Description of Artificial Sequence: Synthetic oligonucleotide
  Target: DMPK; (+) strand; PAM type: NRG; PAM sequence: CGG
tggagagagcggggcgcccc

SEQ ID NO: 15014 - DNA, 20 bp, Artificial Sequence
  Description of Artificial Sequence: Synthetic oligonucleotide
  Target: DMPK; (+) strand; PAM type: NRG; PAM sequence: GAG
agagcggggcgcccccggcc

SEQ ID NO: 15015 - DNA, 20 bp, Artificial Sequence
  Description of Artificial Sequence: Synthetic oligonucleotide
  Target: DMPK; (+) strand; PAM type: NRG; PAM sequence: CAG
cccggccgagcctgtgcccg

SEQ ID NO: 15016 - DNA, 20 bp, Artificial Sequence
  Description of Artificial Sequence: Synthetic oligonucleotide
  Target: DMPK; (+) strand; PAM type: NRG; PAM sequence: CGG
cgagcctgtgcccgcagcct

SEQ ID NO: 15017 - DNA, 20 bp, Artificial Sequence
  Description of Artificial Sequence: Synthetic oligonucleotide
  Target: DMPK; (+) strand; PAM type: NRG; PAM sequence: GGG
gagcctgtgcccgcagcctc

SEQ ID NO: 15018 - DNA, 20 bp, Artificial Sequence
  Description of Artificial Sequence: Synthetic oligonucleotide
  Target: DMPK; (+) strand; PAM type: NRG; PAM sequence: CAG
ttcgccgctccgctccccat

SEQ ID NO: 15019 - DNA, 20 bp, Artificial Sequence
  Description of Artificial Sequence: Synthetic oligonucleotide
  Target: DMPK; (+) strand; PAM type: NRG; PAM sequence: CGG
gctccgctccccatcagcac

SEQ ID NO: 15020 - DNA, 20 bp, Artificial Sequence
  Description of Artificial Sequence: Synthetic oligonucleotide
  Target: DMPK; (+) strand; PAM type: NRG; PAM sequence: TGG
cgccgcctcctctgcccttg

SEQ ID NO: 15021 - DNA, 20 bp, Artificial Sequence
  Description of Artificial Sequence: Synthetic oligonucleotide
  Target: DMPK; (+) strand; PAM type: NRG; PAM sequence: TAG
cctcctctgcccttgtggtg

SEQ ID NO: 15022 - DNA, 20 bp, Artificial Sequence
  Description of Artificial Sequence: Synthetic oligonucleotide
  Target: DMPK; (+) strand; PAM type: NRG; PAM sequence: AGG
ctcctctgcccttgtggtgt

SEQ ID NO: 15023 - DNA, 20 bp, Artificial Sequence
  Description of Artificial Sequence: Synthetic oligonucleotide
  Target: DMPK; (+) strand; PAM type: NRG; PAM sequence: GGG
tcctctgcccttgtggtgta

SEQ ID NO: 15024 - DNA, 20 bp, Artificial Sequence
  Description of Artificial Sequence: Synthetic oligonucleotide
  Target: DMPK; (+) strand; PAM type: NRG; PAM sequence: GGG
cctctgcccttgtggtgtag

SEQ ID NO: 15025 - DNA, 20 bp, Artificial Sequence
  Description of Artificial Sequence: Synthetic oligonucleotide
  Target: DMPK; (+) strand; PAM type: NRG; PAM sequence: AAG
cccttgtggtgtaggggtca

SEQ ID NO: 15026 - DNA, 20 bp, Artificial Sequence
  Description of Artificial Sequence: Synthetic oligonucleotide
  Target: DMPK; (+) strand; PAM type: NRG; PAM sequence: AGG
ccttgtggtgtaggggtcaa

SEQ ID NO: 15027 - DNA, 20 bp, Artificial Sequence
  Description of Artificial Sequence: Synthetic oligonucleotide
  Target: DMPK; (+) strand; PAM type: NRG; PAM sequence: CAG
ggtgtaggggtcaaaggcca

SEQ ID NO: 15028 - DNA, 20 bp, Artificial Sequence
  Description of Artificial Sequence: Synthetic oligonucleotide
  Target: DMPK; (+) strand; PAM type: NRG; PAM sequence: CAG
caaaggccacagcgttgacc

SEQ ID NO: 15029 - DNA, 20 bp, Artificial Sequence
  Description of Artificial Sequence: Synthetic oligonucleotide
  Target: DMPK; (+) strand; PAM type: NRG; PAM sequence: AGG
aaaggccacagcgttgaccc

SEQ ID NO: 15030 - DNA, 20 bp, Artificial Sequence
  Description of Artificial Sequence: Synthetic oligonucleotide
  Target: DMPK; (+) strand; PAM type: NRG; PAM sequence: TGG
cagcgttgacccaggacttg

SEQ ID NO: 15031 - DNA, 20 bp, Artificial Sequence
  Description of Artificial Sequence: Synthetic oligonucleotide
  Target: DMPK; (+) strand; PAM type: NRG; PAM sequence: TGG
tgacccaggacttgtggcca

SEQ ID NO: 15032 - DNA, 20 bp, Artificial Sequence
  Description of Artificial Sequence: Synthetic oligonucleotide
  Target: DMPK; (+) strand; PAM type: NRG; PAM sequence: GAG
ggacttgtggccatggcctc

SEQ ID NO: 15033 - DNA, 20 bp, Artificial Sequence
  Description of Artificial Sequence: Synthetic oligonucleotide
  Target: DMPK; (+) strand; PAM type: NRG; PAM sequence: CGG
catggcctcgagccaccacg

SEQ ID NO: 15034 - DNA, 20 bp, Artificial Sequence
  Description of Artificial Sequence: Synthetic oligonucleotide
  Target: DMPK; (+) strand; PAM type: NRG; PAM sequence: CGG
tcgagccaccacgcggccct

SEQ ID NO: 15035 - DNA, 20 bp, Artificial Sequence
  Description of Artificial Sequence: Synthetic oligonucleotide
  Target: DMPK; (+) strand; PAM type: NRG; PAM sequence: AAG
ccaccacgcggccctcggtg

SEQ ID NO: 15036 - DNA, 20 bp, Artificial Sequence
  Description of Artificial Sequence: Synthetic oligonucleotide
  Target: DMPK; (+) strand; PAM type: NRG; PAM sequence: AGG
caccacgcggccctcggtga

SEQ ID NO: 15037 - DNA, 20 bp, Artificial Sequence
  Description of Artificial Sequence: Synthetic oligonucleotide
  Target: DMPK; (+) strand; PAM type: NRG; PAM sequence: CGG
gccctcggtgaaggaccaca

SEQ ID NO: 15038 - DNA, 20 bp, Artificial Sequence
  Description of Artificial Sequence: Synthetic oligonucleotide
  Target: DMPK; (+) strand; PAM type: NRG; PAM sequence: CAG
gtgaaggaccacacggtgac

SEQ ID NO: 15039 - DNA, 20 bp, Artificial Sequence
  Description of Artificial Sequence: Synthetic oligonucleotide
  Target: DMPK; (+) strand; PAM type: NRG; PAM sequence: AGG
tgaaggaccacacggtgacc

SEQ ID NO: 15040 - DNA, 20 bp, Artificial Sequence
  Description of Artificial Sequence: Synthetic oligonucleotide
  Target: DMPK; (+) strand; PAM type: NRG; PAM sequence: TAG
cttcgccacccgtcaccacg

SEQ ID NO: 15041 - DNA, 20 bp, Artificial Sequence
  Description of Artificial Sequence: Synthetic oligonucleotide
  Target: DMPK; (+) strand; PAM type: NRG; PAM sequence: CGG
cgccacccgtcaccacgtag

SEQ ID NO: 15042 - DNA, 20 bp, Artificial Sequence
  Description of Artificial Sequence: Synthetic oligonucleotide
  Target: DMPK; (+) strand; PAM type: NRG; PAM sequence: CAG
cgtcaccacgtagcggccgt

SEQ ID NO: 15043 - DNA, 20 bp, Artificial Sequence
  Description of Artificial Sequence: Synthetic oligonucleotide
  Target: DMPK; (+) strand; PAM type: NRG; PAM sequence: AGG
gtcaccacgtagcggccgtc

SEQ ID NO: 15044 - DNA, 20 bp, Artificial Sequence
  Description of Artificial Sequence: Synthetic oligonucleotide
  Target: DMPK; (+) strand; PAM type: NRG; PAM sequence: GGG
tcaccacgtagcggccgtca

SEQ ID NO: 15045 - DNA, 20 bp, Artificial Sequence
  Description of Artificial Sequence: Synthetic oligonucleotide
  Target: DMPK; (+) strand; PAM type: NRG; PAM sequence: CAG
cgtagcggccgtcagggctc

SEQ ID NO: 15046 - DNA, 20 bp, Artificial Sequence
  Description of Artificial Sequence: Synthetic oligonucleotide
  Target: DMPK; (+) strand; PAM type: NRG; PAM sequence: CAG
tcagggctccagcacacaca

SEQ ID NO: 15047 - DNA, 20 bp, Artificial Sequence
  Description of Artificial Sequence: Synthetic oligonucleotide
  Target: DMPK; (+) strand; PAM type: NRG; PAM sequence: CAG
gggctccagcacacacacag

SEQ ID NO: 15048 - DNA, 20 bp, Artificial Sequence
  Description of Artificial Sequence: Synthetic oligonucleotide
  Target: DMPK; (+) strand; PAM type: NRG; PAM sequence: AGG
ggctccagcacacacacagc

SEQ ID NO: 15049 - DNA, 20 bp, Artificial Sequence
  Description of Artificial Sequence: Synthetic oligonucleotide
  Target: DMPK; (+) strand; PAM type: NRG; PAM sequence: AAG
acacacacagcaggccccca

SEQ ID NO: 15050 - DNA, 20 bp, Artificial Sequence
  Description of Artificial Sequence: Synthetic oligonucleotide
  Target: DMPK; (+) strand; PAM type: NRG; PAM sequence: TAG
cacacagcaggcccccaaag

SEQ ID NO: 15051 - DNA, 20 bp, Artificial Sequence
  Description of Artificial Sequence: Synthetic oligonucleotide
  Target: DMPK; (+) strand; PAM type: NRG; PAM sequence: GAG
cccccaaagtagctcttcat

SEQ ID NO: 15052 - DNA, 20 bp, Artificial Sequence
  Description of Artificial Sequence: Synthetic oligonucleotide
  Target: DMPK; (+) strand; PAM type: NRG; PAM sequence: CAG
tagctcttcatgagcccacg

SEQ ID NO: 15053 - DNA, 20 bp, Artificial Sequence
  Description of Artificial Sequence: Synthetic oligonucleotide
  Target: DMPK; (+) strand; PAM type: NRG; PAM sequence: AGG
agctcttcatgagcccacgc

SEQ ID NO: 15054 - DNA, 20 bp, Artificial Sequence
  Description of Artificial Sequence: Synthetic oligonucleotide
  Target: DMPK; (+) strand; PAM type: NRG; PAM sequence: GAG
ctcttcatgagcccacgcag

SEQ ID NO: 15055 - DNA, 20 bp, Artificial Sequence
  Description of Artificial Sequence: Synthetic oligonucleotide
  Target: DMPK; (+) strand; PAM type: NRG; PAM sequence: TGG
catgagcccacgcaggagca

SEQ ID NO: 15056 - DNA, 20 bp, Artificial Sequence
  Description of Artificial Sequence: Synthetic oligonucleotide
  Target: DMPK; (+) strand; PAM type: NRG; PAM sequence: GAG
tgagcccacgcaggagcatg

SEQ ID NO: 15057 - DNA, 20 bp, Artificial Sequence
  Description of Artificial Sequence: Synthetic oligonucleotide
  Target: DMPK; (+) strand; PAM type: NRG; PAM sequence: AAG
cacgcaggagcatggagtcg

SEQ ID NO: 15058 - DNA, 20 bp, Artificial Sequence
  Description of Artificial Sequence: Synthetic oligonucleotide
  Target: DMPK; (+) strand; PAM type: NRG; PAM sequence: TGG
gcaggagcatggagtcgaag

SEQ ID NO: 15059 - DNA, 20 bp, Artificial Sequence
  Description of Artificial Sequence: Synthetic oligonucleotide
  Target: DMPK; (+) strand; PAM type: NRG; PAM sequence: AAG
ggagcatggagtcgaagtgg

SEQ ID NO: 15060 - DNA, 20 bp, Artificial Sequence
  Description of Artificial Sequence: Synthetic oligonucleotide
  Target: DMPK; (+) strand; PAM type: NRG; PAM sequence: CAG
gagtcgaagtggaagacgcg

SEQ ID NO: 15061 - DNA, 20 bp, Artificial Sequence
  Description of Artificial Sequence: Synthetic oligonucleotide
  Target: DMPK; (+) strand; PAM type: NRG; PAM sequence: AGG
agtcgaagtggaagacgcgc

SEQ ID NO: 15062 - DNA, 20 bp, Artificial Sequence
  Description of Artificial Sequence: Synthetic oligonucleotide
  Target: DMPK; (+) strand; PAM type: NRG; PAM sequence: CAG
cgaagtggaagacgcgcagg

SEQ ID NO: 15063 - DNA, 20 bp, Artificial Sequence
  Description of Artificial Sequence: Synthetic oligonucleotide
  Target: DMPK; (+) strand; PAM type: NRG; PAM sequence: TGG
agacgcgcaggcagccatcc

SEQ ID NO: 15064 - DNA, 20 bp, Artificial Sequence
  Description of Artificial Sequence: Synthetic oligonucleotide
  Target: DMPK; (+) strand; PAM type: NRG; PAM sequence: CAG
ggcagccatcctggctcaca

SEQ ID NO: 15065 - DNA, 20 bp, Artificial Sequence
  Description of Artificial Sequence: Synthetic oligonucleotide
  Target: DMPK; (+) strand; PAM type: NRG; PAM sequence: AGG
gcagccatcctggctcacac

SEQ ID NO: 15066 - DNA, 20 bp, Artificial Sequence
  Description of Artificial Sequence: Synthetic oligonucleotide
  Target: DMPK; (+) strand; PAM type: NRG; PAM sequence: CAG
ccatcctggctcacacaggc

SEQ ID NO: 15067 - DNA, 20 bp, Artificial Sequence
  Description of Artificial Sequence: Synthetic oligonucleotide
  Target: DMPK; (+) strand; PAM type: NRG; PAM sequence: AGG
catcctggctcacacaggcc

SEQ ID NO: 15068 - DNA, 20 bp, Artificial Sequence
  Description of Artificial Sequence: Synthetic oligonucleotide
  Target: DMPK; (+) strand; PAM type: NRG; PAM sequence: CGG
ggctcacacaggccaggtgc

SEQ ID NO: 15069 - DNA, 20 bp, Artificial Sequence
  Description of Artificial Sequence: Synthetic oligonucleotide
  Target: DMPK; (+) strand; PAM type: NRG; PAM sequence: CGG
acaggccaggtgccggccat

SEQ ID NO: 15070 - DNA, 20 bp, Artificial Sequence
  Description of Artificial Sequence: Synthetic oligonucleotide
  Target: DMPK; (+) strand; PAM type: NRG; PAM sequence: GGG
caggccaggtgccggccatc

SEQ ID NO: 15071 - DNA, 20 bp, Artificial Sequence
  Description of Artificial Sequence: Synthetic oligonucleotide
  Target: DMPK; (+) strand; PAM type: NRG; PAM sequence: GAG
ccaggtgccggccatcgggc

SEQ ID NO: 15072 - DNA, 20 bp, Artificial Sequence
  Description of Artificial Sequence: Synthetic oligonucleotide
  Target: DMPK; (+) strand; PAM type: NRG; PAM sequence: AAG
ggtgccggccatcgggcgag

SEQ ID NO: 15073 - DNA, 20 bp, Artificial Sequence
  Description of Artificial Sequence: Synthetic oligonucleotide
  Target: DMPK; (+) strand; PAM type: NRG; PAM sequence: AGG
gtgccggccatcgggcgaga

SEQ ID NO: 15074 - DNA, 20 bp, Artificial Sequence
  Description of Artificial Sequence: Synthetic oligonucleotide
  Target: DMPK; (+) strand; PAM type: NRG; PAM sequence: GAG
ggcgagaaggcgaactcgtt

SEQ ID NO: 15075 - DNA, 20 bp, Artificial Sequence
  Description of Artificial Sequence: Synthetic oligonucleotide
  Target: DMPK; (+) strand; PAM type: NRG; PAM sequence: AGG
gcgagaaggcgaactcgttg

SEQ ID NO: 15076 - DNA, 20 bp, Artificial Sequence
  Description of Artificial Sequence: Synthetic oligonucleotide
  Target: DMPK; (+) strand; PAM type: NRG; PAM sequence: GGG
cgagaaggcgaactcgttga

SEQ ID NO: 15077 - DNA, 20 bp, Artificial Sequence
  Description of Artificial Sequence: Synthetic oligonucleotide
  Target: DMPK; (+) strand; PAM type: NRG; PAM sequence: GGG
gagaaggcgaactcgttgag

SEQ ID NO: 15078 - DNA, 20 bp, Artificial Sequence
  Description of Artificial Sequence: Synthetic oligonucleotide
  Target: DMPK; (+) strand; PAM type: NRG; PAM sequence: TGG
cccctcacccaccgcccact

SEQ ID NO: 15079 - DNA, 20 bp, Artificial Sequence
  Description of Artificial Sequence: Synthetic oligonucleotide
  Target: DMPK; (+) strand; PAM type: NRG; PAM sequence: CAG
tcacccaccgcccacttggc

SEQ ID NO: 15080 - DNA, 20 bp, Artificial Sequence
  Description of Artificial Sequence: Synthetic oligonucleotide
  Target: DMPK; (+) strand; PAM type: NRG; PAM sequence: CGG
cccaccgcccacttggccag

SEQ ID NO: 15081 - DNA, 20 bp, Artificial Sequence
  Description of Artificial Sequence: Synthetic oligonucleotide
  Target: DMPK; (+) strand; PAM type: NRG; PAM sequence: GGG
ccaccgcccacttggccagc

SEQ ID NO: 15082 - DNA, 20 bp, Artificial Sequence
  Description of Artificial Sequence: Synthetic oligonucleotide
  Target: DMPK; (+) strand; PAM type: NRG; PAM sequence: CGG
cccacttggccagcgggttg

SEQ ID NO: 15083 - DNA, 20 bp, Artificial Sequence
  Description of Artificial Sequence: Synthetic oligonucleotide
  Target: DMPK; (+) strand; PAM type: NRG; PAM sequence: GGG
ccacttggccagcgggttgc

SEQ ID NO: 15084 - DNA, 20 bp, Artificial Sequence
  Description of Artificial Sequence: Synthetic oligonucleotide
  Target: DMPK; (+) strand; PAM type: NRG; PAM sequence: GGG
cacttggccagcgggttgcg

SEQ ID NO: 15085 - DNA, 20 bp, Artificial Sequence
  Description of Artificial Sequence: Synthetic oligonucleotide
  Target: DMPK; (+) strand; PAM type: NRG; PAM sequence: TGG
gttgcggggtgccttgctct

SEQ ID NO: 15086 - DNA, 20 bp, Artificial Sequence
  Description of Artificial Sequence: Synthetic oligonucleotide
  Target: DMPK; (+) strand; PAM type: NRG; PAM sequence: CAG
gcggggtgccttgctcttgg

SEQ ID NO: 15087 - DNA, 20 bp, Artificial Sequence
  Description of Artificial Sequence: Synthetic oligonucleotide
  Target: DMPK; (+) strand; PAM type: NRG; PAM sequence: TAG
gtgccttgctcttggcagca

SEQ ID NO: 15088 - DNA, 20 bp, Artificial Sequence
  Description of Artificial Sequence: Synthetic oligonucleotide
  Target: DMPK; (+) strand; PAM type: NRG; PAM sequence: CAG
cttgctcttggcagcataga

SEQ ID NO: 15089 - DNA, 20 bp, Artificial Sequence
  Description of Artificial Sequence: Synthetic oligonucleotide
  Target: DMPK; (+) strand; PAM type: NRG; PAM sequence: GAG
tgctcttggcagcatagaca

SEQ ID NO: 15090 - DNA, 20 bp, Artificial Sequence
  Description of Artificial Sequence: Synthetic oligonucleotide
  Target: DMPK; (+) strand; PAM type: NRG; PAM sequence: AAG
tcttggcagcatagacagag

SEQ ID NO: 15091 - DNA, 20 bp, Artificial Sequence
  Description of Artificial Sequence: Synthetic oligonucleotide
  Target: DMPK; (+) strand; PAM type: NRG; PAM sequence: CAG
gagaagccctcgccctgctt

SEQ ID NO: 15092 - DNA, 20 bp, Artificial Sequence
  Description of Artificial Sequence: Synthetic oligonucleotide
  Target: DMPK; (+) strand; PAM type: NRG; PAM sequence: CAG
aagccctcgccctgcttcag

SEQ ID NO: 15093 - DNA, 20 bp, Artificial Sequence
  Description of Artificial Sequence: Synthetic oligonucleotide
  Target: DMPK; (+) strand; PAM type: NRG; PAM sequence: AGG
agccctcgccctgcttcagc

SEQ ID NO: 15094 - DNA, 20 bp, Artificial Sequence
  Description of Artificial Sequence: Synthetic oligonucleotide
  Target: DMPK; (+) strand; PAM type: NRG; PAM sequence: TGG
cctgcttcagcaggctgtac

SEQ ID NO: 15095 - DNA, 20 bp, Artificial Sequence
  Description of Artificial Sequence: Synthetic oligonucleotide
  Target: DMPK; (+) strand; PAM type: NRG; PAM sequence: GGG
ctgcttcagcaggctgtact

SEQ ID NO: 15096 - DNA, 20 bp, Artificial Sequence
  Description of Artificial Sequence: Synthetic oligonucleotide
  Target: DMPK; (+) strand; PAM type: NRG; PAM sequence: GGG
tgcttcagcaggctgtactg

SEQ ID NO: 15097 - DNA, 20 bp, Artificial Sequence
  Description of Artificial Sequence: Synthetic oligonucleotide
  Target: DMPK; (+) strand; PAM type: NRG; PAM sequence: CGG
ttcagcaggctgtactgggg

SEQ ID NO: 15098 - DNA, 20 bp, Artificial Sequence
  Description of Artificial Sequence: Synthetic oligonucleotide
  Target: DMPK; (+) strand; PAM type: NRG; PAM sequence: GGG
tcagcaggctgtactggggc

SEQ ID NO: 15099 - DNA, 20 bp, Artificial Sequence
  Description of Artificial Sequence: Synthetic oligonucleotide
  Target: DMPK; (+) strand; PAM type: NRG; PAM sequence: GGG
cagcaggctgtactggggcg

SEQ ID NO: 15100 - DNA, 20 bp, Artificial Sequence
  Description of Artificial Sequence: Synthetic oligonucleotide
  Target: DMPK; (+) strand; PAM type: NRG; PAM sequence: GAG
ggctgtactggggcggggcc

SEQ ID NO: 15101 - DNA, 20 bp, Artificial Sequence
  Description of Artificial Sequence: Synthetic oligonucleotide
  Target: DMPK; (+) strand; PAM type: NRG; PAM sequence: AGG
gctgtactggggcggggccg

SEQ ID NO: 15102 - DNA, 20 bp, Artificial Sequence
  Description of Artificial Sequence: Synthetic oligonucleotide
  Target: DMPK; (+) strand; PAM type: NRG; PAM sequence: CAG
actggggcggggccgaggcg

SEQ ID NO: 15103 - DNA, 20 bp, Artificial Sequence
  Description of Artificial Sequence: Synthetic oligonucleotide
  Target: DMPK; (+) strand; PAM type: NRG; PAM sequence: AGG
ctggggcggggccgaggcgc

SEQ ID NO: 15104 - DNA, 20 bp, Artificial Sequence
  Description of Artificial Sequence: Synthetic oligonucleotide
  Target: DMPK; (+) strand; PAM type: NRG; PAM sequence: GGG
tggggcggggccgaggcgca

SEQ ID NO: 15105 - DNA, 20 bp, Artificial Sequence
  Description of Artificial Sequence: Synthetic oligonucleotide
  Target: DMPK; (+) strand; PAM type: NRG; PAM sequence: GGG
ggggcggggccgaggcgcag

SEQ ID NO: 15106 - DNA, 20 bp, Artificial Sequence
  Description of Artificial Sequence: Synthetic oligonucleotide
  Target: DMPK; (+) strand; PAM type: NRG; PAM sequence: TGG
gcggggccgaggcgcagggg

SEQ ID NO: 15107 - DNA, 20 bp, Artificial Sequence
  Description of Artificial Sequence: Synthetic oligonucleotide
  Target: DMPK; (+) strand; PAM type: NRG; PAM sequence: CAG
caggggtggctgacgttgta

SEQ ID NO: 15108 - DNA, 20 bp, Artificial Sequence
  Description of Artificial Sequence: Synthetic oligonucleotide
  Target: DMPK; (+) strand; PAM type: NRG; PAM sequence: AGG
aggggtggctgacgttgtac

SEQ ID NO: 15109 - DNA, 20 bp, Artificial Sequence
  Description of Artificial Sequence: Synthetic oligonucleotide
  Target: DMPK; (+) strand; PAM type: NRG; PAM sequence: CAG
tggctgacgttgtacaggta

SEQ ID NO: 15110 - DNA, 20 bp, Artificial Sequence
  Description of Artificial Sequence: Synthetic oligonucleotide
  Target: DMPK; (+) strand; PAM type: NRG; PAM sequence: AGG
ggctgacgttgtacaggtac

SEQ ID NO: 15111 - DNA, 20 bp, Artificial Sequence
  Description of Artificial Sequence: Synthetic oligonucleotide
  Target: DMPK; (+) strand; PAM type: NRG; PAM sequence: TGG
tgacgttgtacaggtacagg

SEQ ID NO: 15112 - DNA, 20 bp, Artificial Sequence
  Description of Artificial Sequence: Synthetic oligonucleotide
  Target: DMPK; (+) strand; PAM type: NRG; PAM sequence: TGG
gtacaggtacaggtggccac

SEQ ID NO: 15113 - DNA, 20 bp, Artificial Sequence
  Description of Artificial Sequence: Synthetic oligonucleotide
  Target: DMPK; (+) strand; PAM type: NRG; PAM sequence: CAG
tggccactggcgtgtgatgc

SEQ ID NO: 15114 - DNA, 20 bp, Artificial Sequence
  Description of Artificial Sequence: Synthetic oligonucleotide
  Target: DMPK; (+) strand; PAM type: NRG; PAM sequence: AGG
ggccactggcgtgtgatgcc

SEQ ID NO: 15115 - DNA, 20 bp, Artificial Sequence
  Description of Artificial Sequence: Synthetic oligonucleotide
  Target: DMPK; (+) strand; PAM type: NRG; PAM sequence: CAG
ctggcgtgtgatgccaggaa

SEQ ID NO: 15116 - DNA, 20 bp, Artificial Sequence
  Description of Artificial Sequence: Synthetic oligonucleotide
  Target: DMPK; (+) strand; PAM type: NRG; PAM sequence: AGG
tggcgtgtgatgccaggaac

SEQ ID NO: 15117 - DNA, 20 bp, Artificial Sequence
  Description of Artificial Sequence: Synthetic oligonucleotide
  Target: DMPK; (+) strand; PAM type: NRG; PAM sequence: CAG
caggaacaggctctccgact

SEQ ID NO: 15118 - DNA, 20 bp, Artificial Sequence
  Description of Artificial Sequence: Synthetic oligonucleotide
  Target: DMPK; (+) strand; PAM type: NRG; PAM sequence: AGG
aggaacaggctctccgactc

SEQ ID NO: 15119 - DNA, 20 bp, Artificial Sequence
  Description of Artificial Sequence: Synthetic oligonucleotide
  Target: DMPK; (+) strand; PAM type: NRG; PAM sequence: CAG
aacaggctctccgactcagg

SEQ ID NO: 15120 - DNA, 20 bp, Artificial Sequence
  Description of Artificial Sequence: Synthetic oligonucleotide
  Target: DMPK; (+) strand; PAM type: NRG; PAM sequence: CAG
tccgactcaggcagccactt

SEQ ID NO: 15121 - DNA, 20 bp, Artificial Sequence
  Description of Artificial Sequence: Synthetic oligonucleotide
  Target: DMPK; (+) strand; PAM type: NRG; PAM sequence: TGG
ccacttcagatatgtcacct

SEQ ID NO: 15122 - DNA, 20 bp, Artificial Sequence
  Description of Artificial Sequence: Synthetic oligonucleotide
  Target: DMPK; (+) strand; PAM type: NRG; PAM sequence: CAG
tcttgtcgatcaaccgctgc

SEQ ID NO: 15123 - DNA, 20 bp, Artificial Sequence
  Description of Artificial Sequence: Synthetic oligonucleotide
  Target: DMPK; (+) strand; PAM type: NRG; PAM sequence: AGG
cttgtcgatcaaccgctgcc

SEQ ID NO: 15124 - DNA, 20 bp, Artificial Sequence
  Description of Artificial Sequence: Synthetic oligonucleotide
  Target: DMPK; (+) strand; PAM type: NRG; PAM sequence: GGG
ttgtcgatcaaccgctgcca

SEQ ID NO: 15125 - DNA, 20 bp, Artificial Sequence
  Description of Artificial Sequence: Synthetic oligonucleotide
  Target: DMPK; (+) strand; PAM type: NRG; PAM sequence: GGG
tgtcgatcaaccgctgccag

SEQ ID NO: 15126 - DNA, 20 bp, Artificial Sequence
  Description of Artificial Sequence: Synthetic oligonucleotide
  Target: DMPK; (+) strand; PAM type: NRG; PAM sequence: GAG
tcgatcaaccgctgccaggg

SEQ ID NO: 15127 - DNA, 20 bp, Artificial Sequence
  Description of Artificial Sequence: Synthetic oligonucleotide
  Target: DMPK; (+) strand; PAM type: NRG; PAM sequence: CAG
tcaaccgctgccaggggaga

SEQ ID NO: 15128 - DNA, 20 bp, Artificial Sequence
  Description of Artificial Sequence: Synthetic oligonucleotide
  Target: DMPK; (+) strand; PAM type: NRG; PAM sequence: TGG
cgctgccaggggagacagtg

SEQ ID NO: 15129 - DNA, 20 bp, Artificial Sequence
  Description of Artificial Sequence: Synthetic oligonucleotide
  Target: DMPK; (+) strand; PAM type: NRG; PAM sequence: GGG
gctgccaggggagacagtgt

SEQ ID NO: 15130 - DNA, 20 bp, Artificial Sequence
  Description of Artificial Sequence: Synthetic oligonucleotide
  Target: DMPK; (+) strand; PAM type: NRG; PAM sequence: GGG
ctgccaggggagacagtgtg

SEQ ID NO: 15131 - DNA, 20 bp, Artificial Sequence
  Description of Artificial Sequence: Synthetic oligonucleotide
  Target: DMPK; (+) strand; PAM type: NRG; PAM sequence: TGG
caggggagacagtgtggggt

SEQ ID NO: 15132 - DNA, 20 bp, Artificial Sequence
  Description of Artificial Sequence: Synthetic oligonucleotide
  Target: DMPK; (+) strand; PAM type: NRG; PAM sequence: GGG
aggggagacagtgtggggtt

SEQ ID NO: 15133 - DNA, 20 bp, Artificial Sequence
  Description of Artificial Sequence: Synthetic oligonucleotide
  Target: DMPK; (+) strand; PAM type: NRG; PAM sequence: GAG
gggagacagtgtggggttgg

SEQ ID NO: 15134 - DNA, 20 bp, Artificial Sequence
  Description of Artificial Sequence: Synthetic oligonucleotide
  Target: DMPK; (+) strand; PAM type: NRG; PAM sequence: AAG
agacagtgtggggttgggag

SEQ ID NO: 15135 - DNA, 20 bp, Artificial Sequence
  Description of Artificial Sequence: Synthetic oligonucleotide
  Target: DMPK; (+) strand; PAM type: NRG; PAM sequence: AGG
gacagtgtggggttgggaga

SEQ ID NO: 15136 - DNA, 20 bp, Artificial Sequence
  Description of Artificial Sequence: Synthetic oligonucleotide
  Target: DMPK; (+) strand; PAM type: NRG; PAM sequence: CAG
agtgtggggttgggagaagg

SEQ ID NO: 15137 - DNA, 20 bp, Artificial Sequence
  Description of Artificial Sequence: Synthetic oligonucleotide
  Target: DMPK; (+) strand; PAM type: NRG; PAM sequence: CAG
tgggagaaggcagtaaaacc

SEQ ID NO: 15138 - DNA, 20 bp, Artificial Sequence
  Description of Artificial Sequence: Synthetic oligonucleotide
  Target: DMPK; (+) strand; PAM type: NRG; PAM sequence: AGG
gggagaaggcagtaaaaccc

SEQ ID NO: 15139 - DNA, 20 bp, Artificial Sequence
  Description of Artificial Sequence: Synthetic oligonucleotide
  Target: DMPK; (+) strand; PAM type: NRG; PAM sequence: CAG
agaaggcagtaaaacccagg

SEQ ID NO: 15140 - DNA, 20 bp, Artificial Sequence
  Description of Artificial Sequence: Synthetic oligonucleotide
  Target: DMPK; (+) strand; PAM type: NRG; PAM sequence: AAG
cagaacttctccccgaccca

SEQ ID NO: 15141 - DNA, 20 bp, Artificial Sequence
  Description of Artificial Sequence: Synthetic oligonucleotide
  Target: DMPK; (+) strand; PAM type: NRG; PAM sequence: AAG
ctccccgacccaaagtcccc

SEQ ID NO: 15142 - DNA, 20 bp, Artificial Sequence
  Description of Artificial Sequence: Synthetic oligonucleotide
  Target: DMPK; (+) strand; PAM type: NRG; PAM sequence: AAG
cccgacccaaagtccccaag

SEQ ID NO: 15143 - DNA, 20 bp, Artificial Sequence
  Description of Artificial Sequence: Synthetic oligonucleotide
  Target: DMPK; (+) strand; PAM type: NRG; PAM sequence: AGG
ccgacccaaagtccccaaga

SEQ ID NO: 15144 - DNA, 20 bp, Artificial Sequence
  Description of Artificial Sequence: Synthetic oligonucleotide
  Target: DMPK; (+) strand; PAM type: NRG; PAM sequence: TGG
aaagtccccaagaaggccgt

SEQ ID NO: 15145 - DNA, 20 bp, Artificial Sequence
  Description of Artificial Sequence: Synthetic oligonucleotide
  Target: DMPK; (+) strand; PAM type: NRG; PAM sequence: TGG
cccaagaaggccgttggaca

SEQ ID NO: 15146 - DNA, 20 bp, Artificial Sequence
  Description of Artificial Sequence: Synthetic oligonucleotide
  Target: DMPK; (+) strand; PAM type: NRG; PAM sequence: CAG
tggacatggccccgctcaca

SEQ ID NO: 15147 - DNA, 20 bp, Artificial Sequence
  Description of Artificial Sequence: Synthetic oligonucleotide
  Target: DMPK; (+) strand; PAM type: NRG; PAM sequence: CAG
acatggccccgctcacacag

SEQ ID NO: 15148 - DNA, 20 bp, Artificial Sequence
  Description of Artificial Sequence: Synthetic oligonucleotide
  Target: DMPK; (+) strand; PAM type: NRG; PAM sequence: AGG
catggccccgctcacacagc

SEQ ID NO: 15149 - DNA, 20 bp, Artificial Sequence
  Description of Artificial Sequence: Synthetic oligonucleotide
  Target: DMPK; (+) strand; PAM type: NRG; PAM sequence: CAG
tcacacagcaggtgccacac

SEQ ID NO: 15150 - DNA, 20 bp, Artificial Sequence
  Description of Artificial Sequence: Synthetic oligonucleotide
  Target: DMPK; (+) strand; PAM type: NRG; PAM sequence: AGG
cacacagcaggtgccacacc

SEQ ID NO: 15151 - DNA, 20 bp, Artificial Sequence
  Description of Artificial Sequence: Synthetic oligonucleotide
  Target: DMPK; (+) strand; PAM type: NRG; PAM sequence: CAG
agcaggtgccacaccaggcc

SEQ ID NO: 15152 - DNA, 20 bp, Artificial Sequence
  Description of Artificial Sequence: Synthetic oligonucleotide
  Target: DMPK; (+) strand; PAM type: NRG; PAM sequence: AGG
gcaggtgccacaccaggccc

SEQ ID NO: 15153 - DNA, 20 bp, Artificial Sequence
  Description of Artificial Sequence: Synthetic oligonucleotide
  Target: DMPK; (+) strand; PAM type: NRG; PAM sequence: CGG
caccaggcccaggtcctcct

SEQ ID NO: 15154 - DNA, 20 bp, Artificial Sequence
  Description of Artificial Sequence: Synthetic oligonucleotide
  Target: DMPK; (+) strand; PAM type: NRG; PAM sequence: GAG
ccaggcccaggtcctcctcg

SEQ ID NO: 15155 - DNA, 20 bp, Artificial Sequence
  Description of Artificial Sequence: Synthetic oligonucleotide
  Target: DMPK; (+) strand; PAM type: NRG; PAM sequence: GAG
aggcccaggtcctcctcgga

SEQ ID NO: 15156 - DNA, 20 bp, Artificial Sequence
  Description of Artificial Sequence: Synthetic oligonucleotide
  Target: DMPK; (+) strand; PAM type: NRG; PAM sequence: AAG
cccaggtcctcctcggagag

SEQ ID NO: 15157 - DNA, 20 bp, Artificial Sequence
  Description of Artificial Sequence: Synthetic oligonucleotide
  Target: DMPK; (+) strand; PAM type: NRG; PAM sequence: TGG
tcggagagaagctcccaaac

SEQ ID NO: 15158 - DNA, 20 bp, Artificial Sequence
  Description of Artificial Sequence: Synthetic oligonucleotide
  Target: DMPK; (+) strand; PAM type: NRG; PAM sequence: GGG
cggagagaagctcccaaact

SEQ ID NO: 15159 - DNA, 20 bp, Artificial Sequence
  Description of Artificial Sequence: Synthetic oligonucleotide
  Target: DMPK; (+) strand; PAM type: NRG; PAM sequence: GGG
ggagagaagctcccaaactg

SEQ ID NO: 15160 - DNA, 20 bp, Artificial Sequence
  Description of Artificial Sequence: Synthetic oligonucleotide
  Target: DMPK; (+) strand; PAM type: NRG; PAM sequence: AAG
gagaagctcccaaactgggg

SEQ ID NO: 15161 - DNA, 20 bp, Artificial Sequence
  Description of Artificial Sequence: Synthetic oligonucleotide
  Target: DMPK; (+) strand; PAM type: NRG; PAM sequence: CAG
agctcccaaactggggaaga

SEQ ID NO: 15162 - DNA, 20 bp, Artificial Sequence
  Description of Artificial Sequence: Synthetic oligonucleotide
  Target: DMPK; (+) strand; PAM type: NRG; PAM sequence: TGG
cccaaactggggaagacaga

SEQ ID NO: 15163 - DNA, 20 bp, Artificial Sequence
  Description of Artificial Sequence: Synthetic oligonucleotide
  Target: DMPK; (+) strand; PAM type: NRG; PAM sequence: CAG
tggggaagacagatggacac

SEQ ID NO: 15164 - DNA, 20 bp, Artificial Sequence
  Description of Artificial Sequence: Synthetic oligonucleotide
  Target: DMPK; (+) strand; PAM type: NRG; PAM sequence: AGG
ggggaagacagatggacacc

SEQ ID NO: 15165 - DNA, 20 bp, Artificial Sequence
  Description of Artificial Sequence: Synthetic oligonucleotide
  Target: DMPK; (+) strand; PAM type: NRG; PAM sequence: TGG
gacagatggacaccaggtca

SEQ ID NO: 15166 - DNA, 20 bp, Artificial Sequence
  Description of Artificial Sequence: Synthetic oligonucleotide
  Target: DMPK; (+) strand; PAM type: NRG; PAM sequence: TGG
gacaccaggtcatggaaaca

SEQ ID NO: 15167 - DNA, 20 bp, Artificial Sequence
  Description of Artificial Sequence: Synthetic oligonucleotide
  Target: DMPK; (+) strand; PAM type: NRG; PAM sequence: GGG
acaccaggtcatggaaacat

SEQ ID NO: 15168 - DNA, 20 bp, Artificial Sequence
  Description of Artificial Sequence: Synthetic oligonucleotide
  Target: DMPK; (+) strand; PAM type: NRG; PAM sequence: GGG
caccaggtcatggaaacatg

SEQ ID NO: 15169 - DNA, 20 bp, Artificial Sequence
  Description of Artificial Sequence: Synthetic oligonucleotide
  Target: DMPK; (+) strand; PAM type: NRG; PAM sequence: CAG
gtcatggaaacatggggaaa

SEQ ID NO: 15170 - DNA, 20 bp, Artificial Sequence
  Description of Artificial Sequence: Synthetic oligonucleotide
  Target: DMPK; (+) strand; PAM type: NRG; PAM sequence: GAG
catggaaacatggggaaaca

SEQ ID NO: 15171 - DNA, 20 bp, Artificial Sequence
  Description of Artificial Sequence: Synthetic oligonucleotide
  Target: DMPK; (+) strand; PAM type: NRG; PAM sequence: AGG
atggaaacatggggaaacag

SEQ ID NO: 15172 - DNA, 20 bp, Artificial Sequence
  Description of Artificial Sequence: Synthetic oligonucleotide
  Target: DMPK; (+) strand; PAM type: NRG; PAM sequence: AAG
ggggaaacagaggctgctgc

SEQ ID NO: 15173 - DNA, 20 bp, Artificial Sequence
  Description of Artificial Sequence: Synthetic oligonucleotide
  Target: DMPK; (+) strand; PAM type: NRG; PAM sequence: AGG
gggaaacagaggctgctgca

SEQ ID NO: 15174 - DNA, 20 bp, Artificial Sequence
  Description of Artificial Sequence: Synthetic oligonucleotide
  Target: DMPK; (+) strand; PAM type: NRG; PAM sequence: TGG
aaacagaggctgctgcaagg

SEQ ID NO: 15175 - DNA, 20 bp, Artificial Sequence
  Description of Artificial Sequence: Synthetic oligonucleotide
  Target: DMPK; (+) strand; PAM type: NRG; PAM sequence: CAG
aggctgctgcaaggtggcca

SEQ ID NO: 15176 - DNA, 20 bp, Artificial Sequence
  Description of Artificial Sequence: Synthetic oligonucleotide
  Target: DMPK; (+) strand; PAM type: NRG; PAM sequence: AGG
ggctgctgcaaggtggccac

SEQ ID NO: 15177 - DNA, 20 bp, Artificial Sequence
  Description of Artificial Sequence: Synthetic oligonucleotide
  Target: DMPK; (+) strand; PAM type: NRG; PAM sequence: GGG
gctgctgcaaggtggccaca

SEQ ID NO: 15178 - DNA, 20 bp, Artificial Sequence
  Description of Artificial Sequence: Synthetic oligonucleotide
  Target: DMPK; (+) strand; PAM type: NRG; PAM sequence: AAG
aggtggccacagggtgctcc

SEQ ID NO: 15179 - DNA, 20 bp, Artificial Sequence
  Description of Artificial Sequence: Synthetic oligonucleotide
  Target: DMPK; (+) strand; PAM type: NRG; PAM sequence: AGG
ggtggccacagggtgctcca

SEQ ID NO: 15180 - DNA, 20 bp, Artificial Sequence
  Description of Artificial Sequence: Synthetic oligonucleotide
  Target: DMPK; (+) strand; PAM type: NRG; PAM sequence: GAG
tggccacagggtgctccaag

SEQ ID NO: 15181 - DNA, 20 bp, Artificial Sequence
  Description of Artificial Sequence: Synthetic oligonucleotide
  Target: DMPK; (+) strand; PAM type: NRG; PAM sequence: TGG
gagcctcgatgtcccatctt

SEQ ID NO: 15182 - DNA, 20 bp, Artificial Sequence
  Description of Artificial Sequence: Synthetic oligonucleotide
  Target: DMPK; (+) strand; PAM type: NRG; PAM sequence: GAG
ctcgatgtcccatctttggc

SEQ ID NO: 15183 - DNA, 20 bp, Artificial Sequence
  Description of Artificial Sequence: Synthetic oligonucleotide
  Target: DMPK; (+) strand; PAM type: NRG; PAM sequence: AGG
tcgatgtcccatctttggcg

SEQ ID NO: 15184 - DNA, 20 bp, Artificial Sequence
  Description of Artificial Sequence: Synthetic oligonucleotide
  Target: DMPK; (+) strand; PAM type: NRG; PAM sequence: GGG
cgatgtcccatctttggcga

SEQ ID NO: 15185 - DNA, 20 bp, Artificial Sequence
  Description of Artificial Sequence: Synthetic oligonucleotide
  Target: DMPK; (+) strand; PAM type: NRG; PAM sequence: GGG
gatgtcccatctttggcgag

SEQ ID NO: 15186 - DNA, 20 bp, Artificial Sequence
  Description of Artificial Sequence: Synthetic oligonucleotide
  Target: DMPK; (+) strand; PAM type: NRG; PAM sequence: CAG
tcccatctttggcgagggga

SEQ ID NO: 15187 - DNA, 20 bp, Artificial Sequence
  Description of Artificial Sequence: Synthetic oligonucleotide
  Target: DMPK; (+) strand; PAM type: NRG; PAM sequence: CAG
ggggacagtcctgcttgcca

SEQ ID NO: 15188 - DNA, 20 bp, Artificial Sequence
  Description of Artificial Sequence: Synthetic oligonucleotide
  Target: DMPK; (+) strand; PAM type: NRG; PAM sequence: CGG
cacagaattgtcctgtatct

SEQ ID NO: 15189 - DNA, 20 bp, Artificial Sequence
  Description of Artificial Sequence: Synthetic oligonucleotide
  Target: DMPK; (+) strand; PAM type: NRG; PAM sequence: GGG
acagaattgtcctgtatctc

SEQ ID NO: 15190 - DNA, 20 bp, Artificial Sequence
  Description of Artificial Sequence: Synthetic oligonucleotide
  Target: DMPK; (+) strand; PAM type: NRG; PAM sequence: GGG
cagaattgtcctgtatctcg

SEQ ID NO: 15191 - DNA, 20 bp, Artificial Sequence
  Description of Artificial Sequence: Synthetic oligonucleotide
  Target: DMPK; (+) strand; PAM type: NRG; PAM sequence: CGG
atctcggggtcctcaacctc

SEQ ID NO: 15192 - DNA, 20 bp, Artificial Sequence
  Description of Artificial Sequence: Synthetic oligonucleotide
  Target: DMPK; (+) strand; PAM type: NRG; PAM sequence: GGG
tctcggggtcctcaacctcc

SEQ ID NO: 15193 - DNA, 20 bp, Artificial Sequence
  Description of Artificial Sequence: Synthetic oligonucleotide
  Target: DMPK; (+) strand; PAM type: NRG; PAM sequence: TGG
ggtcctcaacctccgggcca

SEQ ID NO: 15194 - DNA, 20 bp, Artificial Sequence
  Description of Artificial Sequence: Synthetic oligonucleotide
  Target: DMPK; (+) strand; PAM type: NRG; PAM sequence: CAG
tcaacctccgggccatggaa

SEQ ID NO: 15195 - DNA, 20 bp, Artificial Sequence
  Description of Artificial Sequence: Synthetic oligonucleotide
  Target: DMPK; (+) strand; PAM type: NRG; PAM sequence: TAG
acctccgggccatggaacag

SEQ ID NO: 15196 - DNA, 20 bp, Artificial Sequence
  Description of Artificial Sequence: Synthetic oligonucleotide
  Target: DMPK; (+) strand; PAM type: NRG; PAM sequence: TGG
tccgggccatggaacagtag

SEQ ID NO: 15197 - DNA, 20 bp, Artificial Sequence
  Description of Artificial Sequence: Synthetic oligonucleotide
  Target: DMPK; (+) strand; PAM type: NRG; PAM sequence: TGG
catggaacagtagtggtccg

SEQ ID NO: 15198 - DNA, 20 bp, Artificial Sequence
  Description of Artificial Sequence: Synthetic oligonucleotide
  Target: DMPK; (+) strand; PAM type: NRG; PAM sequence: TAG
agtagtggtccgtggcctgt

SEQ ID NO: 15199 - DNA, 20 bp, Artificial Sequence
  Description of Artificial Sequence: Synthetic oligonucleotide
  Target: DMPK; (+) strand; PAM type: NRG; PAM sequence: AGG
gtagtggtccgtggcctgtt

SEQ ID NO: 15200 - DNA, 20 bp, Artificial Sequence
  Description of Artificial Sequence: Synthetic oligonucleotide
  Target: DMPK; (+) strand; PAM type: NRG; PAM sequence: CAG
gtccgtggcctgttaggaac

SEQ ID NO: 15201 - DNA, 20 bp, Artificial Sequence
  Description of Artificial Sequence: Synthetic oligonucleotide
  Target: DMPK; (+) strand; PAM type: NRG; PAM sequence: AGG
tccgtggcctgttaggaacc

SEQ ID NO: 15202 - DNA, 20 bp, Artificial Sequence
  Description of Artificial Sequence: Synthetic oligonucleotide
  Target: DMPK; (+) strand; PAM type: NRG; PAM sequence: CAG
ctgttaggaaccaggccatg

SEQ ID NO: 15203 - DNA, 20 bp, Artificial Sequence
  Description of Artificial Sequence: Synthetic oligonucleotide
  Target: DMPK; (+) strand; PAM type: NRG; PAM sequence: CAG
ttaggaaccaggccatgcag

SEQ ID NO: 15204 - DNA, 20 bp, Artificial Sequence
  Description of Artificial Sequence: Synthetic oligonucleotide
  Target: DMPK; (+) strand; PAM type: NRG; PAM sequence: AGG
taggaaccaggccatgcagc

SEQ ID NO: 15205 - DNA, 20 bp, Artificial Sequence
  Description of Artificial Sequence: Synthetic oligonucleotide
  Target: DMPK; (+) strand; PAM type: NRG; PAM sequence: GAG
ggaaccaggccatgcagcag

SEQ ID NO: 15206 - DNA, 20 bp, Artificial Sequence
  Description of Artificial Sequence: Synthetic oligonucleotide
  Target: DMPK; (+) strand; PAM type: NRG; PAM sequence: AGG
gaaccaggccatgcagcagg

SEQ ID NO: 15207 - DNA, 20 bp, Artificial Sequence
  Description of Artificial Sequence: Synthetic oligonucleotide
  Target: DMPK; (+) strand; PAM type: NRG; PAM sequence: GAG
caggccatgcagcaggaggt

SEQ ID NO: 15208 - DNA, 20 bp, Artificial Sequence
  Description of Artificial Sequence: Synthetic oligonucleotide
  Target: DMPK; (+) strand; PAM type: NRG; PAM sequence: TGG
gccatgcagcaggaggtgag

SEQ ID NO: 15209 - DNA, 20 bp, Artificial Sequence
  Description of Artificial Sequence: Synthetic oligonucleotide
  Target: DMPK; (+) strand; PAM type: NRG; PAM sequence: TGG
atgcagcaggaggtgagtgg

SEQ ID NO: 15210 - DNA, 20 bp, Artificial Sequence
  Description of Artificial Sequence: Synthetic oligonucleotide
  Target: DMPK; (+) strand; PAM type: NRG; PAM sequence: GGG
tgcagcaggaggtgagtggt

SEQ ID NO: 15211 - DNA, 20 bp, Artificial Sequence
  Description of Artificial Sequence: Synthetic oligonucleotide
  Target: DMPK; (+) strand; PAM type: NRG; PAM sequence: GAG
gcaggaggtgagtggtgggc

SEQ ID NO: 15212 - DNA, 20 bp, Artificial Sequence
  Description of Artificial Sequence: Synthetic oligonucleotide
  Target: DMPK; (+) strand; PAM type: NRG; PAM sequence: CAG
ggaggtgagtggtgggcgag

SEQ ID NO: 15213 - DNA, 20 bp, Artificial Sequence
  Description of Artificial Sequence: Synthetic oligonucleotide
  Target: DMPK; (+) strand; PAM type: NRG; PAM sequence: AGG
gaggtgagtggtgggcgagc

SEQ ID NO: 15214 - DNA, 20 bp, Artificial Sequence
  Description of Artificial Sequence: Synthetic oligonucleotide
  Target: DMPK; (+) strand; PAM type: NRG; PAM sequence: CAG
tggtgggcgagcaggcatta

SEQ ID NO: 15215 - DNA, 20 bp, Artificial Sequence
  Description of Artificial Sequence: Synthetic oligonucleotide
  Target: DMPK; (+) strand; PAM type: NRG; PAM sequence: GAG
gcgagcaggcattacagcct

SEQ ID NO: 15216 - DNA, 20 bp, Artificial Sequence
  Description of Artificial Sequence: Synthetic oligonucleotide
  Target: DMPK; (+) strand; PAM type: NRG; PAM sequence: CAG
caggcattacagcctgagcc

SEQ ID NO: 15217 - DNA, 20 bp, Artificial Sequence
  Description of Artificial Sequence: Synthetic oligonucleotide
  Target: DMPK; (+) strand; PAM type: NRG; PAM sequence: CGG
gcctgagcccagcctcctac

SEQ ID NO: 15218 - DNA, 20 bp, Artificial Sequence
  Description of Artificial Sequence: Synthetic oligonucleotide
  Target: DMPK; (+) strand; PAM type: NRG; PAM sequence: GAG
ctgagcccagcctcctaccg

SEQ ID NO: 15219 - DNA, 20 bp, Artificial Sequence
  Description of Artificial Sequence: Synthetic oligonucleotide
  Target: DMPK; (+) strand; PAM type: NRG; PAM sequence: CAG
agcccagcctcctaccggag

SEQ ID NO: 15220 - DNA, 20 bp, Artificial Sequence
  Description of Artificial Sequence: Synthetic oligonucleotide
  Target: DMPK; (+) strand; PAM type: NRG; PAM sequence: AAG
gcgcaccattcaatcctcgt

SEQ ID NO: 15221 - DNA, 20 bp, Artificial Sequence
  Description of Artificial Sequence: Synthetic oligonucleotide
  Target: DMPK; (+) strand; PAM type: NRG; PAM sequence: GAG
gcaccattcaatcctcgtaa

SEQ ID NO: 15222 - DNA, 20 bp, Artificial Sequence
  Description of Artificial Sequence: Synthetic oligonucleotide
  Target: DMPK; (+) strand; PAM type: NRG; PAM sequence: GAG
ccaccatgaactatgcatgc

SEQ ID NO: 15223 - DNA, 20 bp, Artificial Sequence
  Description of Artificial Sequence: Synthetic oligonucleotide
  Target: DMPK; (+) strand; PAM type: NRG; PAM sequence: AGG
caccatgaactatgcatgcg

SEQ ID NO: 15224 - DNA, 20 bp, Artificial Sequence
  Description of Artificial Sequence: Synthetic oligonucleotide
  Target: DMPK; (+) strand; PAM type: NRG; PAM sequence: GGG
accatgaactatgcatgcga

SEQ ID NO: 15225 - DNA, 20 bp, Artificial Sequence
  Description of Artificial Sequence: Synthetic oligonucleotide
  Target: DMPK; (+) strand; PAM type: NRG; PAM sequence: TAG
aactatgcatgcgagggatc

SEQ ID NO: 15226 - DNA, 20 bp, Artificial Sequence
  Description of Artificial Sequence: Synthetic oligonucleotide
  Target: DMPK; (+) strand; PAM type: NRG; PAM sequence: AGG
actatgcatgcgagggatct

SEQ ID NO: 15227 - DNA, 20 bp, Artificial Sequence
  Description of Artificial Sequence: Synthetic oligonucleotide
  Target: DMPK; (+) strand; PAM type: NRG; PAM sequence: TAG
tctaggtgtgcgctccttat

SEQ ID NO: 15228 - DNA, 20 bp, Artificial Sequence
  Description of Artificial Sequence: Synthetic oligonucleotide
  Target: DMPK; (+) strand; PAM type: NRG; PAM sequence: CAG
agaatctaacacctgatgat

SEQ ID NO: 15229 - DNA, 20 bp, Artificial Sequence
  Description of Artificial Sequence: Synthetic oligonucleotide
  Target: DMPK; (+) strand; PAM type: NRG; PAM sequence: GAG
aatctaacacctgatgatca

SEQ ID NO: 15230 - DNA, 20 bp, Artificial Sequence
  Description of Artificial Sequence: Synthetic oligonucleotide
  Target: DMPK; (+) strand; PAM type: NRG; PAM sequence: AGG
atctaacacctgatgatcag

SEQ ID NO: 15231 - DNA, 20 bp, Artificial Sequence
  Description of Artificial Sequence: Synthetic oligonucleotide
  Target: DMPK; (+) strand; PAM type: NRG; PAM sequence: CAG
taacacctgatgatcagagg

SEQ ID NO: 15232 - DNA, 20 bp, Artificial Sequence
  Description of Artificial Sequence: Synthetic oligonucleotide
  Target: DMPK; (+) strand; PAM type: NRG; PAM sequence: CGG
cctgatgatcagaggcagaa

SEQ ID NO: 15233 - DNA, 20 bp, Artificial Sequence
  Description of Artificial Sequence: Synthetic oligonucleotide
  Target: DMPK; (+) strand; PAM type: NRG; PAM sequence: CAG
tcccaaaaccatccccccaa

SEQ ID NO: 15234 - DNA, 20 bp, Artificial Sequence
  Description of Artificial Sequence: Synthetic oligonucleotide
  Target: DMPK; (+) strand; PAM type: NRG; PAM sequence: TGG
accatccccccaacagtctg

SEQ ID NO: 15235 - DNA, 20 bp, Artificial Sequence
  Description of Artificial Sequence: Synthetic oligonucleotide
  Target: DMPK; (+) strand; PAM type: NRG; PAM sequence: AAG
gtggaaaaactgtcttccat

SEQ ID NO: 15236 - DNA, 20 bp, Artificial Sequence
  Description of Artificial Sequence: Synthetic oligonucleotide
  Target: DMPK; (+) strand; PAM type: NRG; PAM sequence: CAG
aaaactgtcttccataagac

SEQ ID NO: 15237 - DNA, 20 bp, Artificial Sequence
  Description of Artificial Sequence: Synthetic oligonucleotide
  Target: DMPK; (-) strand; PAM type: YTN; PAM sequence: CTG
aacacagagcccacctcgag

SEQ ID NO: 15238 - DNA, 20 bp, Artificial Sequence
  Description of Artificial Sequence: Synthetic oligonucleotide
  Target: DMPK; (-) strand; PAM type: YTN; PAM sequence: CTG
tccaaagcagcgctgaacac

SEQ ID NO: 15239 - DNA, 20 bp, Artificial Sequence
  Description of Artificial Sequence: Synthetic oligonucleotide
  Target: DMPK; (-) strand; PAM type: YTN; PAM sequence: TTC
cagtgtctgtccaaagcagc

SEQ ID NO: 15240 - DNA, 20 bp, Artificial Sequence
  Description of Artificial Sequence: Synthetic oligonucleotide
  Target: DMPK; (-) strand; PAM type: YTN; PAM sequence: CTT
ccagtgtctgtccaaagcag

SEQ ID NO: 15241 - DNA, 20 bp, Artificial Sequence
  Description of Artificial Sequence: Synthetic oligonucleotide
  Target: DMPK; (-) strand; PAM type: YTN; PAM sequence: CTG
gggtgccttccagtgtctgt

SEQ ID NO: 15242 - DNA, 20 bp, Artificial Sequence
  Description of Artificial Sequence: Synthetic oligonucleotide
  Target: DMPK; (-) strand; PAM type: YTN; PAM sequence: TTA
caccaccaccaggggtctgg

SEQ ID NO: 15243 - DNA, 20 bp, Artificial Sequence
  Description of Artificial Sequence: Synthetic oligonucleotide
  Target: DMPK; (-) strand; PAM type: YTN; PAM sequence: TTA
tcggattacaccaccaccag

SEQ ID NO: 15244 - DNA, 20 bp, Artificial Sequence
  Description of Artificial Sequence: Synthetic oligonucleotide
  Target: DMPK; (-) strand; PAM type: YTN; PAM sequence: TTA
aaataaagttatcggattac

SEQ ID NO: 15245 - DNA, 20 bp, Artificial Sequence
  Description of Artificial Sequence: Synthetic oligonucleotide
  Target: DMPK; (-) strand; PAM type: YTN; PAM sequence: TTC
aattaaaataaagttatcgg

SEQ ID NO: 15246 - DNA, 20 bp, Artificial Sequence
  Description of Artificial Sequence: Synthetic oligonucleotide
  Target: DMPK; (-) strand; PAM type: YTN; PAM sequence: TTT
caattaaaataaagttatcg

SEQ ID NO: 15247 - DNA, 20 bp, Artificial Sequence
  Description of Artificial Sequence: Synthetic oligonucleotide
  Target: DMPK; (-) strand; PAM type: YTN; PAM sequence: TTT
tcaattaaaataaagttatc

SEQ ID NO: 15248 - DNA, 20 bp, Artificial Sequence
  Description of Artificial Sequence: Synthetic oligonucleotide
  Target: DMPK; (-) strand; PAM type: YTN; PAM sequence: CTC
cattttcaattaaaataaag

SEQ ID NO: 15249 - DNA, 20 bp, Artificial Sequence
  Description of Artificial Sequence: Synthetic oligonucleotide
  Target: DMPK; (-) strand; PAM type: YTN; PAM sequence: TTA
tgcctccattttcaattaaa

SEQ ID NO: 15250 - DNA, 20 bp, Artificial Sequence
  Description of Artificial Sequence: Synthetic oligonucleotide
  Target: DMPK; (-) strand; PAM type: YTN; PAM sequence: CTA
ggacatgttatgcctccatt

SEQ ID NO: 15251 - DNA, 20 bp, Artificial Sequence
  Description of Artificial Sequence: Synthetic oligonucleotide
  Target: DMPK; (-) strand; PAM type: YTN; PAM sequence: TTC
taggacatgttatgcctcca

SEQ ID NO: 15252 - DNA, 20 bp, Artificial Sequence
  Description of Artificial Sequence: Synthetic oligonucleotide
  Target: DMPK; (-) strand; PAM type: YTN; PAM sequence: TTT
ctaggacatgttatgcctcc

SEQ ID NO: 15253 - DNA, 20 bp, Artificial Sequence
  Description of Artificial Sequence: Synthetic oligonucleotide
  Target: DMPK; (-) strand; PAM type: YTN; PAM sequence: TTT
tctaggacatgttatgcctc

SEQ ID NO: 15254 - DNA, 20 bp, Artificial Sequence
  Description of Artificial Sequence: Synthetic oligonucleotide
  Target: DMPK; (-) strand; PAM type: YTN; PAM sequence: TTT
ttctaggacatgttatgcct

SEQ ID NO: 15255 - DNA, 20 bp, Artificial Sequence
  Description of Artificial Sequence: Synthetic oligonucleotide
  Target: DMPK; (-) strand; PAM type: YTN; PAM sequence: TTA
tttttctaggacatgttatg

SEQ ID NO: 15256 - DNA, 20 bp, Artificial Sequence
  Description of Artificial Sequence: Synthetic oligonucleotide
  Target: DMPK; (-) strand; PAM type: YTN; PAM sequence: TTT
atttttctaggacatgttat

SEQ ID NO: 15257 - DNA, 20 bp, Artificial Sequence
  Description of Artificial Sequence: Synthetic oligonucleotide
  Target: DMPK; (-) strand; PAM type: YTN; PAM sequence: CTT
tatttttctaggacatgtta

SEQ ID NO: 15258 - DNA, 20 bp, Artificial Sequence
  Description of Artificial Sequence: Synthetic oligonucleotide
  Target: DMPK; (-) strand; PAM type: YTN; PAM sequence: CTA
aatctttatttttctaggac

SEQ ID NO: 15259 - DNA, 20 bp, Artificial Sequence
  Description of Artificial Sequence: Synthetic oligonucleotide
  Target: DMPK; (-) strand; PAM type: YTN; PAM sequence: TTG
tatcctaaatctttattttt

SEQ ID NO: 15260 - DNA, 20 bp, Artificial Sequence
  Description of Artificial Sequence: Synthetic oligonucleotide
  Target: DMPK; (-) strand; PAM type: YTN; PAM sequence: TTT
gtatcctaaatctttatttt

SEQ ID NO: 15261 - DNA, 20 bp, Artificial Sequence
  Description of Artificial Sequence: Synthetic oligonucleotide
  Target: DMPK; (-) strand; PAM type: YTN; PAM sequence: CTT
tgtatcctaaatctttattt

SEQ ID NO: 15262 - DNA, 20 bp, Artificial Sequence
  Description of Artificial Sequence: Synthetic oligonucleotide
  Target: DMPK; (-) strand; PAM type: YTN; PAM sequence: CTC
ctttgtatcctaaatcttta

SEQ ID NO: 15263 - DNA, 20 bp, Artificial Sequence
  Description of Artificial Sequence: Synthetic oligonucleotide
  Target: DMPK; (-) strand; PAM type: YTN; PAM sequence: CTG
tgtctcctttgtatcctaaa

SEQ ID NO: 15264 - DNA, 20 bp, Artificial Sequence
  Description of Artificial Sequence: Synthetic oligonucleotide
  Target: DMPK; (-) strand; PAM type: YTN; PAM sequence: CTG
ccgctgtgtctcctttgtat

SEQ ID NO: 15265 - DNA, 20 bp, Artificial Sequence
  Description of Artificial Sequence: Synthetic oligonucleotide
  Target: DMPK; (-) strand; PAM type: YTN; PAM sequence: CTG
ggggcagccctgccgctgtg

SEQ ID NO: 15266 - DNA, 20 bp, Artificial Sequence
  Description of Artificial Sequence: Synthetic oligonucleotide
  Target: DMPK; (-) strand; PAM type: YTN; PAM sequence: CTC
atccctgggggcagccctgc

SEQ ID NO: 15267 - DNA, 20 bp, Artificial Sequence
  Description of Artificial Sequence: Synthetic oligonucleotide
  Target: DMPK; (-) strand; PAM type: YTN; PAM sequence: TTC
cctcatccctgggggcagcc

SEQ ID NO: 15268 - DNA, 20 bp, Artificial Sequence
  Description of Artificial Sequence: Synthetic oligonucleotide
  Target: DMPK; (-) strand; PAM type: YTN; PAM sequence: TTA
tccggcccagaccaaagatt

SEQ ID NO: 15269 - DNA, 20 bp, Artificial Sequence
  Description of Artificial Sequence: Synthetic oligonucleotide
  Target: DMPK; (-) strand; PAM type: YTN; PAM sequence: CTC
attatccggcccagaccaaa

SEQ ID NO: 15270 - DNA, 20 bp, Artificial Sequence
  Description of Artificial Sequence: Synthetic oligonucleotide
  Target: DMPK; (-) strand; PAM type: YTN; PAM sequence: TTG
tcctcattatccggcccaga

SEQ ID NO: 15271 - DNA, 20 bp, Artificial Sequence
  Description of Artificial Sequence: Synthetic oligonucleotide
  Target: DMPK; (-) strand; PAM type: YTN; PAM sequence: CTT
gtcctcattatccggcccag

SEQ ID NO: 15272 - DNA, 20 bp, Artificial Sequence
  Description of Artificial Sequence: Synthetic oligonucleotide
  Target: DMPK; (-) strand; PAM type: YTN; PAM sequence: CTC
aagcccttgtcctcattatc

SEQ ID NO: 15273 - DNA, 20 bp, Artificial Sequence
  Description of Artificial Sequence: Synthetic oligonucleotide
  Target: DMPK; (-) strand; PAM type: YTN; PAM sequence: CTC
gactcaagcccttgtcctca

SEQ ID NO: 15274 - DNA, 20 bp, Artificial Sequence
  Description of Artificial Sequence: Synthetic oligonucleotide
  Target: DMPK; (-) strand; PAM type: YTN; PAM sequence: CTC
ccctcgactcaagcccttgt

SEQ ID NO: 15275 - DNA, 20 bp, Artificial Sequence
  Description of Artificial Sequence: Synthetic oligonucleotide
  Target: DMPK; (-) strand; PAM type: YTN; PAM sequence: TTC
accagctcccctcgactcaa

SEQ ID NO: 15276 - DNA, 20 bp, Artificial Sequence
  Description of Artificial Sequence: Synthetic oligonucleotide
  Target: DMPK; (-) strand; PAM type: YTN; PAM sequence: CTT
caccagctcccctcgactca

SEQ ID NO: 15277 - DNA, 20 bp, Artificial Sequence
  Description of Artificial Sequence: Synthetic oligonucleotide
  Target: DMPK; (-) strand; PAM type: YTN; PAM sequence: TTC
cttcaccagctcccctcgac

SEQ ID NO: 15278 - DNA, 20 bp, Artificial Sequence
  Description of Artificial Sequence: Synthetic oligonucleotide
  Target: DMPK; (-) strand; PAM type: YTN; PAM sequence: CTT
ccttcaccagctcccctcga

SEQ ID NO: 15279 - DNA, 20 bp, Artificial Sequence
  Description of Artificial Sequence: Synthetic oligonucleotide
  Target: DMPK; (-) strand; PAM type: YTN; PAM sequence: CTG
tggggagacgggggtcttcc

SEQ ID NO: 15280 - DNA, 20 bp, Artificial Sequence
  Description of Artificial Sequence: Synthetic oligonucleotide
  Target: DMPK; (-) strand; PAM type: YTN; PAM sequence: CTG
ccaggggcggggggtggggc

SEQ ID NO: 15281 - DNA, 20 bp, Artificial Sequence
  Description of Artificial Sequence: Synthetic oligonucleotide
  Target: DMPK; (-) strand; PAM type: YTN; PAM sequence: TTC
ctgccaggggcggggggtgg

SEQ ID NO: 15282 - DNA, 20 bp, Artificial Sequence
  Description of Artificial Sequence: Synthetic oligonucleotide
  Target: DMPK; (-) strand; PAM type: YTN; PAM sequence: TTT
cctgccaggggcggggggtg

SEQ ID NO: 15283 - DNA, 20 bp, Artificial Sequence
  Description of Artificial Sequence: Synthetic oligonucleotide
  Target: DMPK; (-) strand; PAM type: YTN; PAM sequence: CTC
cccagtgtggcatttcctgc

SEQ ID NO: 15284 - DNA, 20 bp, Artificial Sequence
  Description of Artificial Sequence: Synthetic oligonucleotide
  Target: DMPK; (-) strand; PAM type: YTN; PAM sequence: CTG
gagaccctccccagtgtggc

SEQ ID NO: 15285 - DNA, 20 bp, Artificial Sequence
  Description of Artificial Sequence: Synthetic oligonucleotide
  Target: DMPK; (-) strand; PAM type: YTN; PAM sequence: CTG
agactggagaccctccccag

SEQ ID NO: 15286 - DNA, 20 bp, Artificial Sequence
  Description of Artificial Sequence: Synthetic oligonucleotide
  Target: DMPK; (-) strand; PAM type: YTN; PAM sequence: CTG
gaatccgaaggtggaggaca

SEQ ID NO: 15287 - DNA, 20 bp, Artificial Sequence
  Description of Artificial Sequence: Synthetic oligonucleotide
  Target: DMPK; (-) strand; PAM type: YTN; PAM sequence: CTG
cctggaatccgaaggtggag

SEQ ID NO: 15288 - DNA, 20 bp, Artificial Sequence
  Description of Artificial Sequence: Synthetic oligonucleotide
  Target: DMPK; (-) strand; PAM type: YTN; PAM sequence: TTG
tcacaactgcctggaatccg

SEQ ID NO: 15289 - DNA, 20 bp, Artificial Sequence
  Description of Artificial Sequence: Synthetic oligonucleotide
  Target: DMPK; (-) strand; PAM type: YTN; PAM sequence: CTG
gtgttgtcacaactgcctgg

SEQ ID NO: 15290 - DNA, 20 bp, Artificial Sequence
  Description of Artificial Sequence: Synthetic oligonucleotide
  Target: DMPK; (-) strand; PAM type: YTN; PAM sequence: CTG
ccgatagctggtgttgtcac

SEQ ID NO: 15291 - DNA, 20 bp, Artificial Sequence
  Description of Artificial Sequence: Synthetic oligonucleotide
  Target: DMPK; (-) strand; PAM type: YTN; PAM sequence: CTC
tgccgatagctggtgttgtc

SEQ ID NO: 15292 - DNA, 20 bp, Artificial Sequence
  Description of Artificial Sequence: Synthetic oligonucleotide
  Target: DMPK; (-) strand; PAM type: YTN; PAM sequence: TTA
atagctctgccgatagctgg

SEQ ID NO: 15293 - DNA, 20 bp, Artificial Sequence
  Description of Artificial Sequence: Synthetic oligonucleotide
  Target: DMPK; (-) strand; PAM type: YTN; PAM sequence: CTA
ttaatagctctgccgatagc

SEQ ID NO: 15294 - DNA, 20 bp, Artificial Sequence
  Description of Artificial Sequence: Synthetic oligonucleotide
  Target: DMPK; (-) strand; PAM type: YTN; PAM sequence: CTG
aaacactattaatagctctg

SEQ ID NO: 15295 - DNA, 20 bp, Artificial Sequence
  Description of Artificial Sequence: Synthetic oligonucleotide
  Target: DMPK; (-) strand; PAM type: YTN; PAM sequence: CTC
cctgaaacactattaatagc

SEQ ID NO: 15296 - DNA, 20 bp, Artificial Sequence
  Description of Artificial Sequence: Synthetic oligonucleotide
  Target: DMPK; (-) strand; PAM type: YTN; PAM sequence: CTG
tcactccctgaaacactatt

SEQ ID NO: 15297 - DNA, 20 bp, Artificial Sequence
  Description of Artificial Sequence: Synthetic oligonucleotide
  Target: DMPK; (-) strand; PAM type: YTN; PAM sequence: CTC
cctgtcactccctgaaacac

SEQ ID NO: 15298 - DNA, 20 bp, Artificial Sequence
  Description of Artificial Sequence: Synthetic oligonucleotide
  Target: DMPK; (-) strand; PAM type: YTN; PAM sequence: CTC
tccctgtcactccctgaaac

SEQ ID NO: 15299 - DNA, 20 bp, Artificial Sequence
  Description of Artificial Sequence: Synthetic oligonucleotide
  Target: DMPK; (-) strand; PAM type: YTN; PAM sequence: TTC
cagcccccagagccctctcc

SEQ ID NO: 15300 - DNA, 20 bp, Artificial Sequence
  Description of Artificial Sequence: Synthetic oligonucleotide
  Target: DMPK; (-) strand; PAM type: YTN; PAM sequence: CTT
ccagcccccagagccctctc

SEQ ID NO: 15301 - DNA, 20 bp, Artificial Sequence
  Description of Artificial Sequence: Synthetic oligonucleotide
  Target: DMPK; (-) strand; PAM type: YTN; PAM sequence: CTG
ccccagggccggacttccag

SEQ ID NO: 15302 - DNA, 20 bp, Artificial Sequence
  Description of Artificial Sequence: Synthetic oligonucleotide
  Target: DMPK; (-) strand; PAM type: YTN; PAM sequence: CTG
taagcggaacaccctgcccc

SEQ ID NO: 15303 - DNA, 20 bp, Artificial Sequence
  Description of Artificial Sequence: Synthetic oligonucleotide
  Target: DMPK; (-) strand; PAM type: YTN; PAM sequence: CTA
gctgtaagcggaacaccctg

SEQ ID NO: 15304 - DNA, 20 bp, Artificial Sequence
  Description of Artificial Sequence: Synthetic oligonucleotide
  Target: DMPK; (-) strand; PAM type: YTN; PAM sequence: TTG
gtactagctgtaagcggaac

SEQ ID NO: 15305 - DNA, 20 bp, Artificial Sequence
  Description of Artificial Sequence: Synthetic oligonucleotide
  Target: DMPK; (-) strand; PAM type: YTN; PAM sequence: CTT
ggtactagctgtaagcggaa

SEQ ID NO: 15306 - DNA, 20 bp, Artificial Sequence
  Description of Artificial Sequence: Synthetic oligonucleotide
  Target: DMPK; (-) strand; PAM type: YTN; PAM sequence: CTC
cacttggtactagctgtaag

SEQ ID NO: 15307 - DNA, 20 bp, Artificial Sequence
  Description of Artificial Sequence: Synthetic oligonucleotide
  Target: DMPK; (-) strand; PAM type: YTN; PAM sequence: CTG
ccccctccacttggtactag

SEQ ID NO: 15308 - DNA, 20 bp, Artificial Sequence
  Description of Artificial Sequence: Synthetic oligonucleotide
  Target: DMPK; (-) strand; PAM type: YTN; PAM sequence: CTC
aggggccctgccccctccac

SEQ ID NO: 15309 - DNA, 20 bp, Artificial Sequence
  Description of Artificial Sequence: Synthetic oligonucleotide
  Target: DMPK; (-) strand; PAM type: YTN; PAM sequence: CTG
actcaggggccctgccccct

SEQ ID NO: 15310 - DNA, 20 bp, Artificial Sequence
  Description of Artificial Sequence: Synthetic oligonucleotide
  Target: DMPK; (-) strand; PAM type: YTN; PAM sequence: CTC
agggtcctgactcaggggcc

SEQ ID NO: 15311 - DNA, 20 bp, Artificial Sequence
  Description of Artificial Sequence: Synthetic oligonucleotide
  Target: DMPK; (-) strand; PAM type: YTN; PAM sequence: CTG
ccatatacgtgggggactca

SEQ ID NO: 15312 - DNA, 20 bp, Artificial Sequence
  Description of Artificial Sequence: Synthetic oligonucleotide
  Target: DMPK; (-) strand; PAM type: YTN; PAM sequence: CTG
tgccctgccatatacgtggg

SEQ ID NO: 15313 - DNA, 20 bp, Artificial Sequence
  Description of Artificial Sequence: Synthetic oligonucleotide
  Target: DMPK; (-) strand; PAM type: YTN; PAM sequence: CTC
cccatgctgtgccctgccat

SEQ ID NO: 15314 - DNA, 20 bp, Artificial Sequence
  Description of Artificial Sequence: Synthetic oligonucleotide
  Target: DMPK; (-) strand; PAM type: YTN; PAM sequence: TTA
cagccctccccatgctgtgc

SEQ ID NO: 15315 - DNA, 20 bp, Artificial Sequence
  Description of Artificial Sequence: Synthetic oligonucleotide
  Target: DMPK; (-) strand; PAM type: YTN; PAM sequence: CTG
ttacagccctccccatgctg

SEQ ID NO: 15316 - DNA, 20 bp, Artificial Sequence
  Description of Artificial Sequence: Synthetic oligonucleotide
  Target: DMPK; (-) strand; PAM type: YTN; PAM sequence: CTC
tgttacagccctccccatgc

SEQ ID NO: 15317 - DNA, 20 bp, Artificial Sequence
  Description of Artificial Sequence: Synthetic oligonucleotide
  Target: DMPK; (-) strand; PAM type: YTN; PAM sequence: CTC
tctgttacagccctccccat

SEQ ID NO: 15318 - DNA, 20 bp, Artificial Sequence
  Description of Artificial Sequence: Synthetic oligonucleotide
  Target: DMPK; (-) strand; PAM type: YTN; PAM sequence: TTG
gatgggaggcctctctgtta

SEQ ID NO: 15319 - DNA, 20 bp, Artificial Sequence
  Description of Artificial Sequence: Synthetic oligonucleotide
  Target: DMPK; (-) strand; PAM type: YTN; PAM sequence: TTT
ggatgggaggcctctctgtt

SEQ ID NO: 15320 - DNA, 20 bp, Artificial Sequence
  Description of Artificial Sequence: Synthetic oligonucleotide
  Target: DMPK; (-) strand; PAM type: YTN; PAM sequence: CTT
tggatgggaggcctctctgt

SEQ ID NO: 15321 - DNA, 20 bp, Artificial Sequence
  Description of Artificial Sequence: Synthetic oligonucleotide
  Target: DMPK; (-) strand; PAM type: YTN; PAM sequence: CTC
catccccctttggatgggag

SEQ ID NO: 15322 - DNA, 20 bp, Artificial Sequence
  Description of Artificial Sequence: Synthetic oligonucleotide
  Target: DMPK; (-) strand; PAM type: YTN; PAM sequence: CTG
tccaggtctccatccccctt

SEQ ID NO: 15323 - DNA, 20 bp, Artificial Sequence
  Description of Artificial Sequence: Synthetic oligonucleotide
  Target: DMPK; (-) strand; PAM type: YTN; PAM sequence: CTC
ctgtccaggtctccatcccc

SEQ ID NO: 15324 - DNA, 20 bp, Artificial Sequence
  Description of Artificial Sequence: Synthetic oligonucleotide
  Target: DMPK; (-) strand; PAM type: YTN; PAM sequence: TTG
tatccccggccacctcctgt

SEQ ID NO: 15325 - DNA, 20 bp, Artificial Sequence
  Description of Artificial Sequence: Synthetic oligonucleotide
  Target: DMPK; (-) strand; PAM type: YTN; PAM sequence: CTG
ggggttgtatccccggccac

SEQ ID NO: 15326 - DNA, 20 bp, Artificial Sequence
  Description of Artificial Sequence: Synthetic oligonucleotide
  Target: DMPK; (-) strand; PAM type: YTN; PAM sequence: CTG
gtggtgctgggggttgtatc

SEQ ID NO: 15327 - DNA, 20 bp, Artificial Sequence
  Description of Artificial Sequence: Synthetic oligonucleotide
  Target: DMPK; (-) strand; PAM type: YTN; PAM sequence: CTC
caagccctggtggtgctggg

SEQ ID NO: 15328 - DNA, 20 bp, Artificial Sequence
  Description of Artificial Sequence: Synthetic oligonucleotide
  Target: DMPK; (-) strand; PAM type: YTN; PAM sequence: CTC
tccaagccctggtggtgctg

SEQ ID NO: 15329 - DNA, 20 bp, Artificial Sequence
  Description of Artificial Sequence: Synthetic oligonucleotide
  Target: DMPK; (-) strand; PAM type: YTN; PAM sequence: CTG
ggtggcctctccaagccctg

SEQ ID NO: 15330 - DNA, 20 bp, Artificial Sequence
  Description of Artificial Sequence: Synthetic oligonucleotide
  Target: DMPK; (-) strand; PAM type: YTN; PAM sequence: CTG
cctgggtggcctctccaagc

SEQ ID NO: 15331 - DNA, 20 bp, Artificial Sequence
  Description of Artificial Sequence: Synthetic oligonucleotide
  Target: DMPK; (-) strand; PAM type: YTN; PAM sequence: TTC
tgcctgggtggcctctccaa

SEQ ID NO: 15332 - DNA, 20 bp, Artificial Sequence
  Description of Artificial Sequence: Synthetic oligonucleotide
  Target: DMPK; (-) strand; PAM type: YTN; PAM sequence: CTT
ctgcctgggtggcctctcca

SEQ ID NO: 15333 - DNA, 20 bp, Artificial Sequence
  Description of Artificial Sequence: Synthetic oligonucleotide
  Target: DMPK; (-) strand; PAM type: YTN; PAM sequence: CTG
aagaccccagtcaccacatc

SEQ ID NO: 15334 - DNA, 20 bp, Artificial Sequence
  Description of Artificial Sequence: Synthetic oligonucleotide
  Target: DMPK; (-) strand; PAM type: YTN; PAM sequence: TTG
ctgaagaccccagtcaccac

SEQ ID NO: 15335 - DNA, 20 bp, Artificial Sequence
  Description of Artificial Sequence: Synthetic oligonucleotide
  Target: DMPK; (-) strand; PAM type: YTN; PAM sequence: CTG
aagacgcagggacaggaatg

SEQ ID NO: 15336 - DNA, 20 bp, Artificial Sequence
  Description of Artificial Sequence: Synthetic oligonucleotide
  Target: DMPK; (-) strand; PAM type: YTN; PAM sequence: TTG
gtgctgaagacgcagggaca

SEQ ID NO: 15337 - DNA, 20 bp, Artificial Sequence
  Description of Artificial Sequence: Synthetic oligonucleotide
  Target: DMPK; (-) strand; PAM type: YTN; PAM sequence: CTC
ccgacattggtgctgaagac

SEQ ID NO: 15338 - DNA, 20 bp, Artificial Sequence
  Description of Artificial Sequence: Synthetic oligonucleotide
  Target: DMPK; (-) strand; PAM type: YTN; PAM sequence: CTC
tcccgacattggtgctgaag

SEQ ID NO: 15339 - DNA, 20 bp, Artificial Sequence
  Description of Artificial Sequence: Synthetic oligonucleotide
  Target: DMPK; (-) strand; PAM type: YTN; PAM sequence: CTG
tgacccagtgtggccccgtg

SEQ ID NO: 15340 - DNA, 20 bp, Artificial Sequence
  Description of Artificial Sequence: Synthetic oligonucleotide
  Target: DMPK; (-) strand; PAM type: YTN; PAM sequence: TTG
gaactgtgacccagtgtggc

SEQ ID NO: 15341 - DNA, 20 bp, Artificial Sequence
  Description of Artificial Sequence: Synthetic oligonucleotide
  Target: DMPK; (-) strand; PAM type: YTN; PAM sequence: CTT
ggaactgtgacccagtgtgg

SEQ ID NO: 15342 - DNA, 20 bp, Artificial Sequence
  Description of Artificial Sequence: Synthetic oligonucleotide
  Target: DMPK; (-) strand; PAM type: YTN; PAM sequence: CTG
tggaggagcccttggaactg

SEQ ID NO: 15343 - DNA, 20 bp, Artificial Sequence
  Description of Artificial Sequence: Synthetic oligonucleotide
  Target: DMPK; (-) strand; PAM type: YTN; PAM sequence: CTC
cagtcggtgcctgtggagga

SEQ ID NO: 15344 - DNA, 20 bp, Artificial Sequence
  Description of Artificial Sequence: Synthetic oligonucleotide
  Target: DMPK; (-) strand; PAM type: YTN; PAM sequence: CTG
acccagctccagtcggtgcc

SEQ ID NO: 15345 - DNA, 20 bp, Artificial Sequence
  Description of Artificial Sequence: Synthetic oligonucleotide
  Target: DMPK; (-) strand; PAM type: YTN; PAM sequence: TTC
tgacccagctccagtcggtg

SEQ ID NO: 15346 - DNA, 20 bp, Artificial Sequence
  Description of Artificial Sequence: Synthetic oligonucleotide
  Target: DMPK; (-) strand; PAM type: YTN; PAM sequence: CTG
aggccaaggttctgacccag

SEQ ID NO: 15347 - DNA, 20 bp, Artificial Sequence
  Description of Artificial Sequence: Synthetic oligonucleotide
  Target: DMPK; (-) strand; PAM type: YTN; PAM sequence: TTG
gaagctgaggccaaggttct

SEQ ID NO: 15348 - DNA, 20 bp, Artificial Sequence
  Description of Artificial Sequence: Synthetic oligonucleotide
  Target: DMPK; (-) strand; PAM type: YTN; PAM sequence: TTG
acgaggggttggaagctgag

SEQ ID NO: 15349 - DNA, 20 bp, Artificial Sequence
  Description of Artificial Sequence: Synthetic oligonucleotide
  Target: DMPK; (-) strand; PAM type: YTN; PAM sequence: CTG
ggggccaccgcagggggtga

SEQ ID NO: 15350 - DNA, 20 bp, Artificial Sequence
  Description of Artificial Sequence: Synthetic oligonucleotide
  Target: DMPK; (-) strand; PAM type: YTN; PAM sequence: CTC
ctgggggccaccgcaggggg

SEQ ID NO: 15351 - DNA, 20 bp, Artificial Sequence
  Description of Artificial Sequence: Synthetic oligonucleotide
  Target: DMPK; (-) strand; PAM type: YTN; PAM sequence: CTG
ctcctgggggccaccgcagg

SEQ ID NO: 15352 - DNA, 20 bp, Artificial Sequence
  Description of Artificial Sequence: Synthetic oligonucleotide
  Target: DMPK; (-) strand; PAM type: YTN; PAM sequence: CTG
aggggctgctcctgggggcc

SEQ ID NO: 15353 - DNA, 20 bp, Artificial Sequence
  Description of Artificial Sequence: Synthetic oligonucleotide
  Target: DMPK; (-) strand; PAM type: YTN; PAM sequence: CTG
ccagaccccgaccctgaggg

SEQ ID NO: 15354 - DNA, 20 bp, Artificial Sequence
  Description of Artificial Sequence: Synthetic oligonucleotide
  Target: DMPK; (-) strand; PAM type: YTN; PAM sequence: CTG
aggctgccagaccccgaccc

SEQ ID NO: 15355 - DNA, 20 bp, Artificial Sequence
  Description of Artificial Sequence: Synthetic oligonucleotide
  Target: DMPK; (-) strand; PAM type: YTN; PAM sequence: CTG
gggacacaggccccccacac

SEQ ID NO: 15356 - DNA, 20 bp, Artificial Sequence
  Description of Artificial Sequence: Synthetic oligonucleotide
  Target: DMPK; (-) strand; PAM type: YTN; PAM sequence: CTG
gaagcggaaaaggggctggg

SEQ ID NO: 15357 - DNA, 20 bp, Artificial Sequence
  Description of Artificial Sequence: Synthetic oligonucleotide
  Target: DMPK; (-) strand; PAM type: YTN; PAM sequence: CTG
ctggaagcggaaaaggggct

SEQ ID NO: 15358 - DNA, 20 bp, Artificial Sequence
  Description of Artificial Sequence: Synthetic oligonucleotide
  Target: DMPK; (-) strand; PAM type: YTN; PAM sequence: CTA
agcgcaggaacagaggggct

SEQ ID NO: 15359 - DNA, 20 bp, Artificial Sequence
  Description of Artificial Sequence: Synthetic oligonucleotide
  Target: DMPK; (-) strand; PAM type: YTN; PAM sequence: CTG
gaactaagcgcaggaacaga

SEQ ID NO: 15360 - DNA, 20 bp, Artificial Sequence
  Description of Artificial Sequence: Synthetic oligonucleotide
  Target: DMPK; (-) strand; PAM type: YTN; PAM sequence: CTG
gtcagcagggctggaactaa

SEQ ID NO: 15361 - DNA, 20 bp, Artificial Sequence
  Description of Artificial Sequence: Synthetic oligonucleotide
  Target: DMPK; (-) strand; PAM type: YTN; PAM sequence: CTG
tctggtcagcagggctggaa

SEQ ID NO: 15362 - DNA, 20 bp, Artificial Sequence
  Description of Artificial Sequence: Synthetic oligonucleotide
  Target: DMPK; (-) strand; PAM type: YTN; PAM sequence: TTG
tcacccgcggccgtgcctgt

SEQ ID NO: 15363 - DNA, 20 bp, Artificial Sequence
  Description of Artificial Sequence: Synthetic oligonucleotide
  Target: DMPK; (-) strand; PAM type: YTN; PAM sequence: CTG
atgttgtcacccgcggccgt

SEQ ID NO: 15364 - DNA, 20 bp, Artificial Sequence
  Description of Artificial Sequence: Synthetic oligonucleotide
  Target: DMPK; (-) strand; PAM type: YTN; PAM sequence: TTC
ccggcgcccccaccagaggg

SEQ ID NO: 15365 - DNA, 20 bp, Artificial Sequence
  Description of Artificial Sequence: Synthetic oligonucleotide
  Target: DMPK; (-) strand; PAM type: YTN; PAM sequence: CTT
cccggcgcccccaccagagg

SEQ ID NO: 15366 - DNA, 20 bp, Artificial Sequence
  Description of Artificial Sequence: Synthetic oligonucleotide
  Target: DMPK; (-) strand; PAM type: YTN; PAM sequence: CTG
cccaacttcccggcgccccc

SEQ ID NO: 15367 - DNA, 20 bp, Artificial Sequence
  Description of Artificial Sequence: Synthetic oligonucleotide
  Target: DMPK; (-) strand; PAM type: YTN; PAM sequence: CTC
ctgcccaacttcccggcgcc

SEQ ID NO: 15368 - DNA, 20 bp, Artificial Sequence
  Description of Artificial Sequence: Synthetic oligonucleotide
  Target: DMPK; (-) strand; PAM type: YTN; PAM sequence: CTG
gcctcctgcccaacttcccg

SEQ ID NO: 15369 - DNA, 20 bp, Artificial Sequence
  Description of Artificial Sequence: Synthetic oligonucleotide
  Target: DMPK; (-) strand; PAM type: YTN; PAM sequence: CTC
ccctggcctcctgcccaact

SEQ ID NO: 15370 - DNA, 20 bp, Artificial Sequence
  Description of Artificial Sequence: Synthetic oligonucleotide
  Target: DMPK; (-) strand; PAM type: YTN; PAM sequence: CTG
actcccctggcctcctgccc

SEQ ID NO: 15371 - DNA, 20 bp, Artificial Sequence
  Description of Artificial Sequence: Synthetic oligonucleotide
  Target: DMPK; (-) strand; PAM type: YTN; PAM sequence: CTC
ccctgactcccctggcctcc

SEQ ID NO: 15372 - DNA, 20 bp, Artificial Sequence
  Description of Artificial Sequence: Synthetic oligonucleotide
  Target: DMPK; (-) strand; PAM type: YTN; PAM sequence: TTC
tcccctgactcccctggcct

SEQ ID NO: 15373 - DNA, 20 bp, Artificial Sequence
  Description of Artificial Sequence: Synthetic oligonucleotide
  Target: DMPK; (-) strand; PAM type: YTN; PAM sequence: CTT
ctcccctgactcccctggcc

SEQ ID NO: 15374 - DNA, 20 bp, Artificial Sequence
  Description of Artificial Sequence: Synthetic oligonucleotide
  Target: DMPK; (-) strand; PAM type: YTN; PAM sequence: CTG
cccttctcccctgactcccc

SEQ ID NO: 15375 - DNA, 20 bp, Artificial Sequence
  Description of Artificial Sequence: Synthetic oligonucleotide
  Target: DMPK; (-) strand; PAM type: YTN; PAM sequence: CTC
cagcaccagcctgcccttct

SEQ ID NO: 15376 - DNA, 20 bp, Artificial Sequence
  Description of Artificial Sequence: Synthetic oligonucleotide
  Target: DMPK; (-) strand; PAM type: YTN; PAM sequence: CTG
ccaccacctccagcaccagc

SEQ ID NO: 15377 - DNA, 20 bp, Artificial Sequence
  Description of Artificial Sequence: Synthetic oligonucleotide
  Target: DMPK; (-) strand; PAM type: YTN; PAM sequence: CTG
cacagcagccaccccccgcc

SEQ ID NO: 15378 - DNA, 20 bp, Artificial Sequence
  Description of Artificial Sequence: Synthetic oligonucleotide
  Target: DMPK; (-) strand; PAM type: YTN; PAM sequence: TTC
tgcacagcagccaccccccg

SEQ ID NO: 15379 - DNA, 20 bp, Artificial Sequence
  Description of Artificial Sequence: Synthetic oligonucleotide
  Target: DMPK; (-) strand; PAM type: YTN; PAM sequence: TTT
ctgcacagcagccacccccc

SEQ ID NO: 15380 - DNA, 20 bp, Artificial Sequence
  Description of Artificial Sequence: Synthetic oligonucleotide
  Target: DMPK; (-) strand; PAM type: YTN; PAM sequence: CTT
tctgcacagcagccaccccc

SEQ ID NO: 15381 - DNA, 20 bp, Artificial Sequence
  Description of Artificial Sequence: Synthetic oligonucleotide
  Target: DMPK; (-) strand; PAM type: YTN; PAM sequence: CTA
ggcaccctttctgcacagca

SEQ ID NO: 15382 - DNA, 20 bp, Artificial Sequence
  Description of Artificial Sequence: Synthetic oligonucleotide
  Target: DMPK; (-) strand; PAM type: YTN; PAM sequence: CTC
acgccctaggcaccctttct

SEQ ID NO: 15383 - DNA, 20 bp, Artificial Sequence
  Description of Artificial Sequence: Synthetic oligonucleotide
  Target: DMPK; (-) strand; PAM type: YTN; PAM sequence: CTC
ccagaggctcacgccctagg

SEQ ID NO: 15384 - DNA, 20 bp, Artificial Sequence
  Description of Artificial Sequence: Synthetic oligonucleotide
  Target: DMPK; (-) strand; PAM type: YTN; PAM sequence: CTC
tcccagaggctcacgcccta

SEQ ID NO: 15385 - DNA, 20 bp, Artificial Sequence
  Description of Artificial Sequence: Synthetic oligonucleotide
  Target: DMPK; (-) strand; PAM type: YTN; PAM sequence: CTG
ctctcccagaggctcacgcc

SEQ ID NO: 15386 - DNA, 20 bp, Artificial Sequence
  Description of Artificial Sequence: Synthetic oligonucleotide
  Target: DMPK; (-) strand; PAM type: YTN; PAM sequence: CTC
ccggtggcccccagccctgc

SEQ ID NO: 15387 - DNA, 20 bp, Artificial Sequence
  Description of Artificial Sequence: Synthetic oligonucleotide
  Target: DMPK; (-) strand; PAM type: YTN; PAM sequence: CTG
agggaggcctcccggtggcc

SEQ ID NO: 15388 - DNA, 20 bp, Artificial Sequence
  Description of Artificial Sequence: Synthetic oligonucleotide
  Target: DMPK; (-) strand; PAM type: YTN; PAM sequence: CTC
cgtgcctgagggaggcctcc

SEQ ID NO: 15389 - DNA, 20 bp, Artificial Sequence
  Description of Artificial Sequence: Synthetic oligonucleotide
  Target: DMPK; (-) strand; PAM type: YTN; PAM sequence: CTG
aagccagagacggccatctc

SEQ ID NO: 15390 - DNA, 20 bp, Artificial Sequence
  Description of Artificial Sequence: Synthetic oligonucleotide
  Target: DMPK; (-) strand; PAM type: YTN; PAM sequence: CTG
ccactgaagccagagacggc

SEQ ID NO: 15391 - DNA, 20 bp, Artificial Sequence
  Description of Artificial Sequence: Synthetic oligonucleotide
  Target: DMPK; (-) strand; PAM type: YTN; PAM sequence: CTG
gccctgccactgaagccaga

SEQ ID NO: 15392 - DNA, 20 bp, Artificial Sequence
  Description of Artificial Sequence: Synthetic oligonucleotide
  Target: DMPK; (-) strand; PAM type: YTN; PAM sequence: CTG
ccgccagcccccggcctggc

SEQ ID NO: 15393 - DNA, 20 bp, Artificial Sequence
  Description of Artificial Sequence: Synthetic oligonucleotide
  Target: DMPK; (-) strand; PAM type: YTN; PAM sequence: CTC
ccaggtcctgccgccagccc

SEQ ID NO: 15394 - DNA, 20 bp, Artificial Sequence
  Description of Artificial Sequence: Synthetic oligonucleotide
  Target: DMPK; (-) strand; PAM type: YTN; PAM sequence: CTC
gtctcccaggtcctgccgcc

SEQ ID NO: 15395 - DNA, 20 bp, Artificial Sequence
  Description of Artificial Sequence: Synthetic oligonucleotide
  Target: DMPK; (-) strand; PAM type: YTN; PAM sequence: TTC
cccaccagcatgctcgtctc

SEQ ID NO: 15396 - DNA, 20 bp, Artificial Sequence
  Description of Artificial Sequence: Synthetic oligonucleotide
  Target: DMPK; (-) strand; PAM type: YTN; PAM sequence: CTT
ccccaccagcatgctcgtct

SEQ ID NO: 15397 - DNA, 20 bp, Artificial Sequence
  Description of Artificial Sequence: Synthetic oligonucleotide
  Target: DMPK; (-) strand; PAM type: YTN; PAM sequence: CTC
accgccaccttccccaccag

SEQ ID NO: 15398 - DNA, 20 bp, Artificial Sequence
  Description of Artificial Sequence: Synthetic oligonucleotide
  Target: DMPK; (-) strand; PAM type: YTN; PAM sequence: CTG
cagcagggcaagatcatcct

SEQ ID NO: 15399 - DNA, 20 bp, Artificial Sequence
  Description of Artificial Sequence: Synthetic oligonucleotide
  Target: DMPK; (-) strand; PAM type: YTN; PAM sequence: CTG
gcagccccatcgtgacgggt

SEQ ID NO: 15400 - DNA, 20 bp, Artificial Sequence
  Description of Artificial Sequence: Synthetic oligonucleotide
  Target: DMPK; (-) strand; PAM type: YTN; PAM sequence: CTG
tgtctggcagccccatcgtg

SEQ ID NO: 15401 - DNA, 20 bp, Artificial Sequence
  Description of Artificial Sequence: Synthetic oligonucleotide
  Target: DMPK; (-) strand; PAM type: YTN; PAM sequence: CTG
gccaaccctgtgtctggcag

SEQ ID NO: 15402 - DNA, 20 bp, Artificial Sequence
  Description of Artificial Sequence: Synthetic oligonucleotide
  Target: DMPK; (-) strand; PAM type: YTN; PAM sequence: CTC
ctggccaaccctgtgtctgg

SEQ ID NO: 15403 - DNA, 20 bp, Artificial Sequence
  Description of Artificial Sequence: Synthetic oligonucleotide
  Target: DMPK; (-) strand; PAM type: YTN; PAM sequence: TTC
ctcctggccaaccctgtgtc

SEQ ID NO: 15404 - DNA, 20 bp, Artificial Sequence
  Description of Artificial Sequence: Synthetic oligonucleotide
  Target: DMPK; (-) strand; PAM type: YTN; PAM sequence: CTT
cctcctggccaaccctgtgt

SEQ ID NO: 15405 - DNA, 20 bp, Artificial Sequence
  Description of Artificial Sequence: Synthetic oligonucleotide
  Target: DMPK; (-) strand; PAM type: YTN; PAM sequence: CTC
cccacaggaaacttcctcct

SEQ ID NO: 15406 - DNA, 20 bp, Artificial Sequence
  Description of Artificial Sequence: Synthetic oligonucleotide
  Target: DMPK; (-) strand; PAM type: YTN; PAM sequence: CTC
tccccacaggaaacttcctc

SEQ ID NO: 15407 - DNA, 20 bp, Artificial Sequence
  Description of Artificial Sequence: Synthetic oligonucleotide
  Target: DMPK; (-) strand; PAM type: YTN; PAM sequence: CTC
tctccccacaggaaacttcc

SEQ ID NO: 15408 - DNA, 20 bp, Artificial Sequence
  Description of Artificial Sequence: Synthetic oligonucleotide
  Target: DMPK; (-) strand; PAM type: YTN; PAM sequence: CTC
ggtccctctctccccacagg

SEQ ID NO: 15409 - DNA, 20 bp, Artificial Sequence
  Description of Artificial Sequence: Synthetic oligonucleotide
  Target: DMPK; (-) strand; PAM type: YTN; PAM sequence: CTG
cgctcggtccctctctcccc

SEQ ID NO: 15410 - DNA, 20 bp, Artificial Sequence
  Description of Artificial Sequence: Synthetic oligonucleotide
  Target: DMPK; (-) strand; PAM type: YTN; PAM sequence: CTC
acctgcgctcggtccctctc

SEQ ID NO: 15411 - DNA, 20 bp, Artificial Sequence
  Description of Artificial Sequence: Synthetic oligonucleotide
  Target: DMPK; (-) strand; PAM type: YTN; PAM sequence: CTC
tcacctgcgctcggtccctc

SEQ ID NO: 15412 - DNA, 20 bp, Artificial Sequence
  Description of Artificial Sequence: Synthetic oligonucleotide
  Target: DMPK; (-) strand; PAM type: YTN; PAM sequence: CTG
gctctcacctgcgctcggtc

SEQ ID NO: 15413 - DNA, 20 bp, Artificial Sequence
  Description of Artificial Sequence: Synthetic oligonucleotide
  Target: DMPK; (-) strand; PAM type: YTN; PAM sequence: CTC
ctggctctcacctgcgctcg

SEQ ID NO: 15414 - DNA, 20 bp, Artificial Sequence
  Description of Artificial Sequence: Synthetic oligonucleotide
  Target: DMPK; (-) strand; PAM type: YTN; PAM sequence: CTC
tcctggctctcacctgcgct

SEQ ID NO: 15415 - DNA, 20 bp, Artificial Sequence
  Description of Artificial Sequence: Synthetic oligonucleotide
  Target: DMPK; (-) strand; PAM type: YTN; PAM sequence: CTG
ctctcctggctctcacctgc

SEQ ID NO: 15416 - DNA, 20 bp, Artificial Sequence
  Description of Artificial Sequence: Synthetic oligonucleotide
  Target: DMPK; (-) strand; PAM type: YTN; PAM sequence: TTG
gcctgctctcctggctctca

SEQ ID NO: 15417 - DNA, 20 bp, Artificial Sequence
  Description of Artificial Sequence: Synthetic oligonucleotide
  Target: DMPK; (-) strand; PAM type: YTN; PAM sequence: CTT
ggcctgctctcctggctctc

SEQ ID NO: 15418 - DNA, 20 bp, Artificial Sequence
  Description of Artificial Sequence: Synthetic oligonucleotide
  Target: DMPK; (-) strand; PAM type: YTN; PAM sequence: CTG
gcttggcctgctctcctggc

SEQ ID NO: 15419 - DNA, 20 bp, Artificial Sequence
  Description of Artificial Sequence: Synthetic oligonucleotide
  Target: DMPK; (-) strand; PAM type: YTN; PAM sequence: CTC
tggcttggcctgctctcctg

SEQ ID NO: 15420 - DNA, 20 bp, Artificial Sequence
  Description of Artificial Sequence: Synthetic oligonucleotide
  Target: DMPK; (-) strand; PAM type: YTN; PAM sequence: CTC
tctggcttggcctgctctcc

SEQ ID NO: 15421 - DNA, 20 bp, Artificial Sequence
  Description of Artificial Sequence: Synthetic oligonucleotide
  Target: DMPK; (-) strand; PAM type: YTN; PAM sequence: TTC
tctctggcttggcctgctct

SEQ ID NO: 15422 - DNA, 20 bp, Artificial Sequence
  Description of Artificial Sequence: Synthetic oligonucleotide
  Target: DMPK; (-) strand; PAM type: YTN; PAM sequence: CTT
ctctctggcttggcctgctc

SEQ ID NO: 15423 - DNA, 20 bp, Artificial Sequence
  Description of Artificial Sequence: Synthetic oligonucleotide
  Target: DMPK; (-) strand; PAM type: YTN; PAM sequence: CTC
cacttctctctggcttggcc

SEQ ID NO: 15424 - DNA, 20 bp, Artificial Sequence
  Description of Artificial Sequence: Synthetic oligonucleotide
  Target: DMPK; (-) strand; PAM type: YTN; PAM sequence: CTG
cacagtctccacttctctct

SEQ ID NO: 15425 - DNA, 20 bp, Artificial Sequence
  Description of Artificial Sequence: Synthetic oligonucleotide
  Target: DMPK; (-) strand; PAM type: YTN; PAM sequence: CTC
cagctgcacagtctccactt

SEQ ID NO: 15426 - DNA, 20 bp, Artificial Sequence
  Description of Artificial Sequence: Synthetic oligonucleotide
  Target: DMPK; (-) strand; PAM type: YTN; PAM sequence: CTC
cgcccgccctccagctgcac

SEQ ID NO: 15427 - DNA, 20 bp, Artificial Sequence
  Description of Artificial Sequence: Synthetic oligonucleotide
  Target: DMPK; (-) strand; PAM type: YTN; PAM sequence: CTC
cctccgcccgccctccagct

SEQ ID NO: 15428 - DNA, 20 bp, Artificial Sequence
  Description of Artificial Sequence: Synthetic oligonucleotide
  Target: DMPK; (-) strand; PAM type: YTN; PAM sequence: CTG
gcaagtcccagtgccccaag

SEQ ID NO: 15429 - DNA, 20 bp, Artificial Sequence
  Description of Artificial Sequence: Synthetic oligonucleotide
  Target: DMPK; (-) strand; PAM type: YTN; PAM sequence: CTC
atccctggcaagtcccagtg

SEQ ID NO: 15430 - DNA, 20 bp, Artificial Sequence
  Description of Artificial Sequence: Synthetic oligonucleotide
  Target: DMPK; (-) strand; PAM type: YTN; PAM sequence: CTG
gagggcatctcatccctggc

SEQ ID NO: 15431 - DNA, 20 bp, Artificial Sequence
  Description of Artificial Sequence: Synthetic oligonucleotide
  Target: DMPK; (-) strand; PAM type: YTN; PAM sequence: CTC
ctggagggcatctcatccct

SEQ ID NO: 15432 - DNA, 20 bp, Artificial Sequence
  Description of Artificial Sequence: Synthetic oligonucleotide
  Target: DMPK; (-) strand; PAM type: YTN; PAM sequence: CTG
ggctcctggagggcatctca

SEQ ID NO: 15433 - DNA, 20 bp, Artificial Sequence
  Description of Artificial Sequence: Synthetic oligonucleotide
  Target: DMPK; (-) strand; PAM type: YTN; PAM sequence: CTG
tccctgggctcctggagggc

SEQ ID NO: 15434 - DNA, 20 bp, Artificial Sequence
  Description of Artificial Sequence: Synthetic oligonucleotide
  Target: DMPK; (-) strand; PAM type: YTN; PAM sequence: CTC
ggagagggaggggctgtccc

SEQ ID NO: 15435 - DNA, 20 bp, Artificial Sequence
  Description of Artificial Sequence: Synthetic oligonucleotide
  Target: DMPK; (-) strand; PAM type: YTN; PAM sequence: CTA
ggtgagagccggggaggggt

SEQ ID NO: 15436 - DNA, 20 bp, Artificial Sequence
  Description of Artificial Sequence: Synthetic oligonucleotide
  Target: DMPK; (-) strand; PAM type: YTN; PAM sequence: CTC
aggcctaggtgagagccggg

SEQ ID NO: 15437 - DNA, 20 bp, Artificial Sequence
  Description of Artificial Sequence: Synthetic oligonucleotide
  Target: DMPK; (-) strand; PAM type: YTN; PAM sequence: CTC
cctcaggcctaggtgagagc

SEQ ID NO: 15438 - DNA, 20 bp, Artificial Sequence
  Description of Artificial Sequence: Synthetic oligonucleotide
  Target: DMPK; (-) strand; PAM type: YTN; PAM sequence: CTC
cctccctcaggcctaggtga

SEQ ID NO: 15439 - DNA, 20 bp, Artificial Sequence
  Description of Artificial Sequence: Synthetic oligonucleotide
  Target: DMPK; (-) strand; PAM type: YTN; PAM sequence: CTG
ccccaggtacccccatctcc

SEQ ID NO: 15440 - DNA, 20 bp, Artificial Sequence
  Description of Artificial Sequence: Synthetic oligonucleotide
  Target: DMPK; (-) strand; PAM type: YTN; PAM sequence: TTC
ggccactgccccaggtaccc

SEQ ID NO: 15441 - DNA, 20 bp, Artificial Sequence
  Description of Artificial Sequence: Synthetic oligonucleotide
  Target: DMPK; (-) strand; PAM type: YTN; PAM sequence: CTT
cggccactgccccaggtacc

SEQ ID NO: 15442 - DNA, 20 bp, Artificial Sequence
  Description of Artificial Sequence: Synthetic oligonucleotide
  Target: DMPK; (-) strand; PAM type: YTN; PAM sequence: CTG
ccttcggccactgccccagg

SEQ ID NO: 15443 - DNA, 20 bp, Artificial Sequence
  Description of Artificial Sequence: Synthetic oligonucleotide
  Target: DMPK; (-) strand; PAM type: YTN; PAM sequence: CTG
cagctgccttcggccactgc

SEQ ID NO: 15444 - DNA, 20 bp, Artificial Sequence
  Description of Artificial Sequence: Synthetic oligonucleotide
  Target: DMPK; (-) strand; PAM type: YTN; PAM sequence: CTG
ccctgcagctgccttcggcc

SEQ ID NO: 15445 - DNA, 20 bp, Artificial Sequence
  Description of Artificial Sequence: Synthetic oligonucleotide
  Target: DMPK; (-) strand; PAM type: YTN; PAM sequence: CTC
cggggtgggcgtgactgccc

SEQ ID NO: 15446 - DNA, 20 bp, Artificial Sequence
  Description of Artificial Sequence: Synthetic oligonucleotide
  Target: DMPK; (-) strand; PAM type: YTN; PAM sequence: CTC
atcaactccggggtgggcgt

SEQ ID NO: 15447 - DNA, 20 bp, Artificial Sequence
  Description of Artificial Sequence: Synthetic oligonucleotide
  Target: DMPK; (-) strand; PAM type: YTN; PAM sequence: CTG
ccaatgtgcacctcatcaac

SEQ ID NO: 15448 - DNA, 20 bp, Artificial Sequence
  Description of Artificial Sequence: Synthetic oligonucleotide
  Target: DMPK; (-) strand; PAM type: YTN; PAM sequence: CTG
cagcaggccctgccaatgtg

SEQ ID NO: 15449 - DNA, 20 bp, Artificial Sequence
  Description of Artificial Sequence: Synthetic oligonucleotide
  Target: DMPK; (-) strand; PAM type: YTN; PAM sequence: CTG
tgaaggtggcagctgcagca

SEQ ID NO: 15450 - DNA, 20 bp, Artificial Sequence
  Description of Artificial Sequence: Synthetic oligonucleotide
  Target: DMPK; (-) strand; PAM type: YTN; PAM sequence: TTG
gcagccgggccaggcagccc

SEQ ID NO: 15451 - DNA, 20 bp, Artificial Sequence
  Description of Artificial Sequence: Synthetic oligonucleotide
  Target: DMPK; (-) strand; PAM type: YTN; PAM sequence: CTG
ttggcagccgggccaggcag

SEQ ID NO: 15452 - DNA, 20 bp, Artificial Sequence
  Description of Artificial Sequence: Synthetic oligonucleotide
  Target: DMPK; (-) strand; PAM type: YTN; PAM sequence: CTG
cagctgttggcagccgggcc

SEQ ID NO: 15453 - DNA, 20 bp, Artificial Sequence
  Description of Artificial Sequence: Synthetic oligonucleotide
  Target: DMPK; (-) strand; PAM type: YTN; PAM sequence: CTG
tggggcccctgcagctgttg

SEQ ID NO: 15454 - DNA, 20 bp, Artificial Sequence
  Description of Artificial Sequence: Synthetic oligonucleotide
  Target: DMPK; (-) strand; PAM type: YTN; PAM sequence: CTG
ccccaggctgtggggcccct

SEQ ID NO: 15455 - DNA, 20 bp, Artificial Sequence
  Description of Artificial Sequence: Synthetic oligonucleotide
  Target: DMPK; (-) strand; PAM type: YTN; PAM sequence: CTC
acaggtggtgaccctgcccc

SEQ ID NO: 15456 - DNA, 20 bp, Artificial Sequence
  Description of Artificial Sequence: Synthetic oligonucleotide
  Target: DMPK; (-) strand; PAM type: YTN; PAM sequence: CTG
ccccaggtagtacccacctc

SEQ ID NO: 15457 - DNA, 20 bp, Artificial Sequence
  Description of Artificial Sequence: Synthetic oligonucleotide
  Target: DMPK; (-) strand; PAM type: YTN; PAM sequence: TTG
aacctgccccaggtagtacc

SEQ ID NO: 15458 - DNA, 20 bp, Artificial Sequence
  Description of Artificial Sequence: Synthetic oligonucleotide
  Target: DMPK; (-) strand; PAM type: YTN; PAM sequence: CTA
ttgaacctgccccaggtagt

SEQ ID NO: 15459 - DNA, 20 bp, Artificial Sequence
  Description of Artificial Sequence: Synthetic oligonucleotide
  Target: DMPK; (-) strand; PAM type: YTN; PAM sequence: CTC
cccactattgaacctgcccc

SEQ ID NO: 15460 - DNA, 20 bp, Artificial Sequence
  Description of Artificial Sequence: Synthetic oligonucleotide
  Target: DMPK; (-) strand; PAM type: YTN; PAM sequence: CTG
agccccacctccccactatt

SEQ ID NO: 15461 - DNA, 20 bp, Artificial Sequence
  Description of Artificial Sequence: Synthetic oligonucleotide
  Target: DMPK; (-) strand; PAM type: YTN; PAM sequence: CTC
cccacccccggggtatccca

SEQ ID NO: 15462 - DNA, 20 bp, Artificial Sequence
  Description of Artificial Sequence: Synthetic oligonucleotide
  Target: DMPK; (-) strand; PAM type: YTN; PAM sequence: CTC
tccccacccccggggtatcc

SEQ ID NO: 15463 - DNA, 20 bp, Artificial Sequence
  Description of Artificial Sequence: Synthetic oligonucleotide
  Target: DMPK; (-) strand; PAM type: YTN; PAM sequence: CTG
ccccacaagtggtaccgctc

SEQ ID NO: 15464 - DNA, 20 bp, Artificial Sequence
  Description of Artificial Sequence: Synthetic oligonucleotide
  Target: DMPK; (-) strand; PAM type: YTN; PAM sequence: CTG
tggctgccccacaagtggta

SEQ ID NO: 15465 - DNA, 20 bp, Artificial Sequence
  Description of Artificial Sequence: Synthetic oligonucleotide
  Target: DMPK; (-) strand; PAM type: YTN; PAM sequence: CTG
ctgtggctgccccacaagtg

SEQ ID NO: 15466 - DNA, 20 bp, Artificial Sequence
  Description of Artificial Sequence: Synthetic oligonucleotide
  Target: DMPK; (-) strand; PAM type: YTN; PAM sequence: CTG
cccccggggccagtgcctgc

SEQ ID NO: 15467 - DNA, 20 bp, Artificial Sequence
  Description of Artificial Sequence: Synthetic oligonucleotide
  Target: DMPK; (-) strand; PAM type: YTN; PAM sequence: CTC
tgcccccggggccagtgcct

SEQ ID NO: 15468 - DNA, 20 bp, Artificial Sequence
  Description of Artificial Sequence: Synthetic oligonucleotide
  Target: DMPK; (-) strand; PAM type: YTN; PAM sequence: TTC
ctctgcccccggggccagtg

SEQ ID NO: 15469 - DNA, 20 bp, Artificial Sequence
  Description of Artificial Sequence: Synthetic oligonucleotide
  Target: DMPK; (-) strand; PAM type: YTN; PAM sequence: TTT
cctctgcccccggggccagt

SEQ ID NO: 15470 - DNA, 20 bp, Artificial Sequence
  Description of Artificial Sequence: Synthetic oligonucleotide
  Target: DMPK; (-) strand; PAM type: YTN; PAM sequence: CTT
tcctctgcccccggggccag

SEQ ID NO: 15471 - DNA, 20 bp, Artificial Sequence
  Description of Artificial Sequence: Synthetic oligonucleotide
  Target: DMPK; (-) strand; PAM type: YTN; PAM sequence: CTG
ccacctttcctctgcccccg

SEQ ID NO: 15472 - DNA, 20 bp, Artificial Sequence
  Description of Artificial Sequence: Synthetic oligonucleotide
  Target: DMPK; (-) strand; PAM type: YTN; PAM sequence: CTG
gccccccgacggctgccacc

SEQ ID NO: 15473 - DNA, 20 bp, Artificial Sequence
  Description of Artificial Sequence: Synthetic oligonucleotide
  Target: DMPK; (-) strand; PAM type: YTN; PAM sequence: CTG
gcccaagtggtgcctggccc

SEQ ID NO: 15474 - DNA, 20 bp, Artificial Sequence
  Description of Artificial Sequence: Synthetic oligonucleotide
  Target: DMPK; (-) strand; PAM type: YTN; PAM sequence: CTG
gggcccctggcccaagtggt

SEQ ID NO: 15475 - DNA, 20 bp, Artificial Sequence
  Description of Artificial Sequence: Synthetic oligonucleotide
  Target: DMPK; (-) strand; PAM type: YTN; PAM sequence: TTG
gagaggaggtcctggggccc

SEQ ID NO: 15476 - DNA, 20 bp, Artificial Sequence
  Description of Artificial Sequence: Synthetic oligonucleotide
  Target: DMPK; (-) strand; PAM type: YTN; PAM sequence: CTT
ggagaggaggtcctggggcc

SEQ ID NO: 15477 - DNA, 20 bp, Artificial Sequence
  Description of Artificial Sequence: Synthetic oligonucleotide
  Target: DMPK; (-) strand; PAM type: YTN; PAM sequence: CTC
cgggaccagcccttggagag

SEQ ID NO: 15478 - DNA, 20 bp, Artificial Sequence
  Description of Artificial Sequence: Synthetic oligonucleotide
  Target: DMPK; (-) strand; PAM type: YTN; PAM sequence: CTG
ctccgggaccagcccttgga

SEQ ID NO: 15479 - DNA, 20 bp, Artificial Sequence
  Description of Artificial Sequence: Synthetic oligonucleotide
  Target: DMPK; (-) strand; PAM type: YTN; PAM sequence: CTG
agaccaaaggggcccaggtg

SEQ ID NO: 15480 - DNA, 20 bp, Artificial Sequence
  Description of Artificial Sequence: Synthetic oligonucleotide
  Target: DMPK; (-) strand; PAM type: YTN; PAM sequence: CTC
agtcggaggcccctgagacc

SEQ ID NO: 15481 - DNA, 20 bp, Artificial Sequence
  Description of Artificial Sequence: Synthetic oligonucleotide
  Target: DMPK; (-) strand; PAM type: YTN; PAM sequence: CTG
gaggaggctcagtcggaggc

SEQ ID NO: 15482 - DNA, 20 bp, Artificial Sequence
  Description of Artificial Sequence: Synthetic oligonucleotide
  Target: DMPK; (-) strand; PAM type: YTN; PAM sequence: CTC
agacaggggaggtgcggctg

SEQ ID NO: 15483 - DNA, 20 bp, Artificial Sequence
  Description of Artificial Sequence: Synthetic oligonucleotide
  Target: DMPK; (-) strand; PAM type: YTN; PAM sequence: CTG
gaccctcagacaggggaggt

SEQ ID NO: 15484 - DNA, 20 bp, Artificial Sequence
  Description of Artificial Sequence: Synthetic oligonucleotide
  Target: DMPK; (-) strand; PAM type: YTN; PAM sequence: CTG
gtcctggaccctcagacagg

SEQ ID NO: 15485 - DNA, 20 bp, Artificial Sequence
  Description of Artificial Sequence: Synthetic oligonucleotide
  Target: DMPK; (-) strand; PAM type: YTN; PAM sequence: CTC
tggtcctggaccctcagaca

SEQ ID NO: 15486 - DNA, 20 bp, Artificial Sequence
  Description of Artificial Sequence: Synthetic oligonucleotide
  Target: DMPK; (-) strand; PAM type: YTN; PAM sequence: CTC
tctggtcctggaccctcaga

SEQ ID NO: 15487 - DNA, 20 bp, Artificial Sequence
  Description of Artificial Sequence: Synthetic oligonucleotide
  Target: DMPK; (-) strand; PAM type: YTN; PAM sequence: CTC
agggggccagcgagaccaag

SEQ ID NO: 15488 - DNA, 20 bp, Artificial Sequence
  Description of Artificial Sequence: Synthetic oligonucleotide
  Target: DMPK; (-) strand; PAM type: YTN; PAM sequence: CTC
caccgcagcccagccctcag

SEQ ID NO: 15489 - DNA, 20 bp, Artificial Sequence
  Description of Artificial Sequence: Synthetic oligonucleotide
  Target: DMPK; (-) strand; PAM type: YTN; PAM sequence: CTG
ggggcgggggtgcccctcca

SEQ ID NO: 15490 - DNA, 20 bp, Artificial Sequence
  Description of Artificial Sequence: Synthetic oligonucleotide
  Target: DMPK; (-) strand; PAM type: YTN; PAM sequence: CTC
actgggggcgggggtgcccc

SEQ ID NO: 15491 - DNA, 20 bp, Artificial Sequence
  Description of Artificial Sequence: Synthetic oligonucleotide
  Target: DMPK; (-) strand; PAM type: YTN; PAM sequence: CTG
ctcactgggggcgggggtgc

SEQ ID NO: 15492 - DNA, 20 bp, Artificial Sequence
  Description of Artificial Sequence: Synthetic oligonucleotide
  Target: DMPK; (-) strand; PAM type: YTN; PAM sequence: CTG
ctgctcactgggggcggggg

SEQ ID NO: 15493 - DNA, 20 bp, Artificial Sequence
  Description of Artificial Sequence: Synthetic oligonucleotide
  Target: DMPK; (-) strand; PAM type: YTN; PAM sequence: CTG
ggcccgctgctgctcactgg

SEQ ID NO: 15494 - DNA, 20 bp, Artificial Sequence
  Description of Artificial Sequence: Synthetic oligonucleotide
  Target: DMPK; (-) strand; PAM type: YTN; PAM sequence: CTC
cagcctgggcccgctgctgc

SEQ ID NO: 15495 - DNA, 20 bp, Artificial Sequence
  Description of Artificial Sequence: Synthetic oligonucleotide
  Target: DMPK; (-) strand; PAM type: YTN; PAM sequence: CTG
ggcgaggcctccagcctggg

SEQ ID NO: 15496 - DNA, 20 bp, Artificial Sequence
  Description of Artificial Sequence: Synthetic oligonucleotide
  Target: DMPK; (-) strand; PAM type: YTN; PAM sequence: CTG
gccctgggcgaggcctccag

SEQ ID NO: 15497 - DNA, 20 bp, Artificial Sequence
  Description of Artificial Sequence: Synthetic oligonucleotide
  Target: DMPK; (-) strand; PAM type: YTN; PAM sequence: CTC
aacgggggccccgtcatcat

SEQ ID NO: 15498 - DNA, 20 bp, Artificial Sequence
  Description of Artificial Sequence: Synthetic oligonucleotide
  Target: DMPK; (-) strand; PAM type: YTN; PAM sequence: CTC
ctcaacgggggccccgtcat

SEQ ID NO: 15499 - DNA, 20 bp, Artificial Sequence
  Description of Artificial Sequence: Synthetic oligonucleotide
  Target: DMPK; (-) strand; PAM type: YTN; PAM sequence: CTC
cccagcagtgctcctcaacg

SEQ ID NO: 15500 - DNA, 20 bp, Artificial Sequence
  Description of Artificial Sequence: Synthetic oligonucleotide
  Target: DMPK; (-) strand; PAM type: YTN; PAM sequence: CTG
gcagccagcggctccccagc

SEQ ID NO: 15501 - DNA, 20 bp, Artificial Sequence
  Description of Artificial Sequence: Synthetic oligonucleotide
  Target: DMPK; (-) strand; PAM type: YTN; PAM sequence: TTC
ctggcagccagcggctcccc

SEQ ID NO: 15502 - DNA, 20 bp, Artificial Sequence
  Description of Artificial Sequence: Synthetic oligonucleotide
  Target: DMPK; (-) strand; PAM type: YTN; PAM sequence: CTT
cctggcagccagcggctccc

SEQ ID NO: 15503 - DNA, 20 bp, Artificial Sequence
  Description of Artificial Sequence: Synthetic oligonucleotide
  Target: DMPK; (-) strand; PAM type: YTN; PAM sequence: CTG
gtgaacgggagcttcctggc

SEQ ID NO: 15504 - DNA, 20 bp, Artificial Sequence
  Description of Artificial Sequence: Synthetic oligonucleotide
  Target: DMPK; (-) strand; PAM type: YTN; PAM sequence: CTC
catcctggtgaacgggagct

SEQ ID NO: 15505 - DNA, 20 bp, Artificial Sequence
  Description of Artificial Sequence: Synthetic oligonucleotide
  Target: DMPK; (-) strand; PAM type: YTN; PAM sequence: CTC
ctccatcctggtgaacggga

SEQ ID NO: 15506 - DNA, 20 bp, Artificial Sequence
  Description of Artificial Sequence: Synthetic oligonucleotide
  Target: DMPK; (-) strand; PAM type: YTN; PAM sequence: TTC
ctcctccatcctggtgaacg

SEQ ID NO: 15507 - DNA, 20 bp, Artificial Sequence
  Description of Artificial Sequence: Synthetic oligonucleotide
  Target: DMPK; (-) strand; PAM type: YTN; PAM sequence: CTT
cctcctccatcctggtgaac

SEQ ID NO: 15508 - DNA, 20 bp, Artificial Sequence
  Description of Artificial Sequence: Synthetic oligonucleotide
  Target: DMPK; (-) strand; PAM type: YTN; PAM sequence: TTG
cccggcttcctcctccatcc

SEQ ID NO: 15509 - DNA, 20 bp, Artificial Sequence
  Description of Artificial Sequence: Synthetic oligonucleotide
  Target: DMPK; (-) strand; PAM type: YTN; PAM sequence: CTT
gcccggcttcctcctccatc

SEQ ID NO: 15510 - DNA, 20 bp, Artificial Sequence
  Description of Artificial Sequence: Synthetic oligonucleotide
  Target: DMPK; (-) strand; PAM type: YTN; PAM sequence: CTC
ccgcgccttgcccggcttcc

SEQ ID NO: 15511 - DNA, 20 bp, Artificial Sequence
  Description of Artificial Sequence: Synthetic oligonucleotide
  Target: DMPK; (-) strand; PAM type: YTN; PAM sequence: CTG
gcagggaccggccctcccgc

SEQ ID NO: 15512 - DNA, 20 bp, Artificial Sequence
  Description of Artificial Sequence: Synthetic oligonucleotide
  Target: DMPK; (-) strand; PAM type: YTN; PAM sequence: TTC
ctggcagggaccggccctcc

SEQ ID NO: 15513 - DNA, 20 bp, Artificial Sequence
  Description of Artificial Sequence: Synthetic oligonucleotide
  Target: DMPK; (-) strand; PAM type: YTN; PAM sequence: CTC
catattcctggcagggaccg

SEQ ID NO: 15514 - DNA, 20 bp, Artificial Sequence
  Description of Artificial Sequence: Synthetic oligonucleotide
  Target: DMPK; (-) strand; PAM type: YTN; PAM sequence: CTG
cccagggctccatattcctg

SEQ ID NO: 15515 - DNA, 20 bp, Artificial Sequence
  Description of Artificial Sequence: Synthetic oligonucleotide
  Target: DMPK; (-) strand; PAM type: YTN; PAM sequence: CTG
gagagaggggcggccccagt

SEQ ID NO: 15516 - DNA, 20 bp, Artificial Sequence
  Description of Artificial Sequence: Synthetic oligonucleotide
  Target: DMPK; (-) strand; PAM type: YTN; PAM sequence: CTG
aggacctggagagaggggcg

SEQ ID NO: 15517 - DNA, 20 bp, Artificial Sequence
  Description of Artificial Sequence: Synthetic oligonucleotide
  Target: DMPK; (-) strand; PAM type: YTN; PAM sequence: CTG
aggacgagtccagccgaagt

SEQ ID NO: 15518 - DNA, 20 bp, Artificial Sequence
  Description of Artificial Sequence: Synthetic oligonucleotide
  Target: DMPK; (-) strand; PAM type: YTN; PAM sequence: CTG
atgggaatcccacgactgag

SEQ ID NO: 15519 - DNA, 20 bp, Artificial Sequence
  Description of Artificial Sequence: Synthetic oligonucleotide
  Target: DMPK; (-) strand; PAM type: YTN; PAM sequence: CTC
cggccagcgagtctgatggg

SEQ ID NO: 15520 - DNA, 20 bp, Artificial Sequence
  Description of Artificial Sequence: Synthetic oligonucleotide
  Target: DMPK; (-) strand; PAM type: YTN; PAM sequence: TTC
tccggccagcgagtctgatg

SEQ ID NO: 15521 - DNA, 20 bp, Artificial Sequence
  Description of Artificial Sequence: Synthetic oligonucleotide
  Target: DMPK; (-) strand; PAM type: YTN; PAM sequence: TTT
ctccggccagcgagtctgat

SEQ ID NO: 15522 - DNA, 20 bp, Artificial Sequence
  Description of Artificial Sequence: Synthetic oligonucleotide
  Target: DMPK; (-) strand; PAM type: YTN; PAM sequence: CTG
acagccatttctccggccag

SEQ ID NO: 15523 - DNA, 20 bp, Artificial Sequence
  Description of Artificial Sequence: Synthetic oligonucleotide
  Target: DMPK; (-) strand; PAM type: YTN; PAM sequence: CTA
agggaccccagctgacagcc

SEQ ID NO: 15524 - DNA, 20 bp, Artificial Sequence
  Description of Artificial Sequence: Synthetic oligonucleotide
  Target: DMPK; (-) strand; PAM type: YTN; PAM sequence: CTA
tgcgggaggccccacaggct

SEQ ID NO: 15525 - DNA, 20 bp, Artificial Sequence
  Description of Artificial Sequence: Synthetic oligonucleotide
  Target: DMPK; (-) strand; PAM type: YTN; PAM sequence: CTG
gctatgcgggaggccccaca

SEQ ID NO: 15526 - DNA, 20 bp, Artificial Sequence
  Description of Artificial Sequence: Synthetic oligonucleotide
  Target: DMPK; (-) strand; PAM type: YTN; PAM sequence: CTG
gctggctatgcgggaggccc

SEQ ID NO: 15527 - DNA, 20 bp, Artificial Sequence
  Description of Artificial Sequence: Synthetic oligonucleotide
  Target: DMPK; (-) strand; PAM type: YTN; PAM sequence: TTG
ggccagggaaaggtggggga

SEQ ID NO: 15528 - DNA, 20 bp, Artificial Sequence
  Description of Artificial Sequence: Synthetic oligonucleotide
  Target: DMPK; (-) strand; PAM type: YTN; PAM sequence: CTT
gggccagggaaaggtggggg

SEQ ID NO: 15529 - DNA, 20 bp, Artificial Sequence
  Description of Artificial Sequence: Synthetic oligonucleotide
  Target: DMPK; (-) strand; PAM type: YTN; PAM sequence: CTG
gaatgatccaccgaaacttg

SEQ ID NO: 15530 - DNA, 20 bp, Artificial Sequence
  Description of Artificial Sequence: Synthetic oligonucleotide
  Target: DMPK; (-) strand; PAM type: YTN; PAM sequence: CTC
agagaggcgtcataacccct

SEQ ID NO: 15531 - DNA, 20 bp, Artificial Sequence
  Description of Artificial Sequence: Synthetic oligonucleotide
  Target: DMPK; (-) strand; PAM type: YTN; PAM sequence: TTG
gagtggtctcagagaggcgt

SEQ ID NO: 15532 - DNA, 20 bp, Artificial Sequence
  Description of Artificial Sequence: Synthetic oligonucleotide
  Target: DMPK; (-) strand; PAM type: YTN; PAM sequence: TTT
ggagtggtctcagagaggcg

SEQ ID NO: 15533 - DNA, 20 bp, Artificial Sequence
  Description of Artificial Sequence: Synthetic oligonucleotide
  Target: DMPK; (-) strand; PAM type: YTN; PAM sequence: CTG
gagtttggagtggtctcaga

SEQ ID NO: 15534 - DNA, 20 bp, Artificial Sequence
  Description of Artificial Sequence: Synthetic oligonucleotide
  Target: DMPK; (-) strand; PAM type: YTN; PAM sequence: TTG
caaaaggccctggagtttgg

SEQ ID NO: 15535 - DNA, 20 bp, Artificial Sequence
  Description of Artificial Sequence: Synthetic oligonucleotide
  Target: DMPK; (-) strand; PAM type: YTN; PAM sequence: CTT
gcaaaaggccctggagtttg

SEQ ID NO: 15536 - DNA, 20 bp, Artificial Sequence
  Description of Artificial Sequence: Synthetic oligonucleotide
  Target: DMPK; (-) strand; PAM type: YTN; PAM sequence: CTG
cagtggtgtccacgcagggc

SEQ ID NO: 15537 - DNA, 20 bp, Artificial Sequence
  Description of Artificial Sequence: Synthetic oligonucleotide
  Target: DMPK; (-) strand; PAM type: YTN; PAM sequence: CTC
tgcagtggtgtccacgcagg

SEQ ID NO: 15538 - DNA, 20 bp, Artificial Sequence
  Description of Artificial Sequence: Synthetic oligonucleotide
  Target: DMPK; (-) strand; PAM type: YTN; PAM sequence: TTC
tctgcagtggtgtccacgca

SEQ ID NO: 15539 - DNA, 20 bp, Artificial Sequence
  Description of Artificial Sequence: Synthetic oligonucleotide
  Target: DMPK; (-) strand; PAM type: YTN; PAM sequence: CTT
ctctgcagtggtgtccacgc

SEQ ID NO: 15540 - DNA, 20 bp, Artificial Sequence
  Description of Artificial Sequence: Synthetic oligonucleotide
  Target: DMPK; (-) strand; PAM type: YTN; PAM sequence: CTC
cccagcgcttctctgcagtg

SEQ ID NO: 15541 - DNA, 20 bp, Artificial Sequence
  Description of Artificial Sequence: Synthetic oligonucleotide
  Target: DMPK; (-) strand; PAM type: YTN; PAM sequence: TTC
cctccccagcgcttctctgc

SEQ ID NO: 15542 - DNA, 20 bp, Artificial Sequence
  Description of Artificial Sequence: Synthetic oligonucleotide
  Target: DMPK; (-) strand; PAM type: YTN; PAM sequence: CTT
ccctccccagcgcttctctg

SEQ ID NO: 15543 - DNA, 20 bp, Artificial Sequence
  Description of Artificial Sequence: Synthetic oligonucleotide
  Target: DMPK; (-) strand; PAM type: YTN; PAM sequence: CTC
ttccctccccagcgcttctc

SEQ ID NO: 15544 - DNA, 20 bp, Artificial Sequence
  Description of Artificial Sequence: Synthetic oligonucleotide
  Target: DMPK; (-) strand; PAM type: YTN; PAM sequence: CTG
gggacccgaggccgaggtgg

SEQ ID NO: 15545 - DNA, 20 bp, Artificial Sequence
  Description of Artificial Sequence: Synthetic oligonucleotide
  Target: DMPK; (-) strand; PAM type: YTN; PAM sequence: CTC
tggggacccgaggccgaggt

SEQ ID NO: 15546 - DNA, 20 bp, Artificial Sequence
  Description of Artificial Sequence: Synthetic oligonucleotide
  Target: DMPK; (-) strand; PAM type: YTN; PAM sequence: CTC
agcctctggggacccgaggc

SEQ ID NO: 15547 - DNA, 20 bp, Artificial Sequence
  Description of Artificial Sequence: Synthetic oligonucleotide
  Target: DMPK; (-) strand; PAM type: YTN; PAM sequence: CTG
ggagctcagcctctggggac

SEQ ID NO: 15548 - DNA, 20 bp, Artificial Sequence
  Description of Artificial Sequence: Synthetic oligonucleotide
  Target: DMPK; (-) strand; PAM type: YTN; PAM sequence: TTA
gggcaacctgggagctcagc

SEQ ID NO: 15549 - DNA, 20 bp, Artificial Sequence
  Description of Artificial Sequence: Synthetic oligonucleotide
  Target: DMPK; (-) strand; PAM type: YTN; PAM sequence: TTT
agggcaacctgggagctcag

SEQ ID NO: 15550 - DNA, 20 bp, Artificial Sequence
  Description of Artificial Sequence: Synthetic oligonucleotide
  Target: DMPK; (-) strand; PAM type: YTN; PAM sequence: TTT
tagggcaacctgggagctca

SEQ ID NO: 15551 - DNA, 20 bp, Artificial Sequence
  Description of Artificial Sequence: Synthetic oligonucleotide
  Target: DMPK; (-) strand; PAM type: YTN; PAM sequence: CTT
ttagggcaacctgggagctc

SEQ ID NO: 15552 - DNA, 20 bp, Artificial Sequence
  Description of Artificial Sequence: Synthetic oligonucleotide
  Target: DMPK; (-) strand; PAM type: YTN; PAM sequence: TTC
cgcccaaccaaggaactttt

SEQ ID NO: 15553 - DNA, 20 bp, Artificial Sequence
  Description of Artificial Sequence: Synthetic oligonucleotide
  Target: DMPK; (-) strand; PAM type: YTN; PAM sequence: TTT
ccgcccaaccaaggaacttt

SEQ ID NO: 15554 - DNA, 20 bp, Artificial Sequence
  Description of Artificial Sequence: Synthetic oligonucleotide
  Target: DMPK; (-) strand; PAM type: YTN; PAM sequence: CTT
tccgcccaaccaaggaactt

SEQ ID NO: 15555 - DNA, 20 bp, Artificial Sequence
  Description of Artificial Sequence: Synthetic oligonucleotide
  Target: DMPK; (-) strand; PAM type: YTN; PAM sequence: CTC
gcccgctttccgcccaacca

SEQ ID NO: 15556 - DNA, 20 bp, Artificial Sequence
  Description of Artificial Sequence: Synthetic oligonucleotide
  Target: DMPK; (-) strand; PAM type: YTN; PAM sequence: CTC
caggccactcgcccgctttc

SEQ ID NO: 15557 - DNA, 20 bp, Artificial Sequence
  Description of Artificial Sequence: Synthetic oligonucleotide
  Target: DMPK; (-) strand; PAM type: YTN; PAM sequence: CTC
tccaggccactcgcccgctt

SEQ ID NO: 15558 - DNA, 20 bp, Artificial Sequence
  Description of Artificial Sequence: Synthetic oligonucleotide
  Target: DMPK; (-) strand; PAM type: YTN; PAM sequence: CTC
tctccaggccactcgcccgc

SEQ ID NO: 15559 - DNA, 20 bp, Artificial Sequence
  Description of Artificial Sequence: Synthetic oligonucleotide
  Target: DMPK; (-) strand; PAM type: YTN; PAM sequence: CTC
cctctctccaggccactcgc

SEQ ID NO: 15560 - DNA, 20 bp, Artificial Sequence
  Description of Artificial Sequence: Synthetic oligonucleotide
  Target: DMPK; (-) strand; PAM type: YTN; PAM sequence: CTG
ctccctctctccaggccact

SEQ ID NO: 15561 - DNA, 20 bp, Artificial Sequence
  Description of Artificial Sequence: Synthetic oligonucleotide
  Target: DMPK; (-) strand; PAM type: YTN; PAM sequence: CTG
ctgctccctctctccaggcc

SEQ ID NO: 15562 - DNA, 20 bp, Artificial Sequence
  Description of Artificial Sequence: Synthetic oligonucleotide
  Target: DMPK; (-) strand; PAM type: YTN; PAM sequence: CTG
gcggctgctgctccctctct

SEQ ID NO: 15563 - DNA, 20 bp, Artificial Sequence
  Description of Artificial Sequence: Synthetic oligonucleotide
  Target: DMPK; (-) strand; PAM type: YTN; PAM sequence: CTG
ggctggcggctgctgctccc

SEQ ID NO: 15564 - DNA, 20 bp, Artificial Sequence
  Description of Artificial Sequence: Synthetic oligonucleotide
  Target: DMPK; (-) strand; PAM type: YTN; PAM sequence: CTG
acgccccgcggggagggcac

SEQ ID NO: 15565 - DNA, 20 bp, Artificial Sequence
  Description of Artificial Sequence: Synthetic oligonucleotide
  Target: DMPK; (-) strand; PAM type: YTN; PAM sequence: CTC
tgacgccccgcggggagggc

SEQ ID NO: 15566 - DNA, 20 bp, Artificial Sequence
  Description of Artificial Sequence: Synthetic oligonucleotide
  Target: DMPK; (-) strand; PAM type: YTN; PAM sequence: TTC
tctgacgccccgcggggagg

SEQ ID NO: 15567 - DNA, 20 bp, Artificial Sequence
  Description of Artificial Sequence: Synthetic oligonucleotide
  Target: DMPK; (-) strand; PAM type: YTN; PAM sequence: CTT
ctctgacgccccgcggggag

SEQ ID NO: 15568 - DNA, 20 bp, Artificial Sequence
  Description of Artificial Sequence: Synthetic oligonucleotide
  Target: DMPK; (-) strand; PAM type: YTN; PAM sequence: CTC
ccttctctgacgccccgcgg

SEQ ID NO: 15569 - DNA, 20 bp, Artificial Sequence
  Description of Artificial Sequence: Synthetic oligonucleotide
  Target: DMPK; (-) strand; PAM type: YTN; PAM sequence: CTC
tcccttctctgacgccccgc

SEQ ID NO: 15570 - DNA, 20 bp, Artificial Sequence
  Description of Artificial Sequence: Synthetic oligonucleotide
  Target: DMPK; (-) strand; PAM type: YTN; PAM sequence: CTG
agcgccggcctctcccttct

SEQ ID NO: 15571 - DNA, 20 bp, Artificial Sequence
  Description of Artificial Sequence: Synthetic oligonucleotide
  Target: DMPK; (-) strand; PAM type: YTN; PAM sequence: CTC
ccaccctgagcgccggcctc

SEQ ID NO: 15572 - DNA, 20 bp, Artificial Sequence
  Description of Artificial Sequence: Synthetic oligonucleotide
  Target: DMPK; (-) strand; PAM type: YTN; PAM sequence: CTC
ctcccaccctgagcgccggc

SEQ ID NO: 15573 - DNA, 20 bp, Artificial Sequence
  Description of Artificial Sequence: Synthetic oligonucleotide
  Target: DMPK; (-) strand; PAM type: YTN; PAM sequence: TTC
tcctcccaccctgagcgccg

SEQ ID NO: 15574 - DNA, 20 bp, Artificial Sequence
  Description of Artificial Sequence: Synthetic oligonucleotide
  Target: DMPK; (-) strand; PAM type: YTN; PAM sequence: CTT
ctcctcccaccctgagcgcc

SEQ ID NO: 15575 - DNA, 20 bp, Artificial Sequence
  Description of Artificial Sequence: Synthetic oligonucleotide
  Target: DMPK; (-) strand; PAM type: YTN; PAM sequence: CTG
taacccaaacccttctcctc

SEQ ID NO: 15576 - DNA, 20 bp, Artificial Sequence
  Description of Artificial Sequence: Synthetic oligonucleotide
  Target: DMPK; (-) strand; PAM type: YTN; PAM sequence: TTC
cctgtaacccaaacccttct

SEQ ID NO: 15577 - DNA, 20 bp, Artificial Sequence
  Description of Artificial Sequence: Synthetic oligonucleotide
  Target: DMPK; (-) strand; PAM type: YTN; PAM sequence: TTT
ccctgtaacccaaacccttc

SEQ ID NO: 15578 - DNA, 20 bp, Artificial Sequence
  Description of Artificial Sequence: Synthetic oligonucleotide
  Target: DMPK; (-) strand; PAM type: YTN; PAM sequence: CTC
cggtttccctgtaacccaaa

SEQ ID NO: 15579 - DNA, 20 bp, Artificial Sequence
  Description of Artificial Sequence: Synthetic oligonucleotide
  Target: DMPK; (-) strand; PAM type: YTN; PAM sequence: TTC
ccagctccggtttccctgta

SEQ ID NO: 15580 - DNA, 20 bp, Artificial Sequence
  Description of Artificial Sequence: Synthetic oligonucleotide
  Target: DMPK; (-) strand; PAM type: YTN; PAM sequence: TTT
cccagctccggtttccctgt

SEQ ID NO: 15581 - DNA, 20 bp, Artificial Sequence
  Description of Artificial Sequence: Synthetic oligonucleotide
  Target: DMPK; (-) strand; PAM type: YTN; PAM sequence: CTT
tcccagctccggtttccctg

SEQ ID NO: 15582 - DNA, 20 bp, Artificial Sequence
  Description of Artificial Sequence: Synthetic oligonucleotide
  Target: DMPK; (-) strand; PAM type: YTN; PAM sequence: TTG
tgaaacgtgaacctttccca

SEQ ID NO: 15583 - DNA, 20 bp, Artificial Sequence
  Description of Artificial Sequence: Synthetic oligonucleotide
  Target: DMPK; (-) strand; PAM type: YTN; PAM sequence: TTG
ttgtgaaacgtgaacctttc

SEQ ID NO: 15584 - DNA, 20 bp, Artificial Sequence
  Description of Artificial Sequence: Synthetic oligonucleotide
  Target: DMPK; (-) strand; PAM type: YTN; PAM sequence: TTT
gttgtgaaacgtgaaccttt

SEQ ID NO: 15585 - DNA, 20 bp, Artificial Sequence
  Description of Artificial Sequence: Synthetic oligonucleotide
  Target: DMPK; (-) strand; PAM type: YTN; PAM sequence: CTT
tgttgtgaaacgtgaacctt

SEQ ID NO: 15586 - DNA, 20 bp, Artificial Sequence
  Description of Artificial Sequence: Synthetic oligonucleotide
  Target: DMPK; (-) strand; PAM type: YTN; PAM sequence: CTG
cctttgttgtgaaacgtgaa

SEQ ID NO: 15587 - DNA, 20 bp, Artificial Sequence
  Description of Artificial Sequence: Synthetic oligonucleotide
  Target: DMPK; (-) strand; PAM type: YTN; PAM sequence: TTC
tgcctttgttgtgaaacgtg

SEQ ID NO: 15588 - DNA, 20 bp, Artificial Sequence
  Description of Artificial Sequence: Synthetic oligonucleotide
  Target: DMPK; (-) strand; PAM type: YTN; PAM sequence: CTT
ctgcctttgttgtgaaacgt

SEQ ID NO: 15589 - DNA, 20 bp, Artificial Sequence
  Description of Artificial Sequence: Synthetic oligonucleotide
  Target: DMPK; (-) strand; PAM type: YTN; PAM sequence: CTC
cgggcccggacggcgtggtc

SEQ ID NO: 15590 - DNA, 20 bp, Artificial Sequence
  Description of Artificial Sequence: Synthetic oligonucleotide
  Target: DMPK; (-) strand; PAM type: YTN; PAM sequence: CTC
cctccgggcccggacggcgt

SEQ ID NO: 15591 - DNA, 20 bp, Artificial Sequence
  Description of Artificial Sequence: Synthetic oligonucleotide
  Target: DMPK; (-) strand; PAM type: YTN; PAM sequence: TTA
cccacccgcccccacactcc

SEQ ID NO: 15592 - DNA, 20 bp, Artificial Sequence
  Description of Artificial Sequence: Synthetic oligonucleotide
  Target: DMPK; (-) strand; PAM type: YTN; PAM sequence: CTT
acccacccgcccccacactc

SEQ ID NO: 15593 - DNA, 20 bp, Artificial Sequence
  Description of Artificial Sequence: Synthetic oligonucleotide
  Target: DMPK; (-) strand; PAM type: YTN; PAM sequence: CTC
ttacccacccgcccccacac

SEQ ID NO: 15594 - DNA, 20 bp, Artificial Sequence
  Description of Artificial Sequence: Synthetic oligonucleotide
  Target: DMPK; (-) strand; PAM type: YTN; PAM sequence: TTA
ctcttacccacccgccccca

SEQ ID NO: 15595 - DNA, 20 bp, Artificial Sequence
  Description of Artificial Sequence: Synthetic oligonucleotide
  Target: DMPK; (-) strand; PAM type: YTN; PAM sequence: CTG
accgttactcttacccaccc

SEQ ID NO: 15596 - DNA, 20 bp, Artificial Sequence
  Description of Artificial Sequence: Synthetic oligonucleotide
  Target: DMPK; (-) strand; PAM type: YTN; PAM sequence: TTC
actgaccgttactcttaccc

SEQ ID NO: 15597 - DNA, 20 bp, Artificial Sequence
  Description of Artificial Sequence: Synthetic oligonucleotide
  Target: DMPK; (-) strand; PAM type: YTN; PAM sequence: CTT
cactgaccgttactcttacc

SEQ ID NO: 15598 - DNA, 20 bp, Artificial Sequence
  Description of Artificial Sequence: Synthetic oligonucleotide
  Target: DMPK; (-) strand; PAM type: YTN; PAM sequence: TTC
ttcactgaccgttactctta

SEQ ID NO: 15599 - DNA, 20 bp, Artificial Sequence
  Description of Artificial Sequence: Synthetic oligonucleotide
  Target: DMPK; (-) strand; PAM type: YTN; PAM sequence: TTT
cttcactgaccgttactctt

SEQ ID NO: 15600 - DNA, 20 bp, Artificial Sequence
  Description of Artificial Sequence: Synthetic oligonucleotide
  Target: DMPK; (-) strand; PAM type: YTN; PAM sequence: CTT
tcttcactgaccgttactct

SEQ ID NO: 15601 - DNA, 20 bp, Artificial Sequence
  Description of Artificial Sequence: Synthetic oligonucleotide
  Target: DMPK; (-) strand; PAM type: YTN; PAM sequence: CTC
ccagccccctttcttcactg

SEQ ID NO: 15602 - DNA, 20 bp, Artificial Sequence
  Description of Artificial Sequence: Synthetic oligonucleotide
  Target: DMPK; (-) strand; PAM type: YTN; PAM sequence: CTG
cctcccagccccctttcttc

SEQ ID NO: 15603 - DNA, 20 bp, Artificial Sequence
  Description of Artificial Sequence: Synthetic oligonucleotide
  Target: DMPK; (-) strand; PAM type: YTN; PAM sequence: CTC
cgcgtaggggctgcctccca

SEQ ID NO: 15604 - DNA, 20 bp, Artificial Sequence
  Description of Artificial Sequence: Synthetic oligonucleotide
  Target: DMPK; (-) strand; PAM type: YTN; PAM sequence: CTC
cactccgcgtaggggctgcc

SEQ ID NO: 15605 - DNA, 20 bp, Artificial Sequence
  Description of Artificial Sequence: Synthetic oligonucleotide
  Target: DMPK; (-) strand; PAM type: YTN; PAM sequence: CTG
tggccactccactccgcgta

SEQ ID NO: 15606 - DNA, 20 bp, Artificial Sequence
  Description of Artificial Sequence: Synthetic oligonucleotide
  Target: DMPK; (-) strand; PAM type: YTN; PAM sequence: CTG
aggaaaaaggacagggcctg

SEQ ID NO: 15607 - DNA, 20 bp, Artificial Sequence
  Description of Artificial Sequence: Synthetic oligonucleotide
  Target: DMPK; (-) strand; PAM type: YTN; PAM sequence: CTA
gagggactgaggaaaaagga

SEQ ID NO: 15608 - DNA, 20 bp, Artificial Sequence
  Description of Artificial Sequence: Synthetic oligonucleotide
  Target: DMPK; (-) strand; PAM type: YTN; PAM sequence: CTG
cggggggcactagagggact

SEQ ID NO: 15609 - DNA, 20 bp, Artificial Sequence
  Description of Artificial Sequence: Synthetic oligonucleotide
  Target: DMPK; (-) strand; PAM type: YTN; PAM sequence: TTG
gggaatcacactgcgggggg

SEQ ID NO: 15610 - DNA, 20 bp, Artificial Sequence
  Description of Artificial Sequence: Synthetic oligonucleotide
  Target: DMPK; (-) strand; PAM type: YTN; PAM sequence: TTC
ccaaatcccatcggtgttgg

SEQ ID NO: 15611 - DNA, 20 bp, Artificial Sequence
  Description of Artificial Sequence: Synthetic oligonucleotide
  Target: DMPK; (-) strand; PAM type: YTN; PAM sequence: CTT
cccaaatcccatcggtgttg

SEQ ID NO: 15612 - DNA, 20 bp, Artificial Sequence
  Description of Artificial Sequence: Synthetic oligonucleotide
  Target: DMPK; (-) strand; PAM type: YTN; PAM sequence: CTC
cttcccaaatcccatcggtg

SEQ ID NO: 15613 - DNA, 20 bp, Artificial Sequence
  Description of Artificial Sequence: Synthetic oligonucleotide
  Target: DMPK; (-) strand; PAM type: YTN; PAM sequence: TTC
cgagctccttcccaaatccc

SEQ ID NO: 15614 - DNA, 20 bp, Artificial Sequence
  Description of Artificial Sequence: Synthetic oligonucleotide
  Target: DMPK; (-) strand; PAM type: YTN; PAM sequence: CTC
cattccgagctccttcccaa

SEQ ID NO: 15615 - DNA, 20 bp, Artificial Sequence
  Description of Artificial Sequence: Synthetic oligonucleotide
  Target: DMPK; (-) strand; PAM type: YTN; PAM sequence: TTC
cagcggctccattccgagct

SEQ ID NO: 15616 - DNA, 20 bp, Artificial Sequence
  Description of Artificial Sequence: Synthetic oligonucleotide
  Target: DMPK; (-) strand; PAM type: YTN; PAM sequence: CTT
ccagcggctccattccgagc

SEQ ID NO: 15617 - DNA, 20 bp, Artificial Sequence
  Description of Artificial Sequence: Synthetic oligonucleotide
  Target: DMPK; (-) strand; PAM type: YTN; PAM sequence: CTC
ttccagcggctccattccga

SEQ ID NO: 15618 - DNA, 20 bp, Artificial Sequence
  Description of Artificial Sequence: Synthetic oligonucleotide
  Target: DMPK; (-) strand; PAM type: YTN; PAM sequence: CTC
ctcttccagcggctccattc

SEQ ID NO: 15619 - DNA, 20 bp, Artificial Sequence
  Description of Artificial Sequence: Synthetic oligonucleotide
  Target: DMPK; (-) strand; PAM type: YTN; PAM sequence: CTC
cccgcacgcgtctcctcttc

SEQ ID NO: 15620 - DNA, 20 bp, Artificial Sequence
  Description of Artificial Sequence: Synthetic oligonucleotide
  Target: DMPK; (-) strand; PAM type: YTN; PAM sequence: CTC
tccccgcacgcgtctcctct

SEQ ID NO: 15621 - DNA, 20 bp, Artificial Sequence
  Description of Artificial Sequence: Synthetic oligonucleotide
  Target: DMPK; (-) strand; PAM type: YTN; PAM sequence: CTA
agtgtggacgggacaggcac

SEQ ID NO: 15622 - DNA, 20 bp, Artificial Sequence
  Description of Artificial Sequence: Synthetic oligonucleotide
  Target: DMPK; (-) strand; PAM type: YTN; PAM sequence: CTC
aggcgcccgcggggcgcggg

SEQ ID NO: 15623 - DNA, 20 bp, Artificial Sequence
  Description of Artificial Sequence: Synthetic oligonucleotide
  Target: DMPK; (-) strand; PAM type: YTN; PAM sequence: CTC
acaatctcaggcgcccgcgg

SEQ ID NO: 15624 - DNA, 20 bp, Artificial Sequence
  Description of Artificial Sequence: Synthetic oligonucleotide
  Target: DMPK; (-) strand; PAM type: YTN; PAM sequence: CTC
ccgggaccagctcacaatct

SEQ ID NO: 15625 - DNA, 20 bp, Artificial Sequence
  Description of Artificial Sequence: Synthetic oligonucleotide
  Target: DMPK; (-) strand; PAM type: YTN; PAM sequence: CTC
ggacatctcccgggaccagc

SEQ ID NO: 15626 - DNA, 20 bp, Artificial Sequence
  Description of Artificial Sequence: Synthetic oligonucleotide
  Target: DMPK; (-) strand; PAM type: YTN; PAM sequence: CTG
gggccggcgcgccgaggtcc

SEQ ID NO: 15627 - DNA, 20 bp, Artificial Sequence
  Description of Artificial Sequence: Synthetic oligonucleotide
  Target: DMPK; (-) strand; PAM type: YTN; PAM sequence: CTG
ctggggccggcgcgccgagg

SEQ ID NO: 15628 - DNA, 20 bp, Artificial Sequence
  Description of Artificial Sequence: Synthetic oligonucleotide
  Target: DMPK; (-) strand; PAM type: YTN; PAM sequence: TTC
ccccgtgcccactgctgggg

SEQ ID NO: 15629 - DNA, 20 bp, Artificial Sequence
  Description of Artificial Sequence: Synthetic oligonucleotide
  Target: DMPK; (-) strand; PAM type: YTN; PAM sequence: CTT
cccccgtgcccactgctggg

SEQ ID NO: 15630 - DNA, 20 bp, Artificial Sequence
  Description of Artificial Sequence: Synthetic oligonucleotide
  Target: DMPK; (-) strand; PAM type: YTN; PAM sequence: CTC
ttcccccgtgcccactgctg

SEQ ID NO: 15631 - DNA, 20 bp, Artificial Sequence
  Description of Artificial Sequence: Synthetic oligonucleotide
  Target: DMPK; (-) strand; PAM type: YTN; PAM sequence: CTC
ccggggacatcccgtccacc

SEQ ID NO: 15632 - DNA, 20 bp, Artificial Sequence
  Description of Artificial Sequence: Synthetic oligonucleotide
  Target: DMPK; (-) strand; PAM type: YTN; PAM sequence: CTC
tcccggggacatcccgtcca

SEQ ID NO: 15633 - DNA, 20 bp, Artificial Sequence
  Description of Artificial Sequence: Synthetic oligonucleotide
  Target: DMPK; (-) strand; PAM type: YTN; PAM sequence: CTC
gggcggcgcaagtccagctc

SEQ ID NO: 15634 - DNA, 20 bp, Artificial Sequence
  Description of Artificial Sequence: Synthetic oligonucleotide
  Target: DMPK; (-) strand; PAM type: YTN; PAM sequence: CTG
caagaggtgaggggcctcgg

SEQ ID NO: 15635 - DNA, 20 bp, Artificial Sequence
  Description of Artificial Sequence: Synthetic oligonucleotide
  Target: DMPK; (-) strand; PAM type: YTN; PAM sequence: TTC
aagaaccggcgacagcgcga

SEQ ID NO: 15636 - DNA, 20 bp, Artificial Sequence
  Description of Artificial Sequence: Synthetic oligonucleotide
  Target: DMPK; (-) strand; PAM type: YTN; PAM sequence: CTG
gttcaagaaccggcgacagc

SEQ ID NO: 15637 - DNA, 20 bp, Artificial Sequence
  Description of Artificial Sequence: Synthetic oligonucleotide
  Target: DMPK; (-) strand; PAM type: YTN; PAM sequence: CTC
acgcaggtcagcaactggtt

SEQ ID NO: 15638 - DNA, 20 bp, Artificial Sequence
  Description of Artificial Sequence: Synthetic oligonucleotide
  Target: DMPK; (-) strand; PAM type: YTN; PAM sequence: CTG
tcgctcacgcaggtcagcaa

SEQ ID NO: 15639 - DNA, 20 bp, Artificial Sequence
  Description of Artificial Sequence: Synthetic oligonucleotide
  Target: DMPK; (-) strand; PAM type: YTN; PAM sequence: CTC
accggcctgtcgctcacgca

SEQ ID NO: 15640 - DNA, 20 bp, Artificial Sequence
  Description of Artificial Sequence: Synthetic oligonucleotide
  Target: DMPK; (-) strand; PAM type: YTN; PAM sequence: CTG
gccacactcaccggcctgtc

SEQ ID NO: 15641 - DNA, 20 bp, Artificial Sequence
  Description of Artificial Sequence: Synthetic oligonucleotide
  Target: DMPK; (-) strand; PAM type: YTN; PAM sequence: CTA
ccccacgccggacgagaagc

SEQ ID NO: 15642 - DNA, 20 bp, Artificial Sequence
  Description of Artificial Sequence: Synthetic oligonucleotide
  Target: DMPK; (-) strand; PAM type: YTN; PAM sequence: CTA
ccgcggcaaccgctacccca

SEQ ID NO: 15643 - DNA, 20 bp, Artificial Sequence
  Description of Artificial Sequence: Synthetic oligonucleotide
  Target: DMPK; (-) strand; PAM type: YTN; PAM sequence: CTG
ctaccgcggcaaccgctacc

SEQ ID NO: 15644 - DNA, 20 bp, Artificial Sequence
  Description of Artificial Sequence: Synthetic oligonucleotide
  Target: DMPK; (-) strand; PAM type: YTN; PAM sequence: CTC
aaggcctgctaccgcggcaa

SEQ ID NO: 15645 - DNA, 20 bp, Artificial Sequence
  Description of Artificial Sequence: Synthetic oligonucleotide
  Target: DMPK; (-) strand; PAM type: YTN; PAM sequence: CTC
ccgcgcagcgctcaaggcct

SEQ ID NO: 15646 - DNA, 20 bp, Artificial Sequence
  Description of Artificial Sequence: Synthetic oligonucleotide
  Target: DMPK; (-) strand; PAM type: YTN; PAM sequence: TTC
aaggagcgctcccgcgcagc

SEQ ID NO: 15647 - DNA, 20 bp, Artificial Sequence
  Description of Artificial Sequence: Synthetic oligonucleotide
  Target: DMPK; (-) strand; PAM type: YTN; PAM sequence: CTT
caaggagcgctcccgcgcag

SEQ ID NO: 15648 - DNA, 20 bp, Artificial Sequence
  Description of Artificial Sequence: Synthetic oligonucleotide
  Target: DMPK; (-) strand; PAM type: YTN; PAM sequence: CTG
cttcaaggagcgctcccgcg

SEQ ID NO: 15649 - DNA, 20 bp, Artificial Sequence
  Description of Artificial Sequence: Synthetic oligonucleotide
  Target: DMPK; (-) strand; PAM type: YTN; PAM sequence: CTA
ctgcttcaaggagcgctccc

SEQ ID NO: 15650 - DNA, 20 bp, Artificial Sequence
  Description of Artificial Sequence: Synthetic oligonucleotide
  Target: DMPK; (-) strand; PAM type: YTN; PAM sequence: CTG
ggacggcgaggagacagtct

SEQ ID NO: 15651 - DNA, 20 bp, Artificial Sequence
  Description of Artificial Sequence: Synthetic oligonucleotide
  Target: DMPK; (-) strand; PAM type: YTN; PAM sequence: CTG
cccaagaccatctgggacgg

SEQ ID NO: 15652 - DNA, 20 bp, Artificial Sequence
  Description of Artificial Sequence: Synthetic oligonucleotide
  Target: DMPK; (-) strand; PAM type: YTN; PAM sequence: TTC
ccgctgcccaagaccatctg

SEQ ID NO: 15653 - DNA, 20 bp, Artificial Sequence
  Description of Artificial Sequence: Synthetic oligonucleotide
  Target: DMPK; (-) strand; PAM type: YTN; PAM sequence: CTG
cgcaagaagttcccgctgcc

SEQ ID NO: 15654 - DNA, 20 bp, Artificial Sequence
  Description of Artificial Sequence: Synthetic oligonucleotide
  Target: DMPK; (-) strand; PAM type: YTN; PAM sequence: TTG
gcgcagtggacaagtatcga

SEQ ID NO: 15655 - DNA, 20 bp, Artificial Sequence
  Description of Artificial Sequence: Synthetic oligonucleotide
  Target: DMPK; (-) strand; PAM type: YTN; PAM sequence: CTT
ggcgcagtggacaagtatcg

SEQ ID NO: 15656 - DNA, 20 bp, Artificial Sequence
  Description of Artificial Sequence: Synthetic oligonucleotide
  Target: DMPK; (-) strand; PAM type: YTN; PAM sequence: CTA
ccatgaggccgagcgggccc

SEQ ID NO: 15657 - DNA, 20 bp, Artificial Sequence
  Description of Artificial Sequence: Synthetic oligonucleotide
  Target: DMPK; (-) strand; PAM type: YTN; PAM sequence: CTG
cgcgcgcgctaccatgaggc

SEQ ID NO: 15658 - DNA, 20 bp, Artificial Sequence
  Description of Artificial Sequence: Synthetic oligonucleotide
  Target: DMPK; (-) strand; PAM type: YTN; PAM sequence: CTA
cctgcgcgcgcgctaccatg

SEQ ID NO: 15659 - DNA, 20 bp, Artificial Sequence
  Description of Artificial Sequence: Synthetic oligonucleotide
  Target: DMPK; (-) strand; PAM type: YTN; PAM sequence: CTC
tacctgcgcgcgcgctacca

SEQ ID NO: 15660 - DNA, 20 bp, Artificial Sequence
  Description of Artificial Sequence: Synthetic oligonucleotide
  Target: DMPK; (-) strand; PAM type: YTN; PAM sequence: CTG
caggacctctacctgcgcgc

SEQ ID NO: 15661 - DNA, 20 bp, Artificial Sequence
  Description of Artificial Sequence: Synthetic oligonucleotide
  Target: DMPK; (-) strand; PAM type: YTN; PAM sequence: TTC
ctgcaggacctctacctgcg

SEQ ID NO: 15662 - DNA, 20 bp, Artificial Sequence
  Description of Artificial Sequence: Synthetic oligonucleotide
  Target: DMPK; (-) strand; PAM type: YTN; PAM sequence: CTT
cctgcaggacctctacctgc

SEQ ID NO: 15663 - DNA, 20 bp, Artificial Sequence
  Description of Artificial Sequence: Synthetic oligonucleotide
  Target: DMPK; (-) strand; PAM type: YTN; PAM sequence: TTC
cccgccgcccaccacgcctt

SEQ ID NO: 15664 - DNA, 20 bp, Artificial Sequence
  Description of Artificial Sequence: Synthetic oligonucleotide
  Target: DMPK; (-) strand; PAM type: YTN; PAM sequence: CTT
ccccgccgcccaccacgcct

SEQ ID NO: 15665 - DNA, 20 bp, Artificial Sequence
  Description of Artificial Sequence: Synthetic oligonucleotide
  Target: DMPK; (-) strand; PAM type: YTN; PAM sequence: CTC
gagagccgccccttccccgc

SEQ ID NO: 15666 - DNA, 20 bp, Artificial Sequence
  Description of Artificial Sequence: Synthetic oligonucleotide
  Target: DMPK; (-) strand; PAM type: YTN; PAM sequence: CTA
ctcgagagccgccccttccc

SEQ ID NO: 15667 - DNA, 20 bp, Artificial Sequence
  Description of Artificial Sequence: Synthetic oligonucleotide
  Target: DMPK; (-) strand; PAM type: YTN; PAM sequence: CTA
ccggctactcgagagccgcc

SEQ ID NO: 15668 - DNA, 20 bp, Artificial Sequence
  Description of Artificial Sequence: Synthetic oligonucleotide
  Target: DMPK; (-) strand; PAM type: YTN; PAM sequence: CTC
taccggctactcgagagccg

SEQ ID NO: 15669 - DNA, 20 bp, Artificial Sequence
  Description of Artificial Sequence: Synthetic oligonucleotide
  Target: DMPK; (-) strand; PAM type: YTN; PAM sequence: TTC
cagcggggcgagtacgccga

SEQ ID NO: 15670 - DNA, 20 bp, Artificial Sequence
  Description of Artificial Sequence: Synthetic oligonucleotide
  Target: DMPK; (-) strand; PAM type: YTN; PAM sequence: CTT
ccagcggggcgagtacgccg

SEQ ID NO: 15671 - DNA, 20 bp, Artificial Sequence
  Description of Artificial Sequence: Synthetic oligonucleotide
  Target: DMPK; (-) strand; PAM type: YTN; PAM sequence: CTG
gtggccttccagcggggcga

SEQ ID NO: 15672 - DNA, 20 bp, Artificial Sequence
  Description of Artificial Sequence: Synthetic oligonucleotide
  Target: DMPK; (-) strand; PAM type: YTN; PAM sequence: TTG
cgcgcgcgggccctggtggc

SEQ ID NO: 15673 - DNA, 20 bp, Artificial Sequence
  Description of Artificial Sequence: Synthetic oligonucleotide
  Target: DMPK; (-) strand; PAM type: YTN; PAM sequence: CTA
cgtggcagcgacccggtgtt

SEQ ID NO: 15674 - DNA, 20 bp, Artificial Sequence
  Description of Artificial Sequence: Synthetic oligonucleotide
  Target: DMPK; (-) strand; PAM type: YTN; PAM sequence: CTG
cccccggccgagcgcctacg

SEQ ID NO: 15675 - DNA, 20 bp, Artificial Sequence
  Description of Artificial Sequence: Synthetic oligonucleotide
  Target: DMPK; (-) strand; PAM type: YTN; PAM sequence: CTG
ggcgcactgcccccggccga

SEQ ID NO: 15676 - DNA, 20 bp, Artificial Sequence
  Description of Artificial Sequence: Synthetic oligonucleotide
  Target: DMPK; (-) strand; PAM type: YTN; PAM sequence: TTC
ctgggcgcactgcccccggc

SEQ ID NO: 15677 - DNA, 20 bp, Artificial Sequence
  Description of Artificial Sequence: Synthetic oligonucleotide
  Target: DMPK; (-) strand; PAM type: YTN; PAM sequence: CTT
cctgggcgcactgcccccgg

SEQ ID NO: 15678 - DNA, 20 bp, Artificial Sequence
  Description of Artificial Sequence: Synthetic oligonucleotide
  Target: DMPK; (-) strand; PAM type: YTN; PAM sequence: TTG
agccgcttcctgggcgcact

SEQ ID NO: 15679 - DNA, 20 bp, Artificial Sequence
  Description of Artificial Sequence: Synthetic oligonucleotide
  Target: DMPK; (-) strand; PAM type: YTN; PAM sequence: CTT
gagccgcttcctgggcgcac

SEQ ID NO: 15680 - DNA, 20 bp, Artificial Sequence
  Description of Artificial Sequence: Synthetic oligonucleotide
  Target: DMPK; (-) strand; PAM type: YTN; PAM sequence: CTC
caggcgggccacgccggccg

SEQ ID NO: 15681 - DNA, 20 bp, Artificial Sequence
  Description of Artificial Sequence: Synthetic oligonucleotide
  Target: DMPK; (-) strand; PAM type: YTN; PAM sequence: CTG
ctccaggcgggccacgccgg

SEQ ID NO: 15682 - DNA, 20 bp, Artificial Sequence
  Description of Artificial Sequence: Synthetic oligonucleotide
  Target: DMPK; (-) strand; PAM type: YTN; PAM sequence: CTG
cgaggcgctgctccaggcgg

SEQ ID NO: 15683 - DNA, 20 bp, Artificial Sequence
  Description of Artificial Sequence: Synthetic oligonucleotide
  Target: DMPK; (-) strand; PAM type: YTN; PAM sequence: CTC
gcccgagcaggtggcgtgcg

SEQ ID NO: 15684 - DNA, 20 bp, Artificial Sequence
  Description of Artificial Sequence: Synthetic oligonucleotide
  Target: DMPK; (-) strand; PAM type: YTN; PAM sequence: TTC
tcgcccgagcaggtggcgtg

SEQ ID NO: 15685 - DNA, 20 bp, Artificial Sequence
  Description of Artificial Sequence: Synthetic oligonucleotide
  Target: DMPK; (-) strand; PAM type: YTN; PAM sequence: CTT
ctcgcccgagcaggtggcgt

SEQ ID NO: 15686 - DNA, 20 bp, Artificial Sequence
  Description of Artificial Sequence: Synthetic oligonucleotide
  Target: DMPK; (-) strand; PAM type: YTN; PAM sequence: CTC
cgcttctcgcccgagcaggt

SEQ ID NO: 15687 - DNA, 20 bp, Artificial Sequence
  Description of Artificial Sequence: Synthetic oligonucleotide
  Target: DMPK; (-) strand; PAM type: YTN; PAM sequence: TTC
cgaaccgcccacgggcctcc

SEQ ID NO: 15688 - DNA, 20 bp, Artificial Sequence
  Description of Artificial Sequence: Synthetic oligonucleotide
  Target: DMPK; (-) strand; PAM type: YTN; PAM sequence: CTT
ccgaaccgcccacgggcctc

SEQ ID NO: 15689 - DNA, 20 bp, Artificial Sequence
  Description of Artificial Sequence: Synthetic oligonucleotide
  Target: DMPK; (-) strand; PAM type: YTN; PAM sequence: CTG
agggcccgggatccccgggc

SEQ ID NO: 15690 - DNA, 20 bp, Artificial Sequence
  Description of Artificial Sequence: Synthetic oligonucleotide
  Target: DMPK; (-) strand; PAM type: YTN; PAM sequence: CTG
cgggagctgagggcccggga

SEQ ID NO: 15691 - DNA, 20 bp, Artificial Sequence
  Description of Artificial Sequence: Synthetic oligonucleotide
  Target: DMPK; (-) strand; PAM type: YTN; PAM sequence: TTG
caggcggccgagggtgaggc

SEQ ID NO: 15692 - DNA, 20 bp, Artificial Sequence
  Description of Artificial Sequence: Synthetic oligonucleotide
  Target: DMPK; (-) strand; PAM type: YTN; PAM sequence: TTT
gcaggcggccgagggtgagg

SEQ ID NO: 15693 - DNA, 20 bp, Artificial Sequence
  Description of Artificial Sequence: Synthetic oligonucleotide
  Target: DMPK; (-) strand; PAM type: YTN; PAM sequence: CTT
tgcaggcggccgagggtgag

SEQ ID NO: 15694 - DNA, 20 bp, Artificial Sequence
  Description of Artificial Sequence: Synthetic oligonucleotide
  Target: DMPK; (-) strand; PAM type: YTN; PAM sequence: TTG
cagactttgcaggcggccga

SEQ ID NO: 15695 - DNA, 20 bp, Artificial Sequence
  Description of Artificial Sequence: Synthetic oligonucleotide
  Target: DMPK; (-) strand; PAM type: YTN; PAM sequence: CTT
gcagactttgcaggcggccg

SEQ ID NO: 15696 - DNA, 20 bp, Artificial Sequence
  Description of Artificial Sequence: Synthetic oligonucleotide
  Target: DMPK; (-) strand; PAM type: YTN; PAM sequence: CTC
ttgcagactttgcaggcggc

SEQ ID NO: 15697 - DNA, 20 bp, Artificial Sequence
  Description of Artificial Sequence: Synthetic oligonucleotide
  Target: DMPK; (-) strand; PAM type: YTN; PAM sequence: CTG
ggggggaggcggtggcggcg

SEQ ID NO: 15698 - DNA, 20 bp, Artificial Sequence
  Description of Artificial Sequence: Synthetic oligonucleotide
  Target: DMPK; (-) strand; PAM type: YTN; PAM sequence: CTG
cggagccgagcgcggggccg

SEQ ID NO: 15699 - DNA, 20 bp, Artificial Sequence
  Description of Artificial Sequence: Synthetic oligonucleotide
  Target: DMPK; (-) strand; PAM type: YTN; PAM sequence: TTG
cctgcggagccgagcgcggg

SEQ ID NO: 15700 - DNA, 20 bp, Artificial Sequence
  Description of Artificial Sequence: Synthetic oligonucleotide
  Target: DMPK; (-) strand; PAM type: YTN; PAM sequence: CTT
gcctgcggagccgagcgcgg

SEQ ID NO: 15701 - DNA, 20 bp, Artificial Sequence
  Description of Artificial Sequence: Synthetic oligonucleotide
  Target: DMPK; (-) strand; PAM type: YTN; PAM sequence: CTA
ccttgcctgcggagccgagc

SEQ ID NO: 15702 - DNA, 20 bp, Artificial Sequence
  Description of Artificial Sequence: Synthetic oligonucleotide
  Target: DMPK; (-) strand; PAM type: YTN; PAM sequence: TTG
caaaacatggctaccttgcc

SEQ ID NO: 15703 - DNA, 20 bp, Artificial Sequence
  Description of Artificial Sequence: Synthetic oligonucleotide
  Target: DMPK; (-) strand; PAM type: YTN; PAM sequence: TTC
ccaaagttgcaaaacatggc

SEQ ID NO: 15704 - DNA, 20 bp, Artificial Sequence
  Description of Artificial Sequence: Synthetic oligonucleotide
  Target: DMPK; (-) strand; PAM type: YTN; PAM sequence: CTT
cccaaagttgcaaaacatgg

SEQ ID NO: 15705 - DNA, 20 bp, Artificial Sequence
  Description of Artificial Sequence: Synthetic oligonucleotide
  Target: DMPK; (-) strand; PAM type: YTN; PAM sequence: CTG
gggaaagcccgagggaggaa

SEQ ID NO: 15706 - DNA, 20 bp, Artificial Sequence
  Description of Artificial Sequence: Synthetic oligonucleotide
  Target: DMPK; (-) strand; PAM type: YTN; PAM sequence: TTC
ccggcgtggggcgcagggtc

SEQ ID NO: 15707 - DNA, 20 bp, Artificial Sequence
  Description of Artificial Sequence: Synthetic oligonucleotide
  Target: DMPK; (-) strand; PAM type: YTN; PAM sequence: CTT
cccggcgtggggcgcagggt

SEQ ID NO: 15708 - DNA, 20 bp, Artificial Sequence
  Description of Artificial Sequence: Synthetic oligonucleotide
  Target: DMPK; (-) strand; PAM type: YTN; PAM sequence: CTC
gccttcccggcgtggggcgc

SEQ ID NO: 15709 - DNA, 20 bp, Artificial Sequence
  Description of Artificial Sequence: Synthetic oligonucleotide
  Target: DMPK; (-) strand; PAM type: YTN; PAM sequence: CTG
gatctcgccttcccggcgtg

SEQ ID NO: 15710 - DNA, 20 bp, Artificial Sequence
  Description of Artificial Sequence: Synthetic oligonucleotide
  Target: DMPK; (-) strand; PAM type: YTN; PAM sequence: CTG
gggggaggcagaaagcgcgg

SEQ ID NO: 15711 - DNA, 20 bp, Artificial Sequence
  Description of Artificial Sequence: Synthetic oligonucleotide
  Target: DMPK; (-) strand; PAM type: YTN; PAM sequence: CTG
agccagaagcacacgctggg

SEQ ID NO: 15712 - DNA, 20 bp, Artificial Sequence
  Description of Artificial Sequence: Synthetic oligonucleotide
  Target: DMPK; (-) strand; PAM type: YTN; PAM sequence: CTG
aggccctgagccagaagcac

SEQ ID NO: 15713 - DNA, 20 bp, Artificial Sequence
  Description of Artificial Sequence: Synthetic oligonucleotide
  Target: DMPK; (-) strand; PAM type: YTN; PAM sequence: TTG
tcccgatggggaaactgagg

SEQ ID NO: 15714 - DNA, 20 bp, Artificial Sequence
  Description of Artificial Sequence: Synthetic oligonucleotide
  Target: DMPK; (-) strand; PAM type: YTN; PAM sequence: CTG
cgttgtcccgatggggaaac

SEQ ID NO: 15715 - DNA, 20 bp, Artificial Sequence
  Description of Artificial Sequence: Synthetic oligonucleotide
  Target: DMPK; (-) strand; PAM type: YTN; PAM sequence: TTC
tgcgttgtcccgatggggaa

SEQ ID NO: 15716 - DNA, 20 bp, Artificial Sequence
  Description of Artificial Sequence: Synthetic oligonucleotide
  Target: DMPK; (-) strand; PAM type: YTN; PAM sequence: CTT
ctgcgttgtcccgatgggga

SEQ ID NO: 15717 - DNA, 20 bp, Artificial Sequence
  Description of Artificial Sequence: Synthetic oligonucleotide
  Target: DMPK; (-) strand; PAM type: YTN; PAM sequence: TTA
ccttctgcgttgtcccgatg

SEQ ID NO: 15718 - DNA, 20 bp, Artificial Sequence
  Description of Artificial Sequence: Synthetic oligonucleotide
  Target: DMPK; (-) strand; PAM type: YTN; PAM sequence: CTG
gacggcccgttaccttctgc

SEQ ID NO: 15719 - DNA, 20 bp, Artificial Sequence
  Description of Artificial Sequence: Synthetic oligonucleotide
  Target: DMPK; (-) strand; PAM type: YTN; PAM sequence: CTC
ctggacggcccgttaccttc

SEQ ID NO: 15720 - DNA, 20 bp, Artificial Sequence
  Description of Artificial Sequence: Synthetic oligonucleotide
  Target: DMPK; (-) strand; PAM type: YTN; PAM sequence: TTA
gtcctcctggacggcccgtt

SEQ ID NO: 15721 - DNA, 20 bp, Artificial Sequence
  Description of Artificial Sequence: Synthetic oligonucleotide
  Target: DMPK; (-) strand; PAM type: YTN; PAM sequence: CTT
agtcctcctggacggcccgt

SEQ ID NO: 15722 - DNA, 20 bp, Artificial Sequence
  Description of Artificial Sequence: Synthetic oligonucleotide
  Target: DMPK; (-) strand; PAM type: YTN; PAM sequence: TTC
gcgcccttagtcctcctgga

SEQ ID NO: 15723 - DNA, 20 bp, Artificial Sequence
  Description of Artificial Sequence: Synthetic oligonucleotide
  Target: DMPK; (-) strand; PAM type: YTN; PAM sequence: CTT
cgcgcccttagtcctcctgg

SEQ ID NO: 15724 - DNA, 20 bp, Artificial Sequence
  Description of Artificial Sequence: Synthetic oligonucleotide
  Target: DMPK; (-) strand; PAM type: YTN; PAM sequence: CTC
ggggcggaggcttcgcgccc

SEQ ID NO: 15725 - DNA, 20 bp, Artificial Sequence
  Description of Artificial Sequence: Synthetic oligonucleotide
  Target: DMPK; (-) strand; PAM type: YTN; PAM sequence: CTC
agtctcggggcggaggcttc

SEQ ID NO: 15726 - DNA, 20 bp, Artificial Sequence
  Description of Artificial Sequence: Synthetic oligonucleotide
  Target: DMPK; (-) strand; PAM type: YTN; PAM sequence: CTG
gagacggaggcgtgcagaag

SEQ ID NO: 15727 - DNA, 20 bp, Artificial Sequence
  Description of Artificial Sequence: Synthetic oligonucleotide
  Target: DMPK; (-) strand; PAM type: YTN; PAM sequence: CTG
cagaggaccctggagacgga

SEQ ID NO: 15728 - DNA, 20 bp, Artificial Sequence
  Description of Artificial Sequence: Synthetic oligonucleotide
  Target: DMPK; (-) strand; PAM type: YTN; PAM sequence: TTC
cgaggggcggagcgcaggcc

SEQ ID NO: 15729 - DNA, 20 bp, Artificial Sequence
  Description of Artificial Sequence: Synthetic oligonucleotide
  Target: DMPK; (-) strand; PAM type: YTN; PAM sequence: CTG
cggagccgggaattccgagg

SEQ ID NO: 15730 - DNA, 20 bp, Artificial Sequence
  Description of Artificial Sequence: Synthetic oligonucleotide
  Target: DMPK; (-) strand; PAM type: YTN; PAM sequence: CTC
ccggccagacccgccccccc

SEQ ID NO: 15731 - DNA, 20 bp, Artificial Sequence
  Description of Artificial Sequence: Synthetic oligonucleotide
  Target: DMPK; (-) strand; PAM type: YTN; PAM sequence: CTC
ctcccggccagacccgcccc

SEQ ID NO: 15732 - DNA, 20 bp, Artificial Sequence
  Description of Artificial Sequence: Synthetic oligonucleotide
  Target: DMPK; (-) strand; PAM type: YTN; PAM sequence: TTC
cccgcccctcctcccggcca

SEQ ID NO: 15733 - DNA, 20 bp, Artificial Sequence
  Description of Artificial Sequence: Synthetic oligonucleotide
  Target: DMPK; (-) strand; PAM type: YTN; PAM sequence: CTA
gcccgttccccgcccctcct

SEQ ID NO: 15734 - DNA, 20 bp, Artificial Sequence
  Description of Artificial Sequence: Synthetic oligonucleotide
  Target: DMPK; (-) strand; PAM type: YTN; PAM sequence: TTC
tagcccgttccccgcccctc

SEQ ID NO: 15735 - DNA, 20 bp, Artificial Sequence
  Description of Artificial Sequence: Synthetic oligonucleotide
  Target: DMPK; (-) strand; PAM type: YTN; PAM sequence: TTT
ctagcccgttccccgcccct

SEQ ID NO: 15736 - DNA, 20 bp, Artificial Sequence
  Description of Artificial Sequence: Synthetic oligonucleotide
  Target: DMPK; (-) strand; PAM type: YTN; PAM sequence: CTT
tctagcccgttccccgcccc

SEQ ID NO: 15737 - DNA, 20 bp, Artificial Sequence
  Description of Artificial Sequence: Synthetic oligonucleotide
  Target: DMPK; (-) strand; PAM type: YTN; PAM sequence: CTG
caaactttctagcccgttcc

SEQ ID NO: 15738 - DNA, 20 bp, Artificial Sequence
  Description of Artificial Sequence: Synthetic oligonucleotide
  Target: DMPK; (-) strand; PAM type: YTN; PAM sequence: TTG
ctgcaaactttctagcccgt

SEQ ID NO: 15739 - DNA, 20 bp, Artificial Sequence
  Description of Artificial Sequence: Synthetic oligonucleotide
  Target: DMPK; (-) strand; PAM type: YTN; PAM sequence: CTC
gagaaaagttgctgcaaact

SEQ ID NO: 15740 - DNA, 20 bp, Artificial Sequence
  Description of Artificial Sequence: Synthetic oligonucleotide
  Target: DMPK; (-) strand; PAM type: YTN; PAM sequence: CTG
ggacgcaagctcgagaaaag

SEQ ID NO: 15741 - DNA, 20 bp, Artificial Sequence
  Description of Artificial Sequence: Synthetic oligonucleotide
  Target: DMPK; (-) strand; PAM type: YTN; PAM sequence: CTC
ctgggacgcaagctcgagaa

SEQ ID NO: 15742 - DNA, 20 bp, Artificial Sequence
  Description of Artificial Sequence: Synthetic oligonucleotide
  Target: DMPK; (-) strand; PAM type: YTN; PAM sequence: CTG
cgcacgccacgcgcatccgc

SEQ ID NO: 15743 - DNA, 20 bp, Artificial Sequence
  Description of Artificial Sequence: Synthetic oligonucleotide
  Target: DMPK; (-) strand; PAM type: YTN; PAM sequence: CTG
cgcctgcgcacgccacgcgc

SEQ ID NO: 15744 - DNA, 20 bp, Artificial Sequence
  Description of Artificial Sequence: Synthetic oligonucleotide
  Target: DMPK; (-) strand; PAM type: YTN; PAM sequence: TTC
cactgcgcctgcgcacgcca

SEQ ID NO: 15745 - DNA, 20 bp, Artificial Sequence
  Description of Artificial Sequence: Synthetic oligonucleotide
  Target: DMPK; (-) strand; PAM type: YTN; PAM sequence: CTT
ccactgcgcctgcgcacgcc

SEQ ID NO: 15746 - DNA, 20 bp, Artificial Sequence
  Description of Artificial Sequence: Synthetic oligonucleotide
  Target: DMPK; (-) strand; PAM type: YTN; PAM sequence: CTC
cttccactgcgcctgcgcac

SEQ ID NO: 15747 - DNA, 20 bp, Artificial Sequence
  Description of Artificial Sequence: Synthetic oligonucleotide
  Target: DMPK; (-) strand; PAM type: YTN; PAM sequence: CTG
gcagcgcgcgcggccatcct

SEQ ID NO: 15748 - DNA, 20 bp, Artificial Sequence
  Description of Artificial Sequence: Synthetic oligonucleotide
  Target: DMPK; (-) strand; PAM type: YTN; PAM sequence: CTG
ggctggcagcgcgcgcggcc

SEQ ID NO: 15749 - DNA, 20 bp, Artificial Sequence
  Description of Artificial Sequence: Synthetic oligonucleotide
  Target: DMPK; (-) strand; PAM type: YTN; PAM sequence: CTG
tgccaccgagcgtcgagaag

SEQ ID NO: 15750 - DNA, 20 bp, Artificial Sequence
  Description of Artificial Sequence: Synthetic oligonucleotide
  Target: DMPK; (-) strand; PAM type: YTN; PAM sequence: CTG
tggcccagctgtgccaccga

SEQ ID NO: 15751 - DNA, 20 bp, Artificial Sequence
  Description of Artificial Sequence: Synthetic oligonucleotide
  Target: DMPK; (-) strand; PAM type: YTN; PAM sequence: TTG
gcgtccggccaataggaggg

SEQ ID NO: 15752 - DNA, 20 bp, Artificial Sequence
  Description of Artificial Sequence: Synthetic oligonucleotide
  Target: DMPK; (-) strand; PAM type: YTN; PAM sequence: TTT
ggcgtccggccaataggagg

SEQ ID NO: 15753 - DNA, 20 bp, Artificial Sequence
  Description of Artificial Sequence: Synthetic oligonucleotide
  Target: DMPK; (-) strand; PAM type: YTN; PAM sequence: CTT
tggcgtccggccaataggag

SEQ ID NO: 15754 - DNA, 20 bp, Artificial Sequence
  Description of Artificial Sequence: Synthetic oligonucleotide
  Target: DMPK; (-) strand; PAM type: YTN; PAM sequence: TTG
ggggaggaaaagccacgggg

SEQ ID NO: 15755 - DNA, 20 bp, Artificial Sequence
  Description of Artificial Sequence: Synthetic oligonucleotide
  Target: DMPK; (-) strand; PAM type: YTN; PAM sequence: CTA
gcgggatgcgaagcggccga

SEQ ID NO: 15756 - DNA, 20 bp, Artificial Sequence
  Description of Artificial Sequence: Synthetic oligonucleotide
  Target: DMPK; (-) strand; PAM type: YTN; PAM sequence: CTG
ggaggagctagcgggatgcg

SEQ ID NO: 15757 - DNA, 20 bp, Artificial Sequence
  Description of Artificial Sequence: Synthetic oligonucleotide
  Target: DMPK; (-) strand; PAM type: YTN; PAM sequence: CTC
cgcagcgggccaatccggag

SEQ ID NO: 15758 - DNA, 20 bp, Artificial Sequence
  Description of Artificial Sequence: Synthetic oligonucleotide
  Target: DMPK; (-) strand; PAM type: YTN; PAM sequence: TTG
tgggccggaggctccgcagc

SEQ ID NO: 15759 - DNA, 20 bp, Artificial Sequence
  Description of Artificial Sequence: Synthetic oligonucleotide
  Target: DMPK; (-) strand; PAM type: YTN; PAM sequence: TTG
cgttgtgggccggaggctcc

SEQ ID NO: 15760 - DNA, 20 bp, Artificial Sequence
  Description of Artificial Sequence: Synthetic oligonucleotide
  Target: DMPK; (-) strand; PAM type: YTN; PAM sequence: TTT
gcgttgtgggccggaggctc

SEQ ID NO: 15761 - DNA, 20 bp, Artificial Sequence
  Description of Artificial Sequence: Synthetic oligonucleotide
  Target: DMPK; (-) strand; PAM type: YTN; PAM sequence: CTC
cacagtgtccgcggtttgcg

SEQ ID NO: 15762 - DNA, 20 bp, Artificial Sequence
  Description of Artificial Sequence: Synthetic oligonucleotide
  Target: DMPK; (-) strand; PAM type: YTN; PAM sequence: CTG
gactccacagtgtccgcggt

SEQ ID NO: 15763 - DNA, 20 bp, Artificial Sequence
  Description of Artificial Sequence: Synthetic oligonucleotide
  Target: DMPK; (-) strand; PAM type: YTN; PAM sequence: CTC
tggactccacagtgtccgcg

SEQ ID NO: 15764 - DNA, 20 bp, Artificial Sequence
  Description of Artificial Sequence: Synthetic oligonucleotide
  Target: DMPK; (-) strand; PAM type: YTN; PAM sequence: CTG
cccaaagctctggactccac

SEQ ID NO: 15765 - DNA, 20 bp, Artificial Sequence
  Description of Artificial Sequence: Synthetic oligonucleotide
  Target: DMPK; (-) strand; PAM type: YTN; PAM sequence: CTC
catctgcccaaagctctgga

SEQ ID NO: 15766 - DNA, 20 bp, Artificial Sequence
  Description of Artificial Sequence: Synthetic oligonucleotide
  Target: DMPK; (-) strand; PAM type: YTN; PAM sequence: CTC
gcgaataaaaggccctccat

SEQ ID NO: 15767 - DNA, 20 bp, Artificial Sequence
  Description of Artificial Sequence: Synthetic oligonucleotide
  Target: DMPK; (-) strand; PAM type: YTN; PAM sequence: CTA
ggacccccacccccgaccct

SEQ ID NO: 15768 - DNA, 20 bp, Artificial Sequence
  Description of Artificial Sequence: Synthetic oligonucleotide
  Target: DMPK; (-) strand; PAM type: YTN; PAM sequence: CTG
tccccacctaggacccccac

SEQ ID NO: 15769 - DNA, 20 bp, Artificial Sequence
  Description of Artificial Sequence: Synthetic oligonucleotide
  Target: DMPK; (-) strand; PAM type: YTN; PAM sequence: TTG
tctgtccccacctaggaccc

SEQ ID NO: 15770 - DNA, 20 bp, Artificial Sequence
  Description of Artificial Sequence: Synthetic oligonucleotide
  Target: DMPK; (-) strand; PAM type: YTN; PAM sequence: TTA
ttgtctgtccccacctagga

SEQ ID NO: 15771 - DNA, 20 bp, Artificial Sequence
  Description of Artificial Sequence: Synthetic oligonucleotide
  Target: DMPK; (-) strand; PAM type: YTN; PAM sequence: TTT
attgtctgtccccacctagg

SEQ ID NO: 15772 - DNA, 20 bp, Artificial Sequence
  Description of Artificial Sequence: Synthetic oligonucleotide
  Target: DMPK; (-) strand; PAM type: YTN; PAM sequence: CTC
ggtatttattgtctgtcccc

SEQ ID NO: 15773 - DNA, 20 bp, Artificial Sequence
  Description of Artificial Sequence: Synthetic oligonucleotide
  Target: DMPK; (-) strand; PAM type: YTN; PAM sequence: TTC
ctcggtatttattgtctgtc

SEQ ID NO: 15774 - DNA, 20 bp, Artificial Sequence
  Description of Artificial Sequence: Synthetic oligonucleotide
  Target: DMPK; (-) strand; PAM type: YTN; PAM sequence: CTG
agaccccgacattcctcggt

SEQ ID NO: 15775 - DNA, 20 bp, Artificial Sequence
  Description of Artificial Sequence: Synthetic oligonucleotide
  Target: DMPK; (-) strand; PAM type: YTN; PAM sequence: TTG
gatgcactgagaccccgaca

SEQ ID NO: 15776 - DNA, 20 bp, Artificial Sequence
  Description of Artificial Sequence: Synthetic oligonucleotide
  Target: DMPK; (-) strand; PAM type: YTN; PAM sequence: TTT
ggatgcactgagaccccgac

SEQ ID NO: 15777 - DNA, 20 bp, Artificial Sequence
  Description of Artificial Sequence: Synthetic oligonucleotide
  Target: DMPK; (-) strand; PAM type: YTN; PAM sequence: TTT
tggatgcactgagaccccga

SEQ ID NO: 15778 - DNA, 20 bp, Artificial Sequence
  Description of Artificial Sequence: Synthetic oligonucleotide
  Target: DMPK; (-) strand; PAM type: YTN; PAM sequence: CTA
caggacccccaacaacccca

SEQ ID NO: 15779 - DNA, 20 bp, Artificial Sequence
  Description of Artificial Sequence: Synthetic oligonucleotide
  Target: DMPK; (-) strand; PAM type: YTN; PAM sequence: CTG
acaggctacaggacccccaa

SEQ ID NO: 15780 - DNA, 20 bp, Artificial Sequence
  Description of Artificial Sequence: Synthetic oligonucleotide
  Target: DMPK; (-) strand; PAM type: YTN; PAM sequence: CTC
gctgacaggctacaggaccc

SEQ ID NO: 15781 - DNA, 20 bp, Artificial Sequence
  Description of Artificial Sequence: Synthetic oligonucleotide
  Target: DMPK; (-) strand; PAM type: YTN; PAM sequence: CTC
cgactcgctgacaggctaca

SEQ ID NO: 15782 - DNA, 20 bp, Artificial Sequence
  Description of Artificial Sequence: Synthetic oligonucleotide
  Target: DMPK; (-) strand; PAM type: YTN; PAM sequence: CTC
gtcctccgactcgctgacag

SEQ ID NO: 15783 - DNA, 20 bp, Artificial Sequence
  Description of Artificial Sequence: Synthetic oligonucleotide
  Target: DMPK; (-) strand; PAM type: YTN; PAM sequence: TTG
acctcgtcctccgactcgct

SEQ ID NO: 15784 - DNA, 20 bp, Artificial Sequence
  Description of Artificial Sequence: Synthetic oligonucleotide
  Target: DMPK; (-) strand; PAM type: YTN; PAM sequence: TTA
ttgacctcgtcctccgactc

SEQ ID NO: 15785 - DNA, 20 bp, Artificial Sequence
  Description of Artificial Sequence: Synthetic oligonucleotide
  Target: DMPK; (-) strand; PAM type: YTN; PAM sequence: TTT
attgacctcgtcctccgact

SEQ ID NO: 15786 - DNA, 20 bp, Artificial Sequence
  Description of Artificial Sequence: Synthetic oligonucleotide
  Target: DMPK; (-) strand; PAM type: YTN; PAM sequence: TTG
gatatttattgacctcgtcc

SEQ ID NO: 15787 - DNA, 20 bp, Artificial Sequence
  Description of Artificial Sequence: Synthetic oligonucleotide
  Target: DMPK; (-) strand; PAM type: YTN; PAM sequence: TTT
ggatatttattgacctcgtc

SEQ ID NO: 15788 - DNA, 20 bp, Artificial Sequence
  Description of Artificial Sequence: Synthetic oligonucleotide
  Target: DMPK; (-) strand; PAM type: YTN; PAM sequence: TTC
ggcggtttggatatttattg

SEQ ID NO: 15789 - DNA, 20 bp, Artificial Sequence
  Description of Artificial Sequence: Synthetic oligonucleotide
  Target: DMPK; (-) strand; PAM type: YTN; PAM sequence: CTT
cggcggtttggatatttatt

SEQ ID NO: 15790 - DNA, 20 bp, Artificial Sequence
  Description of Artificial Sequence: Synthetic oligonucleotide
  Target: DMPK; (-) strand; PAM type: YTN; PAM sequence: CTC
cgcccgcttcggcggtttgg

SEQ ID NO: 15791 - DNA, 20 bp, Artificial Sequence
  Description of Artificial Sequence: Synthetic oligonucleotide
  Target: DMPK; (-) strand; PAM type: YTN; PAM sequence: CTC
ggagccccagccggctccgc

SEQ ID NO: 15792 - DNA, 20 bp, Artificial Sequence
  Description of Artificial Sequence: Synthetic oligonucleotide
  Target: DMPK; (-) strand; PAM type: YTN; PAM sequence: CTC
tcggagccccagccggctcc

SEQ ID NO: 15793 - DNA, 20 bp, Artificial Sequence
  Description of Artificial Sequence: Synthetic oligonucleotide
  Target: DMPK; (-) strand; PAM type: YTN; PAM sequence: CTG
ctctcggagccccagccggc

SEQ ID NO: 15794 - DNA, 20 bp, Artificial Sequence
  Description of Artificial Sequence: Synthetic oligonucleotide
  Target: DMPK; (-) strand; PAM type: YTN; PAM sequence: TTG
cgctgctctcggagccccag

SEQ ID NO: 15795 - DNA, 20 bp, Artificial Sequence
  Description of Artificial Sequence: Synthetic oligonucleotide
  Target: DMPK; (-) strand; PAM type: YTN; PAM sequence: CTT
gcgctgctctcggagcccca

SEQ ID NO: 15796 - DNA, 20 bp, Artificial Sequence
  Description of Artificial Sequence: Synthetic oligonucleotide
  Target: DMPK; (-) strand; PAM type: YTN; PAM sequence: CTC
acttgcgctgctctcggagc

SEQ ID NO: 15797 - DNA, 20 bp, Artificial Sequence
  Description of Artificial Sequence: Synthetic oligonucleotide
  Target: DMPK; (-) strand; PAM type: YTN; PAM sequence: CTC
ctcacttgcgctgctctcgg

SEQ ID NO: 15798 - DNA, 20 bp, Artificial Sequence
  Description of Artificial Sequence: Synthetic oligonucleotide
  Target: DMPK; (-) strand; PAM type: YTN; PAM sequence: TTC
ggggatcccgcgcccccctc

SEQ ID NO: 15799 - DNA, 20 bp, Artificial Sequence
  Description of Artificial Sequence: Synthetic oligonucleotide
  Target: DMPK; (-) strand; PAM type: YTN; PAM sequence: TTT
cggggatcccgcgcccccct

SEQ ID NO: 15800 - DNA, 20 bp, Artificial Sequence
  Description of Artificial Sequence: Synthetic oligonucleotide
  Target: DMPK; (-) strand; PAM type: YTN; PAM sequence: TTT
tcggggatcccgcgcccccc

SEQ ID NO: 15801 - DNA, 20 bp, Artificial Sequence
  Description of Artificial Sequence: Synthetic oligonucleotide
  Target: DMPK; (-) strand; PAM type: YTN; PAM sequence: TTT
ttcggggatcccgcgccccc

SEQ ID NO: 15802 - DNA, 20 bp, Artificial Sequence
  Description of Artificial Sequence: Synthetic oligonucleotide
  Target: DMPK; (-) strand; PAM type: YTN; PAM sequence: CTT
tttcggggatcccgcgcccc

SEQ ID NO: 15803 - DNA, 20 bp, Artificial Sequence
  Description of Artificial Sequence: Synthetic oligonucleotide
  Target: DMPK; (-) strand; PAM type: YTN; PAM sequence: TTG
ccaaacccgctttttcgggg

SEQ ID NO: 15804 - DNA, 20 bp, Artificial Sequence
  Description of Artificial Sequence: Synthetic oligonucleotide
  Target: DMPK; (-) strand; PAM type: YTN; PAM sequence: TTT
gccaaacccgctttttcggg

SEQ ID NO: 15805 - DNA, 20 bp, Artificial Sequence
  Description of Artificial Sequence: Synthetic oligonucleotide
  Target: DMPK; (-) strand; PAM type: YTN; PAM sequence: TTT
tgccaaacccgctttttcgg

SEQ ID NO: 15806 - DNA, 20 bp, Artificial Sequence
  Description of Artificial Sequence: Synthetic oligonucleotide
  Target: DMPK; (-) strand; PAM type: YTN; PAM sequence: CTT
ttgccaaacccgctttttcg

SEQ ID NO: 15807 - DNA, 20 bp, Artificial Sequence
  Description of Artificial Sequence: Synthetic oligonucleotide
  Target: DMPK; (-) strand; PAM type: YTN; PAM sequence: TTG
cttttgccaaacccgctttt

SEQ ID NO: 15808 - DNA, 20 bp, Artificial Sequence
  Description of Artificial Sequence: Synthetic oligonucleotide
  Target: DMPK; (-) strand; PAM type: YTN; PAM sequence: TTT
gcttttgccaaacccgcttt

SEQ ID NO: 15809 - DNA, 20 bp, Artificial Sequence
  Description of Artificial Sequence: Synthetic oligonucleotide
  Target: DMPK; (-) strand; PAM type: YTN; PAM sequence: CTC
gggaaatttgcttttgccaa

SEQ ID NO: 15810 - DNA, 20 bp, Artificial Sequence
  Description of Artificial Sequence: Synthetic oligonucleotide
  Target: DMPK; (-) strand; PAM type: YTN; PAM sequence: TTA
ctcgggaaatttgcttttgc

SEQ ID NO: 15811 - DNA, 20 bp, Artificial Sequence
  Description of Artificial Sequence: Synthetic oligonucleotide
  Target: DMPK; (-) strand; PAM type: YTN; PAM sequence: CTT
actcgggaaatttgcttttg

SEQ ID NO: 15812 - DNA, 20 bp, Artificial Sequence
  Description of Artificial Sequence: Synthetic oligonucleotide
  Target: DMPK; (-) strand; PAM type: YTN; PAM sequence: CTG
cttactcgggaaatttgctt

SEQ ID NO: 15813 - DNA, 20 bp, Artificial Sequence
  Description of Artificial Sequence: Synthetic oligonucleotide
  Target: DMPK; (-) strand; PAM type: YTN; PAM sequence: CTG
cctgcttactcgggaaattt

SEQ ID NO: 15814 - DNA, 20 bp, Artificial Sequence
  Description of Artificial Sequence: Synthetic oligonucleotide
  Target: DMPK; (-) strand; PAM type: YTN; PAM sequence: CTC
tgcctgcttactcgggaaat

SEQ ID NO: 15815 - DNA, 20 bp, Artificial Sequence
  Description of Artificial Sequence: Synthetic oligonucleotide
  Target: DMPK; (-) strand; PAM type: YTN; PAM sequence: CTG
gcgcgatctctgcctgctta

SEQ ID NO: 15816 - DNA, 20 bp, Artificial Sequence
  Description of Artificial Sequence: Synthetic oligonucleotide
  Target: DMPK; (-) strand; PAM type: YTN; PAM sequence: CTG
gggagcgtctggcgcgatct

SEQ ID NO: 15817 - DNA, 20 bp, Artificial Sequence
  Description of Artificial Sequence: Synthetic oligonucleotide
  Target: DMPK; (-) strand; PAM type: YTN; PAM sequence: CTC
tggggagcgtctggcgcgat

SEQ ID NO: 15818 - DNA, 20 bp, Artificial Sequence
  Description of Artificial Sequence: Synthetic oligonucleotide
  Target: DMPK; (-) strand; PAM type: YTN; PAM sequence: CTG
ctctggggagcgtctggcgc

SEQ ID NO: 15819 - DNA, 20 bp, Artificial Sequence
  Description of Artificial Sequence: Synthetic oligonucleotide
  Target: DMPK; (-) strand; PAM type: YTN; PAM sequence: TTG
tgcatgacgccctgctctgg

SEQ ID NO: 15820 - DNA, 20 bp, Artificial Sequence
  Description of Artificial Sequence: Synthetic oligonucleotide
  Target: DMPK; (-) strand; PAM type: YTN; PAM sequence: CTT
gtgcatgacgccctgctctg

SEQ ID NO: 15821 - DNA, 20 bp, Artificial Sequence
  Description of Artificial Sequence: Synthetic oligonucleotide
  Target: DMPK; (-) strand; PAM type: YTN; PAM sequence: TTC
ttgtgcatgacgccctgctc

SEQ ID NO: 15822 - DNA, 20 bp, Artificial Sequence
  Description of Artificial Sequence: Synthetic oligonucleotide
  Target: DMPK; (-) strand; PAM type: YTN; PAM sequence: TTT
cttgtgcatgacgccctgct

SEQ ID NO: 15823 - DNA, 20 bp, Artificial Sequence
  Description of Artificial Sequence: Synthetic oligonucleotide
  Target: DMPK; (-) strand; PAM type: YTN; PAM sequence: CTT
tcttgtgcatgacgccctgc

SEQ ID NO: 15824 - DNA, 20 bp, Artificial Sequence
  Description of Artificial Sequence: Synthetic oligonucleotide
  Target: DMPK; (-) strand; PAM type: YTN; PAM sequence: TTC
gcaaagtgcaaagctttctt

SEQ ID NO: 15825 - DNA, 20 bp, Artificial Sequence
  Description of Artificial Sequence: Synthetic oligonucleotide
  Target: DMPK; (-) strand; PAM type: YTN; PAM sequence: TTG
gttcgcaaagtgcaaagctt

SEQ ID NO: 15826 - DNA, 20 bp, Artificial Sequence
  Description of Artificial Sequence: Synthetic oligonucleotide
  Target: DMPK; (-) strand; PAM type: YTN; PAM sequence: CTA
tcgttggttcgcaaagtgca

SEQ ID NO: 15827 - DNA, 20 bp, Artificial Sequence
  Description of Artificial Sequence: Synthetic oligonucleotide
  Target: DMPK; (-) strand; PAM type: YTN; PAM sequence: CTC
cacgcacccccacctatcgt

SEQ ID NO: 15828 - DNA, 20 bp, Artificial Sequence
  Description of Artificial Sequence: Synthetic oligonucleotide
  Target: DMPK; (-) strand; PAM type: YTN; PAM sequence: TTC
catcctccacgcacccccac

SEQ ID NO: 15829 - DNA, 20 bp, Artificial Sequence
  Description of Artificial Sequence: Synthetic oligonucleotide
  Target: DMPK; (-) strand; PAM type: YTN; PAM sequence: CTG
ggaaggcagcaagccgggcc

SEQ ID NO: 15830 - DNA, 20 bp, Artificial Sequence
  Description of Artificial Sequence: Synthetic oligonucleotide
  Target: DMPK; (-) strand; PAM type: YTN; PAM sequence: CTG
caggcctgggaaggcagcaa

SEQ ID NO: 15831 - DNA, 20 bp, Artificial Sequence
  Description of Artificial Sequence: Synthetic oligonucleotide
  Target: DMPK; (-) strand; PAM type: YTN; PAM sequence: CTG
acgtggatgggcaaactgca

SEQ ID NO: 15832 - DNA, 20 bp, Artificial Sequence
  Description of Artificial Sequence: Synthetic oligonucleotide
  Target: DMPK; (-) strand; PAM type: YTN; PAM sequence: CTG
aggccctgacgtggatgggc

SEQ ID NO: 15833 - DNA, 20 bp, Artificial Sequence
  Description of Artificial Sequence: Synthetic oligonucleotide
  Target: DMPK; (-) strand; PAM type: YTN; PAM sequence: TTC
ggccaggctgaggccctgac

SEQ ID NO: 15834 - DNA, 20 bp, Artificial Sequence
  Description of Artificial Sequence: Synthetic oligonucleotide
  Target: DMPK; (-) strand; PAM type: YTN; PAM sequence: TTT
cggccaggctgaggccctga

SEQ ID NO: 15835 - DNA, 20 bp, Artificial Sequence
  Description of Artificial Sequence: Synthetic oligonucleotide
  Target: DMPK; (-) strand; PAM type: YTN; PAM sequence: CTT
tcggccaggctgaggccctg

SEQ ID NO: 15836 - DNA, 20 bp, Artificial Sequence
  Description of Artificial Sequence: Synthetic oligonucleotide
  Target: DMPK; (-) strand; PAM type: YTN; PAM sequence: TTC
tttcggccaggctgaggccc

SEQ ID NO: 15837 - DNA, 20 bp, Artificial Sequence
  Description of Artificial Sequence: Synthetic oligonucleotide
  Target: DMPK; (-) strand; PAM type: YTN; PAM sequence: TTT
ctttcggccaggctgaggcc

SEQ ID NO: 15838 - DNA, 20 bp, Artificial Sequence
  Description of Artificial Sequence: Synthetic oligonucleotide
  Target: DMPK; (-) strand; PAM type: YTN; PAM sequence: CTT
tctttcggccaggctgaggc

SEQ ID NO: 15839 - DNA, 20 bp, Artificial Sequence
  Description of Artificial Sequence: Synthetic oligonucleotide
  Target: DMPK; (-) strand; PAM type: YTN; PAM sequence: TTC
tttctttcggccaggctgag

SEQ ID NO: 15840 - DNA, 20 bp, Artificial Sequence
  Description of Artificial Sequence: Synthetic oligonucleotide
  Target: DMPK; (-) strand; PAM type: YTN; PAM sequence: TTT
ctttctttcggccaggctga

SEQ ID NO: 15841 - DNA, 20 bp, Artificial Sequence
  Description of Artificial Sequence: Synthetic oligonucleotide
  Target: DMPK; (-) strand; PAM type: YTN; PAM sequence: CTG
gggggatcacagaccatttc

SEQ ID NO: 15842 - DNA, 20 bp, Artificial Sequence
  Description of Artificial Sequence: Synthetic oligonucleotide
  Target: DMPK; (-) strand; PAM type: YTN; PAM sequence: CTG
ctggggggatcacagaccat

SEQ ID NO: 15843 - DNA, 20 bp, Artificial Sequence
  Description of Artificial Sequence: Synthetic oligonucleotide
  Target: DMPK; (-) strand; PAM type: YTN; PAM sequence: CTG
ctgctggggggatcacagac

SEQ ID NO: 15844 - DNA, 20 bp, Artificial Sequence
  Description of Artificial Sequence: Synthetic oligonucleotide
  Target: DMPK; (-) strand; PAM type: YTN; PAM sequence: CTG
ctgctgctggggggatcaca

SEQ ID NO: 15845 - DNA, 20 bp, Artificial Sequence
  Description of Artificial Sequence: Synthetic oligonucleotide
  Target: DMPK; (-) strand; PAM type: YTN; PAM sequence: CTG
ctgctgctgctggggggatc

SEQ ID NO: 15846 - DNA, 20 bp, Artificial Sequence
  Description of Artificial Sequence: Synthetic oligonucleotide
  Target: DMPK; (-) strand; PAM type: YTN; PAM sequence: CTG
ctgctgctgctgctgggggg

SEQ ID NO: 15847 - DNA, 20 bp, Artificial Sequence
  Description of Artificial Sequence: Synthetic oligonucleotide
  Target: DMPK; (-) strand; PAM type: YTN; PAM sequence: CTG
ctgctgctgctgctgctggg

SEQ ID NO: 15848 - DNA, 20 bp, Artificial Sequence
  Description of Artificial Sequence: Synthetic oligonucleotide
  Target: DMPK; (-) strand; PAM type: YTN; PAM sequence: CTG
ctgctgctgctgctgctgct

SEQ ID NO: 15849 - DNA, 20 bp, Artificial Sequence
  Description of Artificial Sequence: Synthetic oligonucleotide
  Target: DMPK; (-) strand; PAM type: YTN; PAM sequence: CTG
ctgctgctgctgctgctgct

SEQ ID NO: 15850 - DNA, 20 bp, Artificial Sequence
  Description of Artificial Sequence: Synthetic oligonucleotide
  Target: DMPK; (-) strand; PAM type: YTN; PAM sequence: CTG
ctgctgctgctgctgctgct

SEQ ID NO: 15851 - DNA, 20 bp, Artificial Sequence
  Description of Artificial Sequence: Synthetic oligonucleotide
  Target: DMPK; (-) strand; PAM type: YTN; PAM sequence: CTG
ctgctgctgctgctgctgct

SEQ ID NO: 15852 - DNA, 20 bp, Artificial Sequence
  Description of Artificial Sequence: Synthetic oligonucleotide
  Target: DMPK; (-) strand; PAM type: YTN; PAM sequence: CTG
ctgctgctgctgctgctgct

SEQ ID NO: 15853 - DNA, 20 bp, Artificial Sequence
  Description of Artificial Sequence: Synthetic oligonucleotide
  Target: DMPK; (-) strand; PAM type: YTN; PAM sequence: CTG
ctgctgctgctgctgctgct

SEQ ID NO: 15854 - DNA, 20 bp, Artificial Sequence
  Description of Artificial Sequence: Synthetic oligonucleotide
  Target: DMPK; (-) strand; PAM type: YTN; PAM sequence: CTG
ctgctgctgctgctgctgct

SEQ ID NO: 15855 - DNA, 20 bp, Artificial Sequence
  Description of Artificial Sequence: Synthetic oligonucleotide
  Target: DMPK; (-) strand; PAM type: YTN; PAM sequence: CTG
ctgctgctgctgctgctgct

SEQ ID NO: 15856 - DNA, 20 bp, Artificial Sequence
  Description of Artificial Sequence: Synthetic oligonucleotide
  Target: DMPK; (-) strand; PAM type: YTN; PAM sequence: CTG
ctgctgctgctgctgctgct

SEQ ID NO: 15857 - DNA, 20 bp, Artificial Sequence
  Description of Artificial Sequence: Synthetic oligonucleotide
  Target: DMPK; (-) strand; PAM type: YTN; PAM sequence: CTG
ctgctgctgctgctgctgct

SEQ ID NO: 15858 - DNA, 20 bp, Artificial Sequence
  Description of Artificial Sequence: Synthetic oligonucleotide
  Target: DMPK; (-) strand; PAM type: YTN; PAM sequence: CTG
ctgctgctgctgctgctgct

SEQ ID NO: 15859 - DNA, 20 bp, Artificial Sequence
  Description of Artificial Sequence: Synthetic oligonucleotide
  Target: DMPK; (-) strand; PAM type: YTN; PAM sequence: CTG
ctgctgctgctgctgctgct

SEQ ID NO: 15860 - DNA, 20 bp, Artificial Sequence
  Description of Artificial Sequence: Synthetic oligonucleotide
  Target: DMPK; (-) strand; PAM type: YTN; PAM sequence: CTG
ctgctgctgctgctgctgct

SEQ ID NO: 15861 - DNA, 20 bp, Artificial Sequence
  Description of Artificial Sequence: Synthetic oligonucleotide
  Target: DMPK; (-) strand; PAM type: YTN; PAM sequence: TTG
tagccgggaatgctgctgct

SEQ ID NO: 15862 - DNA, 20 bp, Artificial Sequence
  Description of Artificial Sequence: Synthetic oligonucleotide
  Target: DMPK; (-) strand; PAM type: YTN; PAM sequence: CTT
gtagccgggaatgctgctgc

SEQ ID NO: 15863 - DNA, 20 bp, Artificial Sequence
  Description of Artificial Sequence: Synthetic oligonucleotide
  Target: DMPK; (-) strand; PAM type: YTN; PAM sequence: CTC
gaagggtccttgtagccggg

SEQ ID NO: 15864 - DNA, 20 bp, Artificial Sequence
  Description of Artificial Sequence: Synthetic oligonucleotide
  Target: DMPK; (-) strand; PAM type: YTN; PAM sequence: CTA
gcggccggggagggaggggc

SEQ ID NO: 15865 - DNA, 20 bp, Artificial Sequence
  Description of Artificial Sequence: Synthetic oligonucleotide
  Target: DMPK; (-) strand; PAM type: YTN; PAM sequence: CTG
tgatccgggcccgcccccta

SEQ ID NO: 15866 - DNA, 20 bp, Artificial Sequence
  Description of Artificial Sequence: Synthetic oligonucleotide
  Target: DMPK; (-) strand; PAM type: YTN; PAM sequence: CTC
cagtcctgtgatccgggccc

SEQ ID NO: 15867 - DNA, 20 bp, Artificial Sequence
  Description of Artificial Sequence: Synthetic oligonucleotide
  Target: DMPK; (-) strand; PAM type: YTN; PAM sequence: CTC
cgcccagctccagtcctgtg

SEQ ID NO: 15868 - DNA, 20 bp, Artificial Sequence
  Description of Artificial Sequence: Synthetic oligonucleotide
  Target: DMPK; (-) strand; PAM type: YTN; PAM sequence: CTC
cgagcgtgggtctccgccca

SEQ ID NO: 15869 - DNA, 20 bp, Artificial Sequence
  Description of Artificial Sequence: Synthetic oligonucleotide
  Target: DMPK; (-) strand; PAM type: YTN; PAM sequence: TTC
acaaccgctccgagcgtggg

SEQ ID NO: 15870 - DNA, 20 bp, Artificial Sequence
  Description of Artificial Sequence: Synthetic oligonucleotide
  Target: DMPK; (-) strand; PAM type: YTN; PAM sequence: CTG
ccagttcacaaccgctccga

SEQ ID NO: 15871 - DNA, 20 bp, Artificial Sequence
  Description of Artificial Sequence: Synthetic oligonucleotide
  Target: DMPK; (-) strand; PAM type: YTN; PAM sequence: CTG
agtgcccggggcacggcaca

SEQ ID NO: 15872 - DNA, 20 bp, Artificial Sequence
  Description of Artificial Sequence: Synthetic oligonucleotide
  Target: DMPK; (-) strand; PAM type: YTN; PAM sequence: TTG
gaagactgagtgcccggggc

SEQ ID NO: 15873 - DNA, 20 bp, Artificial Sequence
  Description of Artificial Sequence: Synthetic oligonucleotide
  Target: DMPK; (-) strand; PAM type: YTN; PAM sequence: CTC
cggggccccgttggaagact

SEQ ID NO: 15874 - DNA, 20 bp, Artificial Sequence
  Description of Artificial Sequence: Synthetic oligonucleotide
  Target: DMPK; (-) strand; PAM type: YTN; PAM sequence: TTC
gactccggggccccgttgga

SEQ ID NO: 15875 - DNA, 20 bp, Artificial Sequence
  Description of Artificial Sequence: Synthetic oligonucleotide
  Target: DMPK; (-) strand; PAM type: YTN; PAM sequence: CTT
cgactccggggccccgttgg

SEQ ID NO: 15876 - DNA, 20 bp, Artificial Sequence
  Description of Artificial Sequence: Synthetic oligonucleotide
  Target: DMPK; (-) strand; PAM type: YTN; PAM sequence: CTG
tcttcgactccggggccccg

SEQ ID NO: 15877 - DNA, 20 bp, Artificial Sequence
  Description of Artificial Sequence: Synthetic oligonucleotide
  Target: DMPK; (-) strand; PAM type: YTN; PAM sequence: CTA
gaactgtcttcgactccggg

SEQ ID NO: 15878 - DNA, 20 bp, Artificial Sequence
  Description of Artificial Sequence: Synthetic oligonucleotide
  Target: DMPK; (-) strand; PAM type: YTN; PAM sequence: CTG
aaccctagaactgtcttcga

SEQ ID NO: 15879 - DNA, 20 bp, Artificial Sequence
  Description of Artificial Sequence: Synthetic oligonucleotide
  Target: DMPK; (-) strand; PAM type: YTN; PAM sequence: CTC
cctgaaccctagaactgtct

SEQ ID NO: 15880 - DNA, 20 bp, Artificial Sequence
  Description of Artificial Sequence: Synthetic oligonucleotide
  Target: DMPK; (-) strand; PAM type: YTN; PAM sequence: CTG
gcgccgcccaggagccgccc

SEQ ID NO: 15881 - DNA, 20 bp, Artificial Sequence
  Description of Artificial Sequence: Synthetic oligonucleotide
  Target: DMPK; (-) strand; PAM type: YTN; PAM sequence: CTC
accgcagtctggcgccgccc

SEQ ID NO: 15882 - DNA, 20 bp, Artificial Sequence
  Description of Artificial Sequence: Synthetic oligonucleotide
  Target: DMPK; (-) strand; PAM type: YTN; PAM sequence: TTG
gtggcccacgccggccaact

SEQ ID NO: 15883 - DNA, 20 bp, Artificial Sequence
  Description of Artificial Sequence: Synthetic oligonucleotide
  Target: DMPK; (-) strand; PAM type: YTN; PAM sequence: TTG
ggttggtggcccacgccggc

SEQ ID NO: 15884 - DNA, 20 bp, Artificial Sequence
  Description of Artificial Sequence: Synthetic oligonucleotide
  Target: DMPK; (-) strand; PAM type: YTN; PAM sequence: CTG
cattgggttggtggcccacg

SEQ ID NO: 15885 - DNA, 20 bp, Artificial Sequence
  Description of Artificial Sequence: Synthetic oligonucleotide
  Target: DMPK; (-) strand; PAM type: YTN; PAM sequence: CTG
ggctgcattgggttggtggc

SEQ ID NO: 15886 - DNA, 20 bp, Artificial Sequence
  Description of Artificial Sequence: Synthetic oligonucleotide
  Target: DMPK; (-) strand; PAM type: YTN; PAM sequence: CTC
gtgccgccgccctgggctgc

SEQ ID NO: 15887 - DNA, 20 bp, Artificial Sequence
  Description of Artificial Sequence: Synthetic oligonucleotide
  Target: DMPK; (-) strand; PAM type: YTN; PAM sequence: CTG
tctcgtgccgccgccctggg

SEQ ID NO: 15888 - DNA, 20 bp, Artificial Sequence
  Description of Artificial Sequence: Synthetic oligonucleotide
  Target: DMPK; (-) strand; PAM type: YTN; PAM sequence: TTC
tgtctcgtgccgccgccctg

SEQ ID NO: 15889 - DNA, 20 bp, Artificial Sequence
  Description of Artificial Sequence: Synthetic oligonucleotide
  Target: DMPK; (-) strand; PAM type: YTN; PAM sequence: TTG
ttctgtctcgtgccgccgcc

SEQ ID NO: 15890 - DNA, 20 bp, Artificial Sequence
  Description of Artificial Sequence: Synthetic oligonucleotide
  Target: DMPK; (-) strand; PAM type: YTN; PAM sequence: TTC
gccgttgttctgtctcgtgc

SEQ ID NO: 15891 - DNA, 20 bp, Artificial Sequence
  Description of Artificial Sequence: Synthetic oligonucleotide
  Target: DMPK; (-) strand; PAM type: YTN; PAM sequence: CTG
ttcgccgttgttctgtctcg

SEQ ID NO: 15892 - DNA, 20 bp, Artificial Sequence
  Description of Artificial Sequence: Synthetic oligonucleotide
  Target: DMPK; (-) strand; PAM type: YTN; PAM sequence: CTC
ctgttcgccgttgttctgtc

SEQ ID NO: 15893 - DNA, 20 bp, Artificial Sequence
  Description of Artificial Sequence: Synthetic oligonucleotide
  Target: DMPK; (-) strand; PAM type: YTN; PAM sequence: CTG
ctcctgttcgccgttgttct

SEQ ID NO: 15894 - DNA, 20 bp, Artificial Sequence
  Description of Artificial Sequence: Synthetic oligonucleotide
  Target: DMPK; (-) strand; PAM type: YTN; PAM sequence: TTC
cctgctcctgttcgccgttg

SEQ ID NO: 15895 - DNA, 20 bp, Artificial Sequence
  Description of Artificial Sequence: Synthetic oligonucleotide
  Target: DMPK; (-) strand; PAM type: YTN; PAM sequence: TTT
ccctgctcctgttcgccgtt

SEQ ID NO: 15896 - DNA, 20 bp, Artificial Sequence
  Description of Artificial Sequence: Synthetic oligonucleotide
  Target: DMPK; (-) strand; PAM type: YTN; PAM sequence: CTT
tccctgctcctgttcgccgt

SEQ ID NO: 15897 - DNA, 20 bp, Artificial Sequence
  Description of Artificial Sequence: Synthetic oligonucleotide
  Target: DMPK; (-) strand; PAM type: YTN; PAM sequence: CTA
tcggaggcgctttccctgct

SEQ ID NO: 15898 - DNA, 20 bp, Artificial Sequence
  Description of Artificial Sequence: Synthetic oligonucleotide
  Target: DMPK; (-) strand; PAM type: YTN; PAM sequence: CTG
gcctatcggaggcgctttcc

SEQ ID NO: 15899 - DNA, 20 bp, Artificial Sequence
  Description of Artificial Sequence: Synthetic oligonucleotide
  Target: DMPK; (-) strand; PAM type: YTN; PAM sequence: CTA
ggcctggcctatcggaggcg

SEQ ID NO: 15900 - DNA, 20 bp, Artificial Sequence
  Description of Artificial Sequence: Synthetic oligonucleotide
  Target: DMPK; (-) strand; PAM type: YTN; PAM sequence: CTC
cccgcaggtccctaggcctg

SEQ ID NO: 15901 - DNA, 20 bp, Artificial Sequence
  Description of Artificial Sequence: Synthetic oligonucleotide
  Target: DMPK; (-) strand; PAM type: YTN; PAM sequence: CTC
tccccgcaggtccctaggcc

SEQ ID NO: 15902 - DNA, 20 bp, Artificial Sequence
  Description of Artificial Sequence: Synthetic oligonucleotide
  Target: DMPK; (-) strand; PAM type: YTN; PAM sequence: CTC
gccctctccccgcaggtccc

SEQ ID NO: 15903 - DNA, 20 bp, Artificial Sequence
  Description of Artificial Sequence: Synthetic oligonucleotide
  Target: DMPK; (-) strand; PAM type: YTN; PAM sequence: TTG
acctcgccctctccccgcag

SEQ ID NO: 15904 - DNA, 20 bp, Artificial Sequence
  Description of Artificial Sequence: Synthetic oligonucleotide
  Target: DMPK; (-) strand; PAM type: YTN; PAM sequence: CTA
tgggcgtaggcggggcgagt

SEQ ID NO: 15905 - DNA, 20 bp, Artificial Sequence
  Description of Artificial Sequence: Synthetic oligonucleotide
  Target: DMPK; (-) strand; PAM type: YTN; PAM sequence: TTG
gggcgggggcggggcgcagg

SEQ ID NO: 15906 - DNA, 20 bp, Artificial Sequence
  Description of Artificial Sequence: Synthetic oligonucleotide
  Target: DMPK; (-) strand; PAM type: YTN; PAM sequence: CTG
ttggggcgggggcggggcgc

SEQ ID NO: 15907 - DNA, 20 bp, Artificial Sequence
  Description of Artificial Sequence: Synthetic oligonucleotide
  Target: DMPK; (-) strand; PAM type: YTN; PAM sequence: CTG
taggctgttggggcgggggc

SEQ ID NO: 15908 - DNA, 20 bp, Artificial Sequence
  Description of Artificial Sequence: Synthetic oligonucleotide
  Target: DMPK; (-) strand; PAM type: YTN; PAM sequence: CTA
acaacagctgtaggctgttg

SEQ ID NO: 15909 - DNA, 20 bp, Artificial Sequence
  Description of Artificial Sequence: Synthetic oligonucleotide
  Target: DMPK; (-) strand; PAM type: YTN; PAM sequence: TTC
gaggcgtgcgagtggactaa

SEQ ID NO: 15910 - DNA, 20 bp, Artificial Sequence
  Description of Artificial Sequence: Synthetic oligonucleotide
  Target: DMPK; (-) strand; PAM type: YTN; PAM sequence: TTC
ggacgggattcgaggcgtgc

SEQ ID NO: 15911 - DNA, 20 bp, Artificial Sequence
  Description of Artificial Sequence: Synthetic oligonucleotide
  Target: DMPK; (-) strand; PAM type: YTN; PAM sequence: CTA
ggaagcagccaatgacgagt

SEQ ID NO: 15912 - DNA, 20 bp, Artificial Sequence
  Description of Artificial Sequence: Synthetic oligonucleotide
  Target: DMPK; (-) strand; PAM type: YTN; PAM sequence: TTC
gggcagccaatcaacacagg

SEQ ID NO: 15913 - DNA, 20 bp, Artificial Sequence
  Description of Artificial Sequence: Synthetic oligonucleotide
  Target: DMPK; (-) strand; PAM type: YTN; PAM sequence: CTT
cgggcagccaatcaacacag

SEQ ID NO: 15914 - DNA, 20 bp, Artificial Sequence
  Description of Artificial Sequence: Synthetic oligonucleotide
  Target: DMPK; (-) strand; PAM type: YTN; PAM sequence: CTG
ggcccacggcaggagggcgg

SEQ ID NO: 15915 - DNA, 20 bp, Artificial Sequence
  Description of Artificial Sequence: Synthetic oligonucleotide
  Target: DMPK; (-) strand; PAM type: YTN; PAM sequence: TTG
cggggctgggcccacggcag

SEQ ID NO: 15916 - DNA, 20 bp, Artificial Sequence
  Description of Artificial Sequence: Synthetic oligonucleotide
  Target: DMPK; (-) strand; PAM type: YTN; PAM sequence: TTT
gcggggctgggcccacggca

SEQ ID NO: 15917 - DNA, 20 bp, Artificial Sequence
  Description of Artificial Sequence: Synthetic oligonucleotide
  Target: DMPK; (-) strand; PAM type: YTN; PAM sequence: CTG
cgcatttgcggggctgggcc

SEQ ID NO: 15918 - DNA, 20 bp, Artificial Sequence
  Description of Artificial Sequence: Synthetic oligonucleotide
  Target: DMPK; (-) strand; PAM type: YTN; PAM sequence: TTA
gctgcgcatttgcggggctg

SEQ ID NO: 15919 - DNA, 20 bp, Artificial Sequence
  Description of Artificial Sequence: Synthetic oligonucleotide
  Target: DMPK; (-) strand; PAM type: YTN; PAM sequence: CTT
agctgcgcatttgcggggct

SEQ ID NO: 15920 - DNA, 20 bp, Artificial Sequence
  Description of Artificial Sequence: Synthetic oligonucleotide
  Target: DMPK; (-) strand; PAM type: YTN; PAM sequence: TTG
ccacccgcttagctgcgcat

SEQ ID NO: 15921 - DNA, 20 bp, Artificial Sequence
  Description of Artificial Sequence: Synthetic oligonucleotide
  Target: DMPK; (-) strand; PAM type: YTN; PAM sequence: CTT
gccacccgcttagctgcgca

SEQ ID NO: 15922 - DNA, 20 bp, Artificial Sequence
  Description of Artificial Sequence: Synthetic oligonucleotide
  Target: DMPK; (-) strand; PAM type: YTN; PAM sequence: CTC
cacccgccccttgccacccg

SEQ ID NO: 15923 - DNA, 20 bp, Artificial Sequence
  Description of Artificial Sequence: Synthetic oligonucleotide
  Target: DMPK; (-) strand; PAM type: YTN; PAM sequence: CTC
cgccgtcgcgccccgcgctc

SEQ ID NO: 15924 - DNA, 20 bp, Artificial Sequence
  Description of Artificial Sequence: Synthetic oligonucleotide
  Target: DMPK; (-) strand; PAM type: YTN; PAM sequence: CTG
cccacgcccccctccgccgt

SEQ ID NO: 15925 - DNA, 20 bp, Artificial Sequence
  Description of Artificial Sequence: Synthetic oligonucleotide
  Target: DMPK; (-) strand; PAM type: YTN; PAM sequence: CTG
ccagggtacgtccggctgcc

SEQ ID NO: 15926 - DNA, 20 bp, Artificial Sequence
  Description of Artificial Sequence: Synthetic oligonucleotide
  Target: DMPK; (-) strand; PAM type: YTN; PAM sequence: CTC
cctgccagggtacgtccggc

SEQ ID NO: 15927 - DNA, 20 bp, Artificial Sequence
  Description of Artificial Sequence: Synthetic oligonucleotide
  Target: DMPK; (-) strand; PAM type: YTN; PAM sequence: CTG
ctccctgccagggtacgtcc

SEQ ID NO: 15928 - DNA, 20 bp, Artificial Sequence
  Description of Artificial Sequence: Synthetic oligonucleotide
  Target: DMPK; (-) strand; PAM type: YTN; PAM sequence: CTG
ctgctccctgccagggtacg

SEQ ID NO: 15929 - DNA, 20 bp, Artificial Sequence
  Description of Artificial Sequence: Synthetic oligonucleotide
  Target: DMPK; (-) strand; PAM type: YTN; PAM sequence: CTG
gtggggccaggccccatgca

SEQ ID NO: 15930 - DNA, 20 bp, Artificial Sequence
  Description of Artificial Sequence: Synthetic oligonucleotide
  Target: DMPK; (-) strand; PAM type: YTN; PAM sequence: CTG
tgggccagtgcccgctggtg

SEQ ID NO: 15931 - DNA, 20 bp, Artificial Sequence
  Description of Artificial Sequence: Synthetic oligonucleotide
  Target: DMPK; (-) strand; PAM type: YTN; PAM sequence: CTA
gatggccccccggccgtggc

SEQ ID NO: 15932 - DNA, 20 bp, Artificial Sequence
  Description of Artificial Sequence: Synthetic oligonucleotide
  Target: DMPK; (-) strand; PAM type: YTN; PAM sequence: CTC
cagctagatggccccccggc

SEQ ID NO: 15933 - DNA, 20 bp, Artificial Sequence
  Description of Artificial Sequence: Synthetic oligonucleotide
  Target: DMPK; (-) strand; PAM type: YTN; PAM sequence: CTC
tccagctagatggccccccg

SEQ ID NO: 15934 - DNA, 20 bp, Artificial Sequence
  Description of Artificial Sequence: Synthetic oligonucleotide
  Target: DMPK; (-) strand; PAM type: YTN; PAM sequence: CTC
tctccagctagatggccccc

SEQ ID NO: 15935 - DNA, 20 bp, Artificial Sequence
  Description of Artificial Sequence: Synthetic oligonucleotide
  Target: DMPK; (-) strand; PAM type: YTN; PAM sequence: TTC
tctctccagctagatggccc

SEQ ID NO: 15936 - DNA, 20 bp, Artificial Sequence
  Description of Artificial Sequence: Synthetic oligonucleotide
  Target: DMPK; (-) strand; PAM type: YTN; PAM sequence: CTT
ctctctccagctagatggcc

SEQ ID NO: 15937 - DNA, 20 bp, Artificial Sequence
  Description of Artificial Sequence: Synthetic oligonucleotide
  Target: DMPK; (-) strand; PAM type: YTN; PAM sequence: CTG
tcccttctctctccagctag

SEQ ID NO: 15938 - DNA, 20 bp, Artificial Sequence
  Description of Artificial Sequence: Synthetic oligonucleotide
  Target: DMPK; (-) strand; PAM type: YTN; PAM sequence: CTC
cgatcgggtcacctgtccct

SEQ ID NO: 15939 - DNA, 20 bp, Artificial Sequence
  Description of Artificial Sequence: Synthetic oligonucleotide
  Target: DMPK; (-) strand; PAM type: YTN; PAM sequence: CTG
ggctccgatcgggtcacctg

SEQ ID NO: 15940 - DNA, 20 bp, Artificial Sequence
  Description of Artificial Sequence: Synthetic oligonucleotide
  Target: DMPK; (-) strand; PAM type: YTN; PAM sequence: CTG
ggctgggctccgatcgggtc

SEQ ID NO: 15941 - DNA, 20 bp, Artificial Sequence
  Description of Artificial Sequence: Synthetic oligonucleotide
  Target: DMPK; (-) strand; PAM type: YTN; PAM sequence: CTG
agggctgggctgggctccga

SEQ ID NO: 15942 - DNA, 20 bp, Artificial Sequence
  Description of Artificial Sequence: Synthetic oligonucleotide
  Target: DMPK; (-) strand; PAM type: YTN; PAM sequence: CTC
gccccaccgctgagggctgg

SEQ ID NO: 15943 - DNA, 20 bp, Artificial Sequence
  Description of Artificial Sequence: Synthetic oligonucleotide
  Target: DMPK; (-) strand; PAM type: YTN; PAM sequence: CTC
tcgccccaccgctgagggct

SEQ ID NO: 15944 - DNA, 20 bp, Artificial Sequence
  Description of Artificial Sequence: Synthetic oligonucleotide
  Target: DMPK; (-) strand; PAM type: YTN; PAM sequence: CTG
tctctcgccccaccgctgag

SEQ ID NO: 15945 - DNA, 20 bp, Artificial Sequence
  Description of Artificial Sequence: Synthetic oligonucleotide
  Target: DMPK; (-) strand; PAM type: YTN; PAM sequence: CTC
gctgtctctcgccccaccgc

SEQ ID NO: 15946 - DNA, 20 bp, Artificial Sequence
  Description of Artificial Sequence: Synthetic oligonucleotide
  Target: DMPK; (-) strand; PAM type: YTN; PAM sequence: TTC
ccctcgctgtctctcgcccc

SEQ ID NO: 15947 - DNA, 20 bp, Artificial Sequence
  Description of Artificial Sequence: Synthetic oligonucleotide
  Target: DMPK; (-) strand; PAM type: YTN; PAM sequence: CTC
gattcccctcgctgtctctc

SEQ ID NO: 15948 - DNA, 20 bp, Artificial Sequence
  Description of Artificial Sequence: Synthetic oligonucleotide
  Target: DMPK; (-) strand; PAM type: YTN; PAM sequence: CTC
cccaacctcgattcccctcg

SEQ ID NO: 15949 - DNA, 20 bp, Artificial Sequence
  Description of Artificial Sequence: Synthetic oligonucleotide
  Target: DMPK; (-) strand; PAM type: YTN; PAM sequence: CTA
gataacctccccaacctcga

SEQ ID NO: 15950 - DNA, 20 bp, Artificial Sequence
  Description of Artificial Sequence: Synthetic oligonucleotide
  Target: DMPK; (-) strand; PAM type: YTN; PAM sequence: CTC
cctagataacctccccaacc

SEQ ID NO: 15951 - DNA, 20 bp, Artificial Sequence
  Description of Artificial Sequence: Synthetic oligonucleotide
  Target: DMPK; (-) strand; PAM type: YTN; PAM sequence: CTC
cgggatctccctagataacc

SEQ ID NO: 15952 - DNA, 20 bp, Artificial Sequence
  Description of Artificial Sequence: Synthetic oligonucleotide
  Target: DMPK; (-) strand; PAM type: YTN; PAM sequence: TTC
cctccgggatctccctagat

SEQ ID NO: 15953 - DNA, 20 bp, Artificial Sequence
  Description of Artificial Sequence: Synthetic oligonucleotide
  Target: DMPK; (-) strand; PAM type: YTN; PAM sequence: CTC
accagattccctccgggatc

SEQ ID NO: 15954 - DNA, 20 bp, Artificial Sequence
  Description of Artificial Sequence: Synthetic oligonucleotide
  Target: DMPK; (-) strand; PAM type: YTN; PAM sequence: TTC
aggcctcaccagattccctc

SEQ ID NO: 15955 - DNA, 20 bp, Artificial Sequence
  Description of Artificial Sequence: Synthetic oligonucleotide
  Target: DMPK; (-) strand; PAM type: YTN; PAM sequence: CTC
cgttcaggcctcaccagatt

SEQ ID NO: 15956 - DNA, 20 bp, Artificial Sequence
  Description of Artificial Sequence: Synthetic oligonucleotide
  Target: DMPK; (-) strand; PAM type: YTN; PAM sequence: CTC
cctccgttcaggcctcacca

SEQ ID NO: 15957 - DNA, 20 bp, Artificial Sequence
  Description of Artificial Sequence: Synthetic oligonucleotide
  Target: DMPK; (-) strand; PAM type: YTN; PAM sequence: TTC
agccccagatctccctccgt

SEQ ID NO: 15958 - DNA, 20 bp, Artificial Sequence
  Description of Artificial Sequence: Synthetic oligonucleotide
  Target: DMPK; (-) strand; PAM type: YTN; PAM sequence: TTA
ttcagccccagatctccctc

SEQ ID NO: 15959 - DNA, 20 bp, Artificial Sequence
  Description of Artificial Sequence: Synthetic oligonucleotide
  Target: DMPK; (-) strand; PAM type: YTN; PAM sequence: TTT
attcagccccagatctccct

SEQ ID NO: 15960 - DNA, 20 bp, Artificial Sequence
  Description of Artificial Sequence: Synthetic oligonucleotide
  Target: DMPK; (-) strand; PAM type: YTN; PAM sequence: CTT
tattcagccccagatctccc

SEQ ID NO: 15961 - DNA, 20 bp, Artificial Sequence
  Description of Artificial Sequence: Synthetic oligonucleotide
  Target: DMPK; (-) strand; PAM type: YTN; PAM sequence: TTA
gagggcagaagccctttatt

SEQ ID NO: 15962 - DNA, 20 bp, Artificial Sequence
  Description of Artificial Sequence: Synthetic oligonucleotide
  Target: DMPK; (-) strand; PAM type: YTN; PAM sequence: TTT
agagggcagaagccctttat

SEQ ID NO: 15963 - DNA, 20 bp, Artificial Sequence
  Description of Artificial Sequence: Synthetic oligonucleotide
  Target: DMPK; (-) strand; PAM type: YTN; PAM sequence: CTT
tagagggcagaagcccttta

SEQ ID NO: 15964 - DNA, 20 bp, Artificial Sequence
  Description of Artificial Sequence: Synthetic oligonucleotide
  Target: DMPK; (-) strand; PAM type: YTN; PAM sequence: TTG
cgactttagagggcagaagc

SEQ ID NO: 15965 - DNA, 20 bp, Artificial Sequence
  Description of Artificial Sequence: Synthetic oligonucleotide
  Target: DMPK; (-) strand; PAM type: YTN; PAM sequence: TTT
gcgactttagagggcagaag

SEQ ID NO: 15966 - DNA, 20 bp, Artificial Sequence
  Description of Artificial Sequence: Synthetic oligonucleotide
  Target: DMPK; (-) strand; PAM type: YTN; PAM sequence: CTT
tgcgactttagagggcagaa

SEQ ID NO: 15967 - DNA, 20 bp, Artificial Sequence
  Description of Artificial Sequence: Synthetic oligonucleotide
  Target: DMPK; (-) strand; PAM type: YTN; PAM sequence: CTA
cgtctttgcgactttagagg

SEQ ID NO: 15968 - DNA, 20 bp, Artificial Sequence
  Description of Artificial Sequence: Synthetic oligonucleotide
  Target: DMPK; (-) strand; PAM type: YTN; PAM sequence: CTC
accctacgtctttgcgactt

SEQ ID NO: 15969 - DNA, 20 bp, Artificial Sequence
  Description of Artificial Sequence: Synthetic oligonucleotide
  Target: DMPK; (-) strand; PAM type: YTN; PAM sequence: CTC
cccgtccagatatagggctc

SEQ ID NO: 15970 - DNA, 20 bp, Artificial Sequence
  Description of Artificial Sequence: Synthetic oligonucleotide
  Target: DMPK; (-) strand; PAM type: YTN; PAM sequence: CTG
gtctccccgtccagatatag

SEQ ID NO: 15971 - DNA, 20 bp, Artificial Sequence
  Description of Artificial Sequence: Synthetic oligonucleotide
  Target: DMPK; (-) strand; PAM type: YTN; PAM sequence: CTC
ctggtctccccgtccagata

SEQ ID NO: 15972 - DNA, 20 bp, Artificial Sequence
  Description of Artificial Sequence: Synthetic oligonucleotide
  Target: DMPK; (-) strand; PAM type: YTN; PAM sequence: CTG
gctcctggtctccccgtcca

SEQ ID NO: 15973 - DNA, 20 bp, Artificial Sequence
  Description of Artificial Sequence: Synthetic oligonucleotide
  Target: DMPK; (-) strand; PAM type: YTN; PAM sequence: CTC
cctggctcctggtctccccg

SEQ ID NO: 15974 - DNA, 20 bp, Artificial Sequence
  Description of Artificial Sequence: Synthetic oligonucleotide
  Target: DMPK; (-) strand; PAM type: YTN; PAM sequence: CTG
cagatcccctccctggctcc

SEQ ID NO: 15975 - DNA, 20 bp, Artificial Sequence
  Description of Artificial Sequence: Synthetic oligonucleotide
  Target: DMPK; (-) strand; PAM type: YTN; PAM sequence: TTC
tgcagatcccctccctggct

SEQ ID NO: 15976 - DNA, 20 bp, Artificial Sequence
  Description of Artificial Sequence: Synthetic oligonucleotide
  Target: DMPK; (-) strand; PAM type: YTN; PAM sequence: CTG
cccattctgcagatcccctc

SEQ ID NO: 15977 - DNA, 20 bp, Artificial Sequence
  Description of Artificial Sequence: Synthetic oligonucleotide
  Target: DMPK; (-) strand; PAM type: YTN; PAM sequence: CTG
ctgcccattctgcagatccc

SEQ ID NO: 15978 - DNA, 20 bp, Artificial Sequence
  Description of Artificial Sequence: Synthetic oligonucleotide
  Target: DMPK; (-) strand; PAM type: YTN; PAM sequence: CTC
agacctgctgcccattctgc

SEQ ID NO: 15979 - DNA, 20 bp, Artificial Sequence
  Description of Artificial Sequence: Synthetic oligonucleotide
  Target: DMPK; (-) strand; PAM type: YTN; PAM sequence: CTG
cctcagacctgctgcccatt

SEQ ID NO: 15980 - DNA, 20 bp, Artificial Sequence
  Description of Artificial Sequence: Synthetic oligonucleotide
  Target: DMPK; (-) strand; PAM type: YTN; PAM sequence: TTC
ccctgcctcagacctgctgc

SEQ ID NO: 15981 - DNA, 20 bp, Artificial Sequence
  Description of Artificial Sequence: Synthetic oligonucleotide
  Target: DMPK; (-) strand; PAM type: YTN; PAM sequence: TTT
cccctgcctcagacctgctg

SEQ ID NO: 15982 - DNA, 20 bp, Artificial Sequence
  Description of Artificial Sequence: Synthetic oligonucleotide
  Target: DMPK; (-) strand; PAM type: YTN; PAM sequence: CTT
tcccctgcctcagacctgct

SEQ ID NO: 15983 - DNA, 20 bp, Artificial Sequence
  Description of Artificial Sequence: Synthetic oligonucleotide
  Target: DMPK; (-) strand; PAM type: YTN; PAM sequence: CTC
tttcccctgcctcagacctg

SEQ ID NO: 15984 - DNA, 20 bp, Artificial Sequence
  Description of Artificial Sequence: Synthetic oligonucleotide
  Target: DMPK; (-) strand; PAM type: YTN; PAM sequence: CTC
tctttcccctgcctcagacc

SEQ ID NO: 15985 - DNA, 20 bp, Artificial Sequence
  Description of Artificial Sequence: Synthetic oligonucleotide
  Target: DMPK; (-) strand; PAM type: YTN; PAM sequence: TTC
ccatgtaagacccctctctt

SEQ ID NO: 15986 - DNA, 20 bp, Artificial Sequence
  Description of Artificial Sequence: Synthetic oligonucleotide
  Target: DMPK; (-) strand; PAM type: YTN; PAM sequence: CTT
cccatgtaagacccctctct

SEQ ID NO: 15987 - DNA, 20 bp, Artificial Sequence
  Description of Artificial Sequence: Synthetic oligonucleotide
  Target: DMPK; (-) strand; PAM type: YTN; PAM sequence: CTG
tcacgggggtccccagtccc

SEQ ID NO: 15988 - DNA, 20 bp, Artificial Sequence
  Description of Artificial Sequence: Synthetic oligonucleotide
  Target: DMPK; (-) strand; PAM type: YTN; PAM sequence: TTC
cagctgtcacgggggtcccc

SEQ ID NO: 15989 - DNA, 20 bp, Artificial Sequence
  Description of Artificial Sequence: Synthetic oligonucleotide
  Target: DMPK; (-) strand; PAM type: YTN; PAM sequence: CTT
ccagctgtcacgggggtccc

SEQ ID NO: 15990 - DNA, 20 bp, Artificial Sequence
  Description of Artificial Sequence: Synthetic oligonucleotide
  Target: DMPK; (-) strand; PAM type: YTN; PAM sequence: CTC
cttccagctgtcacgggggt

SEQ ID NO: 15991 - DNA, 20 bp, Artificial Sequence
  Description of Artificial Sequence: Synthetic oligonucleotide
  Target: DMPK; (-) strand; PAM type: YTN; PAM sequence: TTC
tccttccagctgtcacgggg

SEQ ID NO: 15992 - DNA, 20 bp, Artificial Sequence
  Description of Artificial Sequence: Synthetic oligonucleotide
  Target: DMPK; (-) strand; PAM type: YTN; PAM sequence: CTT
ctccttccagctgtcacggg

SEQ ID NO: 15993 - DNA, 20 bp, Artificial Sequence
  Description of Artificial Sequence: Synthetic oligonucleotide
  Target: DMPK; (-) strand; PAM type: YTN; PAM sequence: TTC
ttctccttccagctgtcacg

SEQ ID NO: 15994 - DNA, 20 bp, Artificial Sequence
  Description of Artificial Sequence: Synthetic oligonucleotide
  Target: DMPK; (-) strand; PAM type: YTN; PAM sequence: TTT
cttctccttccagctgtcac

SEQ ID NO: 15995 - DNA, 20 bp, Artificial Sequence
  Description of Artificial Sequence: Synthetic oligonucleotide
  Target: DMPK; (-) strand; PAM type: YTN; PAM sequence: CTT
tcttctccttccagctgtca

SEQ ID NO: 15996 - DNA, 20 bp, Artificial Sequence
  Description of Artificial Sequence: Synthetic oligonucleotide
  Target: DMPK; (-) strand; PAM type: YTN; PAM sequence: CTC
tttcttctccttccagctgt

SEQ ID NO: 15997 - DNA, 20 bp, Artificial Sequence
  Description of Artificial Sequence: Synthetic oligonucleotide
  Target: DMPK; (-) strand; PAM type: YTN; PAM sequence: CTA
tgcctctttcttctccttcc

SEQ ID NO: 15998 - DNA, 20 bp, Artificial Sequence
  Description of Artificial Sequence: Synthetic oligonucleotide
  Target: DMPK; (-) strand; PAM type: YTN; PAM sequence: CTC
cacgcgccctatgcctcttt

SEQ ID NO: 15999 - DNA, 20 bp, Artificial Sequence
  Description of Artificial Sequence: Synthetic oligonucleotide
  Target: DMPK; (-) strand; PAM type: YTN; PAM sequence: TTC
gcccctccacgcgccctatg

SEQ ID NO: 16000 - DNA, 20 bp, Artificial Sequence
  Description of Artificial Sequence: Synthetic oligonucleotide
  Target: DMPK; (-) strand; PAM type: YTN; PAM sequence: CTT
cgcccctccacgcgccctat

SEQ ID NO: 16001 - DNA, 20 bp, Artificial Sequence
  Description of Artificial Sequence: Synthetic oligonucleotide
  Target: DMPK; (-) strand; PAM type: YTN; PAM sequence: CTC
cttcgcccctccacgcgccc

SEQ ID NO: 16002 - DNA, 20 bp, Artificial Sequence
  Description of Artificial Sequence: Synthetic oligonucleotide
  Target: DMPK; (-) strand; PAM type: YTN; PAM sequence: CTG
gggcacgccgcgccaccgcc

SEQ ID NO: 16003 - DNA, 20 bp, Artificial Sequence
  Description of Artificial Sequence: Synthetic oligonucleotide
  Target: DMPK; (-) strand; PAM type: YTN; PAM sequence: CTG
gaggagggaagggacccacg

SEQ ID NO: 16004 - DNA, 20 bp, Artificial Sequence
  Description of Artificial Sequence: Synthetic oligonucleotide
  Target: DMPK; (-) strand; PAM type: YTN; PAM sequence: CTC
cgcggggcgtgtatagacac

SEQ ID NO: 16005 - DNA, 20 bp, Artificial Sequence
  Description of Artificial Sequence: Synthetic oligonucleotide
  Target: DMPK; (-) strand; PAM type: YTN; PAM sequence: CTG
ctccgcggggcgtgtataga

SEQ ID NO: 16006 - DNA, 20 bp, Artificial Sequence
  Description of Artificial Sequence: Synthetic oligonucleotide
  Target: DMPK; (-) strand; PAM type: YTN; PAM sequence: TTC
cccggaggaccgggaggagg

SEQ ID NO: 16007 - DNA, 20 bp, Artificial Sequence
  Description of Artificial Sequence: Synthetic oligonucleotide
  Target: DMPK; (-) strand; PAM type: YTN; PAM sequence: CTT
ccccggaggaccgggaggag

SEQ ID NO: 16008 - DNA, 20 bp, Artificial Sequence
  Description of Artificial Sequence: Synthetic oligonucleotide
  Target: DMPK; (-) strand; PAM type: YTN; PAM sequence: CTC
atgtgtccccttccccggag

SEQ ID NO: 16009 - DNA, 20 bp, Artificial Sequence
  Description of Artificial Sequence: Synthetic oligonucleotide
  Target: DMPK; (-) strand; PAM type: YTN; PAM sequence: CTG
caggcagagggagccacagg

SEQ ID NO: 16010 - DNA, 20 bp, Artificial Sequence
  Description of Artificial Sequence: Synthetic oligonucleotide
  Target: DMPK; (-) strand; PAM type: YTN; PAM sequence: TTG
ctgcaggcagagggagccac

SEQ ID NO: 16011 - DNA, 20 bp, Artificial Sequence
  Description of Artificial Sequence: Synthetic oligonucleotide
  Target: DMPK; (-) strand; PAM type: YTN; PAM sequence: TTG
caggagcggatggagttgct

SEQ ID NO: 16012 - DNA, 20 bp, Artificial Sequence
  Description of Artificial Sequence: Synthetic oligonucleotide
  Target: DMPK; (-) strand; PAM type: YTN; PAM sequence: CTA
gaggcacacgtccggcagtt

SEQ ID NO: 16013 - DNA, 20 bp, Artificial Sequence
  Description of Artificial Sequence: Synthetic oligonucleotide
  Target: DMPK; (-) strand; PAM type: YTN; PAM sequence: CTC
ggaaccgggacctagaggca

SEQ ID NO: 16014 - DNA, 20 bp, Artificial Sequence
  Description of Artificial Sequence: Synthetic oligonucleotide
  Target: DMPK; (-) strand; PAM type: YTN; PAM sequence: CTA
cgcgaggcagaggctcggaa

SEQ ID NO: 16015 - DNA, 20 bp, Artificial Sequence
  Description of Artificial Sequence: Synthetic oligonucleotide
  Target: DMPK; (-) strand; PAM type: YTN; PAM sequence: CTC
cccacagtcaactacgcgag

SEQ ID NO: 16016 - DNA, 20 bp, Artificial Sequence
  Description of Artificial Sequence: Synthetic oligonucleotide
  Target: DMPK; (-) strand; PAM type: YTN; PAM sequence: TTA
cctccccacagtcaactacg

SEQ ID NO: 16017 - DNA, 20 bp, Artificial Sequence
  Description of Artificial Sequence: Synthetic oligonucleotide
  Target: DMPK; (-) strand; PAM type: YTN; PAM sequence: CTT
acctccccacagtcaactac

SEQ ID NO: 16018 - DNA, 20 bp, Artificial Sequence
  Description of Artificial Sequence: Synthetic oligonucleotide
  Target: DMPK; (-) strand; PAM type: YTN; PAM sequence: CTC
accgtccttacctccccaca

SEQ ID NO: 16019 - DNA, 20 bp, Artificial Sequence
  Description of Artificial Sequence: Synthetic oligonucleotide
  Target: DMPK; (-) strand; PAM type: YTN; PAM sequence: CTC
gtccggcccggacggactca

SEQ ID NO: 16020 - DNA, 20 bp, Artificial Sequence
  Description of Artificial Sequence: Synthetic oligonucleotide
  Target: DMPK; (-) strand; PAM type: YTN; PAM sequence: CTC
tcgtccggcccggacggact

SEQ ID NO: 16021 - DNA, 20 bp, Artificial Sequence
  Description of Artificial Sequence: Synthetic oligonucleotide
  Target: DMPK; (-) strand; PAM type: YTN; PAM sequence: TTG
gcatcccctctcgtccggcc

SEQ ID NO: 16022 - DNA, 20 bp, Artificial Sequence
  Description of Artificial Sequence: Synthetic oligonucleotide
  Target: DMPK; (-) strand; PAM type: YTN; PAM sequence: CTT
ggcatcccctctcgtccggc

SEQ ID NO: 16023 - DNA, 20 bp, Artificial Sequence
  Description of Artificial Sequence: Synthetic oligonucleotide
  Target: DMPK; (-) strand; PAM type: YTN; PAM sequence: TTC
gccaggtcgggatcggggcc

SEQ ID NO: 16024 - DNA, 20 bp, Artificial Sequence
  Description of Artificial Sequence: Synthetic oligonucleotide
  Target: DMPK; (-) strand; PAM type: YTN; PAM sequence: CTT
cgccaggtcgggatcggggc

SEQ ID NO: 16025 - DNA, 20 bp, Artificial Sequence
  Description of Artificial Sequence: Synthetic oligonucleotide
  Target: DMPK; (-) strand; PAM type: YTN; PAM sequence: CTG
agccgggagatggaggccat

SEQ ID NO: 16026 - DNA, 20 bp, Artificial Sequence
  Description of Artificial Sequence: Synthetic oligonucleotide
  Target: DMPK; (-) strand; PAM type: YTN; PAM sequence: CTC
acccggcagagcctgagccg

SEQ ID NO: 16027 - DNA, 20 bp, Artificial Sequence
  Description of Artificial Sequence: Synthetic oligonucleotide
  Target: DMPK; (-) strand; PAM type: YTN; PAM sequence: CTG
gaggaggaggtgctcacccg

SEQ ID NO: 16028 - DNA, 20 bp, Artificial Sequence
  Description of Artificial Sequence: Synthetic oligonucleotide
  Target: DMPK; (-) strand; PAM type: YTN; PAM sequence: CTC
caggaagccctggaggagga

SEQ ID NO: 16029 - DNA, 20 bp, Artificial Sequence
  Description of Artificial Sequence: Synthetic oligonucleotide
  Target: DMPK; (-) strand; PAM type: YTN; PAM sequence: CTG
cgggagctccaggaagccct

SEQ ID NO: 16030 - DNA, 20 bp, Artificial Sequence
  Description of Artificial Sequence: Synthetic oligonucleotide
  Target: DMPK; (-) strand; PAM type: YTN; PAM sequence: CTG
aggccgaggtgacgctgcgg

SEQ ID NO: 16031 - DNA, 20 bp, Artificial Sequence
  Description of Artificial Sequence: Synthetic oligonucleotide
  Target: DMPK; (-) strand; PAM type: YTN; PAM sequence: CTG
cggcagaggctgaggccgag

SEQ ID NO: 16032 - DNA, 20 bp, Artificial Sequence
  Description of Artificial Sequence: Synthetic oligonucleotide
  Target: DMPK; (-) strand; PAM type: YTN; PAM sequence: CTG
tccctgcggcagaggctgag

SEQ ID NO: 16033 - DNA, 20 bp, Artificial Sequence
  Description of Artificial Sequence: Synthetic oligonucleotide
  Target: DMPK; (-) strand; PAM type: YTN; PAM sequence: TTC
cagcggctgtccctgcggca

SEQ ID NO: 16034 - DNA, 20 bp, Artificial Sequence
  Description of Artificial Sequence: Synthetic oligonucleotide
  Target: DMPK; (-) strand; PAM type: YTN; PAM sequence: CTG
aagtggcagttccagcggct

SEQ ID NO: 16035 - DNA, 20 bp, Artificial Sequence
  Description of Artificial Sequence: Synthetic oligonucleotide
  Target: DMPK; (-) strand; PAM type: YTN; PAM sequence: CTG
gtccccatacacaggctgaa

SEQ ID NO: 16036 - DNA, 20 bp, Artificial Sequence
  Description of Artificial Sequence: Synthetic oligonucleotide
  Target: DMPK; (-) strand; PAM type: YTN; PAM sequence: TTA
agcctggtccccatacacag

SEQ ID NO: 16037 - DNA, 20 bp, Artificial Sequence
  Description of Artificial Sequence: Synthetic oligonucleotide
  Target: DMPK; (-) strand; PAM type: YTN; PAM sequence: CTT
aagcctggtccccatacaca

SEQ ID NO: 16038 - DNA, 20 bp, Artificial Sequence
  Description of Artificial Sequence: Synthetic oligonucleotide
  Target: DMPK; (-) strand; PAM type: YTN; PAM sequence: TTC
caggagccacaggcagcctt

SEQ ID NO: 16039 - DNA, 20 bp, Artificial Sequence
  Description of Artificial Sequence: Synthetic oligonucleotide
  Target: DMPK; (-) strand; PAM type: YTN; PAM sequence: CTT
ccaggagccacaggcagcct

SEQ ID NO: 16040 - DNA, 20 bp, Artificial Sequence
  Description of Artificial Sequence: Synthetic oligonucleotide
  Target: DMPK; (-) strand; PAM type: YTN; PAM sequence: CTG
agtcttccaggagccacagg

SEQ ID NO: 16041 - DNA, 20 bp, Artificial Sequence
  Description of Artificial Sequence: Synthetic oligonucleotide
  Target: DMPK; (-) strand; PAM type: YTN; PAM sequence: CTG
gaaccagtgcccaagtcctg

SEQ ID NO: 16042 - DNA, 20 bp, Artificial Sequence
  Description of Artificial Sequence: Synthetic oligonucleotide
  Target: DMPK; (-) strand; PAM type: YTN; PAM sequence: CTA
gcctggaaccagtgcccaag

SEQ ID NO: 16043 - DNA, 20 bp, Artificial Sequence
  Description of Artificial Sequence: Synthetic oligonucleotide
  Target: DMPK; (-) strand; PAM type: YTN; PAM sequence: TTC
ctagcctggaaccagtgccc

SEQ ID NO: 16044 - DNA, 20 bp, Artificial Sequence
  Description of Artificial Sequence: Synthetic oligonucleotide
  Target: DMPK; (-) strand; PAM type: YTN; PAM sequence: TTG
aggggacggaggagtagggg

SEQ ID NO: 16045 - DNA, 20 bp, Artificial Sequence
  Description of Artificial Sequence: Synthetic oligonucleotide
  Target: DMPK; (-) strand; PAM type: YTN; PAM sequence: TTC
cagaaatgttgaggggacgg

SEQ ID NO: 16046 - DNA, 20 bp, Artificial Sequence
  Description of Artificial Sequence: Synthetic oligonucleotide
  Target: DMPK; (-) strand; PAM type: YTN; PAM sequence: CTA
tggggattccagaaatgttg

SEQ ID NO: 16047 - DNA, 20 bp, Artificial Sequence
  Description of Artificial Sequence: Synthetic oligonucleotide
  Target: DMPK; (-) strand; PAM type: YTN; PAM sequence: TTG
caggagctatggggattcca

SEQ ID NO: 16048 - DNA, 20 bp, Artificial Sequence
  Description of Artificial Sequence: Synthetic oligonucleotide
  Target: DMPK; (-) strand; PAM type: YTN; PAM sequence: TTG
gatcattgcaggagctatgg

SEQ ID NO: 16049 - DNA, 20 bp, Artificial Sequence
  Description of Artificial Sequence: Synthetic oligonucleotide
  Target: DMPK; (-) strand; PAM type: YTN; PAM sequence: CTT
ggatcattgcaggagctatg

SEQ ID NO: 16050 - DNA, 20 bp, Artificial Sequence
  Description of Artificial Sequence: Synthetic oligonucleotide
  Target: DMPK; (-) strand; PAM type: YTN; PAM sequence: CTG
agggaggtagggaagggagg

SEQ ID NO: 16051 - DNA, 20 bp, Artificial Sequence
  Description of Artificial Sequence: Synthetic oligonucleotide
  Target: DMPK; (-) strand; PAM type: YTN; PAM sequence: CTC
agggatggggctgagggagg

SEQ ID NO: 16052 - DNA, 20 bp, Artificial Sequence
  Description of Artificial Sequence: Synthetic oligonucleotide
  Target: DMPK; (-) strand; PAM type: YTN; PAM sequence: TTA
gaggaccagactcagggatg

SEQ ID NO: 16053 - DNA, 20 bp, Artificial Sequence
  Description of Artificial Sequence: Synthetic oligonucleotide
  Target: DMPK; (-) strand; PAM type: YTN; PAM sequence: TTT
agaggaccagactcagggat

SEQ ID NO: 16054 - DNA, 20 bp, Artificial Sequence
  Description of Artificial Sequence: Synthetic oligonucleotide
  Target: DMPK; (-) strand; PAM type: YTN; PAM sequence: CTG
tgtagatttagaggaccaga

SEQ ID NO: 16055 - DNA, 20 bp, Artificial Sequence
  Description of Artificial Sequence: Synthetic oligonucleotide
  Target: DMPK; (-) strand; PAM type: YTN; PAM sequence: CTG
gtccctgtgtagatttagag

SEQ ID NO: 16056 - DNA, 20 bp, Artificial Sequence
  Description of Artificial Sequence: Synthetic oligonucleotide
  Target: DMPK; (-) strand; PAM type: YTN; PAM sequence: CTC
tggtccctgtgtagatttag

SEQ ID NO: 16057 - DNA, 20 bp, Artificial Sequence
  Description of Artificial Sequence: Synthetic oligonucleotide
  Target: DMPK; (-) strand; PAM type: YTN; PAM sequence: TTG
agcaccagccctctggtccc

SEQ ID NO: 16058 - DNA, 20 bp, Artificial Sequence
  Description of Artificial Sequence: Synthetic oligonucleotide
  Target: DMPK; (-) strand; PAM type: YTN; PAM sequence: TTT
gagcaccagccctctggtcc

SEQ ID NO: 16059 - DNA, 20 bp, Artificial Sequence
  Description of Artificial Sequence: Synthetic oligonucleotide
  Target: DMPK; (-) strand; PAM type: YTN; PAM sequence: TTA
gtgtttgagcaccagccctc

SEQ ID NO: 16060 - DNA, 20 bp, Artificial Sequence
  Description of Artificial Sequence: Synthetic oligonucleotide
  Target: DMPK; (-) strand; PAM type: YTN; PAM sequence: TTG
tgttagtgtttgagcaccag

SEQ ID NO: 16061 - DNA, 20 bp, Artificial Sequence
  Description of Artificial Sequence: Synthetic oligonucleotide
  Target: DMPK; (-) strand; PAM type: YTN; PAM sequence: TTG
agcagcagagggacataggt

SEQ ID NO: 16062 - DNA, 20 bp, Artificial Sequence
  Description of Artificial Sequence: Synthetic oligonucleotide
  Target: DMPK; (-) strand; PAM type: YTN; PAM sequence: TTT
gagcagcagagggacatagg

SEQ ID NO: 16063 - DNA, 20 bp, Artificial Sequence
  Description of Artificial Sequence: Synthetic oligonucleotide
  Target: DMPK; (-) strand; PAM type: YTN; PAM sequence: TTT
tgagcagcagagggacatag

SEQ ID NO: 16064 - DNA, 20 bp, Artificial Sequence
  Description of Artificial Sequence: Synthetic oligonucleotide
  Target: DMPK; (-) strand; PAM type: YTN; PAM sequence: CTG
gagggattttgagcagcaga

SEQ ID NO: 16065 - DNA, 20 bp, Artificial Sequence
  Description of Artificial Sequence: Synthetic oligonucleotide
  Target: DMPK; (-) strand; PAM type: YTN; PAM sequence: TTA
gggagctggagggattttga

SEQ ID NO: 16066 - DNA, 20 bp, Artificial Sequence
  Description of Artificial Sequence: Synthetic oligonucleotide
  Target: DMPK; (-) strand; PAM type: YTN; PAM sequence: TTG
tcgtgagggcattagggagc

SEQ ID NO: 16067 - DNA, 20 bp, Artificial Sequence
  Description of Artificial Sequence: Synthetic oligonucleotide
  Target: DMPK; (-) strand; PAM type: YTN; PAM sequence: TTT
gtcgtgagggcattagggag

SEQ ID NO: 16068 - DNA, 20 bp, Artificial Sequence
  Description of Artificial Sequence: Synthetic oligonucleotide
  Target: DMPK; (-) strand; PAM type: YTN; PAM sequence: TTT
tgtcgtgagggcattaggga

SEQ ID NO: 16069 - DNA, 20 bp, Artificial Sequence
  Description of Artificial Sequence: Synthetic oligonucleotide
  Target: DMPK; (-) strand; PAM type: YTN; PAM sequence: CTT
ttgtcgtgagggcattaggg

SEQ ID NO: 16070 - DNA, 20 bp, Artificial Sequence
  Description of Artificial Sequence: Synthetic oligonucleotide
  Target: DMPK; (-) strand; PAM type: YTN; PAM sequence: CTG
gagaggccagcaggaaacaa

SEQ ID NO: 16071 - DNA, 20 bp, Artificial Sequence
  Description of Artificial Sequence: Synthetic oligonucleotide
  Target: DMPK; (-) strand; PAM type: YTN; PAM sequence: CTG
agaaggctggagaggccagc

SEQ ID NO: 16072 - DNA, 20 bp, Artificial Sequence
  Description of Artificial Sequence: Synthetic oligonucleotide
  Target: DMPK; (-) strand; PAM type: YTN; PAM sequence: TTC
ctgagaaggctggagaggcc

SEQ ID NO: 16073 - DNA, 20 bp, Artificial Sequence
  Description of Artificial Sequence: Synthetic oligonucleotide
  Target: DMPK; (-) strand; PAM type: YTN; PAM sequence: CTG
aatcattcctgagaaggctg

SEQ ID NO: 16074 - DNA, 20 bp, Artificial Sequence
  Description of Artificial Sequence: Synthetic oligonucleotide
  Target: DMPK; (-) strand; PAM type: YTN; PAM sequence: TTG
gctgaatcattcctgagaag

SEQ ID NO: 16075 - DNA, 20 bp, Artificial Sequence
  Description of Artificial Sequence: Synthetic oligonucleotide
  Target: DMPK; (-) strand; PAM type: YTN; PAM sequence: TTT
ggctgaatcattcctgagaa

SEQ ID NO: 16076 - DNA, 20 bp, Artificial Sequence
  Description of Artificial Sequence: Synthetic oligonucleotide
  Target: DMPK; (-) strand; PAM type: YTN; PAM sequence: CTG
aaaggtagtttggctgaatc

SEQ ID NO: 16077 - DNA, 20 bp, Artificial Sequence
  Description of Artificial Sequence: Synthetic oligonucleotide
  Target: DMPK; (-) strand; PAM type: YTN; PAM sequence: TTC
ctgaaaggtagtttggctga

SEQ ID NO: 16078 - DNA, 20 bp, Artificial Sequence
  Description of Artificial Sequence: Synthetic oligonucleotide
  Target: DMPK; (-) strand; PAM type: YTN; PAM sequence: TTG
ttcctgaaaggtagtttggc

SEQ ID NO: 16079 - DNA, 20 bp, Artificial Sequence
  Description of Artificial Sequence: Synthetic oligonucleotide
  Target: DMPK; (-) strand; PAM type: YTN; PAM sequence: TTT
gttcctgaaaggtagtttgg

SEQ ID NO: 16080 - DNA, 20 bp, Artificial Sequence
  Description of Artificial Sequence: Synthetic oligonucleotide
  Target: DMPK; (-) strand; PAM type: YTN; PAM sequence: CTG
atttgttcctgaaaggtagt

SEQ ID NO: 16081 - DNA, 20 bp, Artificial Sequence
  Description of Artificial Sequence: Synthetic oligonucleotide
  Target: DMPK; (-) strand; PAM type: YTN; PAM sequence: TTG
ggcaggtgggaatcctgatt

SEQ ID NO: 16082 - DNA, 20 bp, Artificial Sequence
  Description of Artificial Sequence: Synthetic oligonucleotide
  Target: DMPK; (-) strand; PAM type: YTN; PAM sequence: CTT
gggcaggtgggaatcctgat

SEQ ID NO: 16083 - DNA, 20 bp, Artificial Sequence
  Description of Artificial Sequence: Synthetic oligonucleotide
  Target: DMPK; (-) strand; PAM type: YTN; PAM sequence: CTC
cagggcaaaggccttgggca

SEQ ID NO: 16084 - DNA, 20 bp, Artificial Sequence
  Description of Artificial Sequence: Synthetic oligonucleotide
  Target: DMPK; (-) strand; PAM type: YTN; PAM sequence: CTG
gtgaaggagaaacaagccat

SEQ ID NO: 16085 - DNA, 20 bp, Artificial Sequence
  Description of Artificial Sequence: Synthetic oligonucleotide
  Target: DMPK; (-) strand; PAM type: YTN; PAM sequence: CTG
agcgctggtgaaggagaaac

SEQ ID NO: 16086 - DNA, 20 bp, Artificial Sequence
  Description of Artificial Sequence: Synthetic oligonucleotide
  Target: DMPK; (-) strand; PAM type: YTN; PAM sequence: TTG
agctgagcgctggtgaagga

SEQ ID NO: 16087 - DNA, 20 bp, Artificial Sequence
  Description of Artificial Sequence: Synthetic oligonucleotide
  Target: DMPK; (-) strand; PAM type: YTN; PAM sequence: TTT
gagctgagcgctggtgaagg

SEQ ID NO: 16088 - DNA, 20 bp, Artificial Sequence
  Description of Artificial Sequence: Synthetic oligonucleotide
  Target: DMPK; (-) strand; PAM type: YTN; PAM sequence: CTT
tgagctgagcgctggtgaag

SEQ ID NO: 16089 - DNA, 20 bp, Artificial Sequence
  Description of Artificial Sequence: Synthetic oligonucleotide
  Target: DMPK; (-) strand; PAM type: YTN; PAM sequence: CTG
agaagtcgatctttgagctg

SEQ ID NO: 16090 - DNA, 20 bp, Artificial Sequence
  Description of Artificial Sequence: Synthetic oligonucleotide
  Target: DMPK; (-) strand; PAM type: YTN; PAM sequence: CTG
gggatctgagaagtcgatct

SEQ ID NO: 16091 - DNA, 20 bp, Artificial Sequence
  Description of Artificial Sequence: Synthetic oligonucleotide
  Target: DMPK; (-) strand; PAM type: YTN; PAM sequence: TTG
ctggggatctgagaagtcga

SEQ ID NO: 16092 - DNA, 20 bp, Artificial Sequence
  Description of Artificial Sequence: Synthetic oligonucleotide
  Target: DMPK; (-) strand; PAM type: YTN; PAM sequence: TTA
agtaagggtgtgtgtgttgc

SEQ ID NO: 16093 - DNA, 20 bp, Artificial Sequence
  Description of Artificial Sequence: Synthetic oligonucleotide
  Target: DMPK; (-) strand; PAM type: YTN; PAM sequence: TTA
cagtggggcattaagtaagg

SEQ ID NO: 16094 - DNA, 20 bp, Artificial Sequence
  Description of Artificial Sequence: Synthetic oligonucleotide
  Target: DMPK; (-) strand; PAM type: YTN; PAM sequence: CTG
tagttacagtggggcattaa

SEQ ID NO: 16095 - DNA, 20 bp, Artificial Sequence
  Description of Artificial Sequence: Synthetic oligonucleotide
  Target: DMPK; (-) strand; PAM type: YTN; PAM sequence: CTC
tgtagttacagtggggcatt

SEQ ID NO: 16096 - DNA, 20 bp, Artificial Sequence
  Description of Artificial Sequence: Synthetic oligonucleotide
  Target: DMPK; (-) strand; PAM type: YTN; PAM sequence: TTC
agacatgggacggtctctgt

SEQ ID NO: 16097 - DNA, 20 bp, Artificial Sequence
  Description of Artificial Sequence: Synthetic oligonucleotide
  Target: DMPK; (-) strand; PAM type: YTN; PAM sequence: CTT
cagacatgggacggtctctg

SEQ ID NO: 16098 - DNA, 20 bp, Artificial Sequence
  Description of Artificial Sequence: Synthetic oligonucleotide
  Target: DMPK; (-) strand; PAM type: YTN; PAM sequence: TTA
cttcagacatgggacggtct

SEQ ID NO: 16099 - DNA, 20 bp, Artificial Sequence
  Description of Artificial Sequence: Synthetic oligonucleotide
  Target: DMPK; (-) strand; PAM type: YTN; PAM sequence: CTG
aacagaagcagacagaaacc

SEQ ID NO: 16100 - DNA, 20 bp, Artificial Sequence
  Description of Artificial Sequence: Synthetic oligonucleotide
  Target: DMPK; (-) strand; PAM type: YTN; PAM sequence: TTC
ctgaacagaagcagacagaa

SEQ ID NO: 16101 - DNA, 20 bp, Artificial Sequence
  Description of Artificial Sequence: Synthetic oligonucleotide
  Target: DMPK; (-) strand; PAM type: YTN; PAM sequence: CTT
cctgaacagaagcagacaga

SEQ ID NO: 16102 - DNA, 20 bp, Artificial Sequence
  Description of Artificial Sequence: Synthetic oligonucleotide
  Target: DMPK; (-) strand; PAM type: YTN; PAM sequence: CTA
gggacttcctgaacagaagc

SEQ ID NO: 16103 - DNA, 20 bp, Artificial Sequence
  Description of Artificial Sequence: Synthetic oligonucleotide
  Target: DMPK; (-) strand; PAM type: YTN; PAM sequence: CTC
tagggacttcctgaacagaa

SEQ ID NO: 16104 - DNA, 20 bp, Artificial Sequence
  Description of Artificial Sequence: Synthetic oligonucleotide
  Target: DMPK; (-) strand; PAM type: YTN; PAM sequence: CTG
tagagccctctagggacttc

SEQ ID NO: 16105 - DNA, 20 bp, Artificial Sequence
  Description of Artificial Sequence: Synthetic oligonucleotide
  Target: DMPK; (-) strand; PAM type: YTN; PAM sequence: TTC
ccgggtggcgtgcactgtag

SEQ ID NO: 16106 - DNA, 20 bp, Artificial Sequence
  Description of Artificial Sequence: Synthetic oligonucleotide
  Target: DMPK; (-) strand; PAM type: YTN; PAM sequence: CTT
cccgggtggcgtgcactgta

SEQ ID NO: 16107 - DNA, 20 bp, Artificial Sequence
  Description of Artificial Sequence: Synthetic oligonucleotide
  Target: DMPK; (-) strand; PAM type: YTN; PAM sequence: TTG
ggagagaaaaggtgagggct

SEQ ID NO: 16108 - DNA, 20 bp, Artificial Sequence
  Description of Artificial Sequence: Synthetic oligonucleotide
  Target: DMPK; (-) strand; PAM type: YTN; PAM sequence: TTG
gtggaggggagggggtccgt

SEQ ID NO: 16109 - DNA, 20 bp, Artificial Sequence
  Description of Artificial Sequence: Synthetic oligonucleotide
  Target: DMPK; (-) strand; PAM type: YTN; PAM sequence: CTC
ggtgtccccacaggatgaaa

SEQ ID NO: 16110 - DNA, 20 bp, Artificial Sequence
  Description of Artificial Sequence: Synthetic oligonucleotide
  Target: DMPK; (-) strand; PAM type: YTN; PAM sequence: CTG
gagccctcggtgtccccaca

SEQ ID NO: 16111 - DNA, 20 bp, Artificial Sequence
  Description of Artificial Sequence: Synthetic oligonucleotide
  Target: DMPK; (-) strand; PAM type: YTN; PAM sequence: TTG
agccacacgtgcaagcgccc

SEQ ID NO: 16112 - DNA, 20 bp, Artificial Sequence
  Description of Artificial Sequence: Synthetic oligonucleotide
  Target: DMPK; (-) strand; PAM type: YTN; PAM sequence: CTT
gagccacacgtgcaagcgcc

SEQ ID NO: 16113 - DNA, 20 bp, Artificial Sequence
  Description of Artificial Sequence: Synthetic oligonucleotide
  Target: DMPK; (-) strand; PAM type: YTN; PAM sequence: CTG
cttgagccacacgtgcaagc

SEQ ID NO: 16114 - DNA, 20 bp, Artificial Sequence
  Description of Artificial Sequence: Synthetic oligonucleotide
  Target: DMPK; (-) strand; PAM type: YTN; PAM sequence: CTG
gaggccgagcagctgcttga

SEQ ID NO: 16115 - DNA, 20 bp, Artificial Sequence
  Description of Artificial Sequence: Synthetic oligonucleotide
  Target: DMPK; (-) strand; PAM type: YTN; PAM sequence: CTC
cccagggacagtgaggtccc

SEQ ID NO: 16116 - DNA, 20 bp, Artificial Sequence
  Description of Artificial Sequence: Synthetic oligonucleotide
  Target: DMPK; (-) strand; PAM type: YTN; PAM sequence: CTC
tccccagggacagtgaggtc

SEQ ID NO: 16117 - DNA, 20 bp, Artificial Sequence
  Description of Artificial Sequence: Synthetic oligonucleotide
  Target: DMPK; (-) strand; PAM type: YTN; PAM sequence: CTC
ctctccccagggacagtgag

SEQ ID NO: 16118 - DNA, 20 bp, Artificial Sequence
  Description of Artificial Sequence: Synthetic oligonucleotide
  Target: DMPK; (-) strand; PAM type: YTN; PAM sequence: CTC
ctcctctccccagggacagt

SEQ ID NO: 16119 - DNA, 20 bp, Artificial Sequence
  Description of Artificial Sequence: Synthetic oligonucleotide
  Target: DMPK; (-) strand; PAM type: YTN; PAM sequence: CTC
cctcctcctctccccaggga

SEQ ID NO: 16120 - DNA, 20 bp, Artificial Sequence
  Description of Artificial Sequence: Synthetic oligonucleotide
  Target: DMPK; (-) strand; PAM type: YTN; PAM sequence: CTC
cccactccctcctcctctcc

SEQ ID NO: 16121 - DNA, 20 bp, Artificial Sequence
  Description of Artificial Sequence: Synthetic oligonucleotide
  Target: DMPK; (-) strand; PAM type: YTN; PAM sequence: CTC
cctccccactccctcctcct

SEQ ID NO: 16122 - DNA, 20 bp, Artificial Sequence
  Description of Artificial Sequence: Synthetic oligonucleotide
  Target: DMPK; (-) strand; PAM type: YTN; PAM sequence: CTG
tctccctccccactccctcc

SEQ ID NO: 16123 - DNA, 20 bp, Artificial Sequence
  Description of Artificial Sequence: Synthetic oligonucleotide
  Target: DMPK; (-) strand; PAM type: YTN; PAM sequence: TTC
tgtctccctccccactccct

SEQ ID NO: 16124 - DNA, 20 bp, Artificial Sequence
  Description of Artificial Sequence: Synthetic oligonucleotide
  Target: DMPK; (-) strand; PAM type: YTN; PAM sequence: CTC
caccagagaatcagcattct

SEQ ID NO: 16125 - DNA, 20 bp, Artificial Sequence
  Description of Artificial Sequence: Synthetic oligonucleotide
  Target: DMPK; (-) strand; PAM type: YTN; PAM sequence: TTC
tccaccagagaatcagcatt

SEQ ID NO: 16126 - DNA, 20 bp, Artificial Sequence
  Description of Artificial Sequence: Synthetic oligonucleotide
  Target: DMPK; (-) strand; PAM type: YTN; PAM sequence: CTG
gttctccaccagagaatcag

SEQ ID NO: 16127 - DNA, 20 bp, Artificial Sequence
  Description of Artificial Sequence: Synthetic oligonucleotide
  Target: DMPK; (-) strand; PAM type: YTN; PAM sequence: TTC
tggttctccaccagagaatc

SEQ ID NO: 16128 - DNA, 20 bp, Artificial Sequence
  Description of Artificial Sequence: Synthetic oligonucleotide
  Target: DMPK; (-) strand; PAM type: YTN; PAM sequence: CTA
cccacaggccagaagttctg

SEQ ID NO: 16129 - DNA, 20 bp, Artificial Sequence
  Description of Artificial Sequence: Synthetic oligonucleotide
  Target: DMPK; (-) strand; PAM type: YTN; PAM sequence: CTG
cccctacccacaggccagaa

SEQ ID NO: 16130 - DNA, 20 bp, Artificial Sequence
  Description of Artificial Sequence: Synthetic oligonucleotide
  Target: DMPK; (-) strand; PAM type: YTN; PAM sequence: TTG
gaagcagctgcccctaccca

SEQ ID NO: 16131 - DNA, 20 bp, Artificial Sequence
  Description of Artificial Sequence: Synthetic oligonucleotide
  Target: DMPK; (-) strand; PAM type: YTN; PAM sequence: CTT
ggaagcagctgcccctaccc

SEQ ID NO: 16132 - DNA, 20 bp, Artificial Sequence
  Description of Artificial Sequence: Synthetic oligonucleotide
  Target: DMPK; (-) strand; PAM type: YTN; PAM sequence: CTC
aaatcaggaggtcttggaag

SEQ ID NO: 16133 - DNA, 20 bp, Artificial Sequence
  Description of Artificial Sequence: Synthetic oligonucleotide
  Target: DMPK; (-) strand; PAM type: YTN; PAM sequence: TTC
ctcaaatcaggaggtcttgg

SEQ ID NO: 16134 - DNA, 20 bp, Artificial Sequence
  Description of Artificial Sequence: Synthetic oligonucleotide
  Target: DMPK; (-) strand; PAM type: YTN; PAM sequence: CTT
cctcaaatcaggaggtcttg

SEQ ID NO: 16135 - DNA, 20 bp, Artificial Sequence
  Description of Artificial Sequence: Synthetic oligonucleotide
  Target: DMPK; (-) strand; PAM type: YTN; PAM sequence: CTC
cccttcctcaaatcaggagg

SEQ ID NO: 16136 - DNA, 20 bp, Artificial Sequence
  Description of Artificial Sequence: Synthetic oligonucleotide
  Target: DMPK; (-) strand; PAM type: YTN; PAM sequence: CTG
ctccccttcctcaaatcagg

SEQ ID NO: 16137 - DNA, 20 bp, Artificial Sequence
  Description of Artificial Sequence: Synthetic oligonucleotide
  Target: DMPK; (-) strand; PAM type: YTN; PAM sequence: CTG
ctgctccccttcctcaaatc

SEQ ID NO: 16138 - DNA, 20 bp, Artificial Sequence
  Description of Artificial Sequence: Synthetic oligonucleotide
  Target: DMPK; (-) strand; PAM type: YTN; PAM sequence: CTC
tgctgctccccttcctcaaa

SEQ ID NO: 16139 - DNA, 20 bp, Artificial Sequence
  Description of Artificial Sequence: Synthetic oligonucleotide
  Target: DMPK; (-) strand; PAM type: YTN; PAM sequence: TTC
gctctgctgctccccttcct

SEQ ID NO: 16140 - DNA, 20 bp, Artificial Sequence
  Description of Artificial Sequence: Synthetic oligonucleotide
  Target: DMPK; (-) strand; PAM type: YTN; PAM sequence: CTT
cgctctgctgctccccttcc

SEQ ID NO: 16141 - DNA, 20 bp, Artificial Sequence
  Description of Artificial Sequence: Synthetic oligonucleotide
  Target: DMPK; (-) strand; PAM type: YTN; PAM sequence: CTC
ttcgctctgctgctcccctt

SEQ ID NO: 16142 - DNA, 20 bp, Artificial Sequence
  Description of Artificial Sequence: Synthetic oligonucleotide
  Target: DMPK; (-) strand; PAM type: YTN; PAM sequence: TTC
tcttcgctctgctgctcccc

SEQ ID NO: 16143 - DNA, 20 bp, Artificial Sequence
  Description of Artificial Sequence: Synthetic oligonucleotide
  Target: DMPK; (-) strand; PAM type: YTN; PAM sequence: CTG
ttctcttcgctctgctgctc

SEQ ID NO: 16144 - DNA, 20 bp, Artificial Sequence
  Description of Artificial Sequence: Synthetic oligonucleotide
  Target: DMPK; (-) strand; PAM type: YTN; PAM sequence: CTC
tgttctcttcgctctgctgc

SEQ ID NO: 16145 - DNA, 20 bp, Artificial Sequence
  Description of Artificial Sequence: Synthetic oligonucleotide
  Target: DMPK; (-) strand; PAM type: YTN; PAM sequence: CTG
ggactctgttctcttcgctc

SEQ ID NO: 16146 - DNA, 20 bp, Artificial Sequence
  Description of Artificial Sequence: Synthetic oligonucleotide
  Target: DMPK; (-) strand; PAM type: YTN; PAM sequence: CTA
cctgggactctgttctcttc

SEQ ID NO: 16147 - DNA, 20 bp, Artificial Sequence
  Description of Artificial Sequence: Synthetic oligonucleotide
  Target: DMPK; (-) strand; PAM type: YTN; PAM sequence: TTG
gcctacctgggactctgttc

SEQ ID NO: 16148 - DNA, 20 bp, Artificial Sequence
  Description of Artificial Sequence: Synthetic oligonucleotide
  Target: DMPK; (-) strand; PAM type: YTN; PAM sequence: CTA
ttggcctacctgggactctg

SEQ ID NO: 16149 - DNA, 20 bp, Artificial Sequence
  Description of Artificial Sequence: Synthetic oligonucleotide
  Target: DMPK; (-) strand; PAM type: YTN; PAM sequence: CTA
agcagaggaggggctattgg

SEQ ID NO: 16150 - DNA, 20 bp, Artificial Sequence
  Description of Artificial Sequence: Synthetic oligonucleotide
  Target: DMPK; (-) strand; PAM type: YTN; PAM sequence: TTC
ctaagcagaggaggggctat

SEQ ID NO: 16151 - DNA, 20 bp, Artificial Sequence
  Description of Artificial Sequence: Synthetic oligonucleotide
  Target: DMPK; (-) strand; PAM type: YTN; PAM sequence: TTT
cctaagcagaggaggggcta

SEQ ID NO: 16152 - DNA, 20 bp, Artificial Sequence
  Description of Artificial Sequence: Synthetic oligonucleotide
  Target: DMPK; (-) strand; PAM type: YTN; PAM sequence: TTT
tcctaagcagaggaggggct

SEQ ID NO: 16153 - DNA, 20 bp, Artificial Sequence
  Description of Artificial Sequence: Synthetic oligonucleotide
  Target: DMPK; (-) strand; PAM type: YTN; PAM sequence: CTT
ttcctaagcagaggaggggc

SEQ ID NO: 16154 - DNA, 20 bp, Artificial Sequence
  Description of Artificial Sequence: Synthetic oligonucleotide
  Target: DMPK; (-) strand; PAM type: YTN; PAM sequence: CTC
ccaggggcccaaggccagga

SEQ ID NO: 16155 - DNA, 20 bp, Artificial Sequence
  Description of Artificial Sequence: Synthetic oligonucleotide
  Target: DMPK; (-) strand; PAM type: YTN; PAM sequence: TTA
gaaagagcagctcccagggg

SEQ ID NO: 16156 - DNA, 20 bp, Artificial Sequence
  Description of Artificial Sequence: Synthetic oligonucleotide
  Target: DMPK; (-) strand; PAM type: YTN; PAM sequence: TTT
agaaagagcagctcccaggg

SEQ ID NO: 16157 - DNA, 20 bp, Artificial Sequence
  Description of Artificial Sequence: Synthetic oligonucleotide
  Target: DMPK; (-) strand; PAM type: YTN; PAM sequence: CTG
cagaaggtttagaaagagca

SEQ ID NO: 16158 - DNA, 20 bp, Artificial Sequence
  Description of Artificial Sequence: Synthetic oligonucleotide
  Target: DMPK; (-) strand; PAM type: YTN; PAM sequence: CTG
gaccccaagtccctgcagaa

SEQ ID NO: 16159 - DNA, 20 bp, Artificial Sequence
  Description of Artificial Sequence: Synthetic oligonucleotide
  Target: DMPK; (-) strand; PAM type: YTN; PAM sequence: CTA
gaacatgggggtctggaccc

SEQ ID NO: 16160 - DNA, 20 bp, Artificial Sequence
  Description of Artificial Sequence: Synthetic oligonucleotide
  Target: DMPK; (-) strand; PAM type: YTN; PAM sequence: CTG
accctagaacatgggggtct

SEQ ID NO: 16161 - DNA, 20 bp, Artificial Sequence
  Description of Artificial Sequence: Synthetic oligonucleotide
  Target: DMPK; (-) strand; PAM type: YTN; PAM sequence: CTG
cagcggtcacatgtcaaggg

SEQ ID NO: 16162 - DNA, 20 bp, Artificial Sequence
  Description of Artificial Sequence: Synthetic oligonucleotide
  Target: DMPK; (-) strand; PAM type: YTN; PAM sequence: CTG
agaagaggggtctgcagcgg

SEQ ID NO: 16163 - DNA, 20 bp, Artificial Sequence
  Description of Artificial Sequence: Synthetic oligonucleotide
  Target: DMPK; (-) strand; PAM type: YTN; PAM sequence: CTG
aggccctgagaagaggggtc

SEQ ID NO: 16164 - DNA, 20 bp, Artificial Sequence
  Description of Artificial Sequence: Synthetic oligonucleotide
  Target: DMPK; (-) strand; PAM type: YTN; PAM sequence: CTG
tcctgaggccctgagaagag

SEQ ID NO: 16165 - DNA, 20 bp, Artificial Sequence
  Description of Artificial Sequence: Synthetic oligonucleotide
  Target: DMPK; (-) strand; PAM type: YTN; PAM sequence: CTC
cctgtcctgaggccctgaga

SEQ ID NO: 16166 - DNA, 20 bp, Artificial Sequence
  Description of Artificial Sequence: Synthetic oligonucleotide
  Target: DMPK; (-) strand; PAM type: YTN; PAM sequence: CTC
cccatcaggtcggcctccct

SEQ ID NO: 16167 - DNA, 20 bp, Artificial Sequence
  Description of Artificial Sequence: Synthetic oligonucleotide
  Target: DMPK; (-) strand; PAM type: YTN; PAM sequence: CTG
tggaggtggccagagccaag

SEQ ID NO: 16168 - DNA, 20 bp, Artificial Sequence
  Description of Artificial Sequence: Synthetic oligonucleotide
  Target: DMPK; (-) strand; PAM type: YTN; PAM sequence: TTA
ggaccacatctgtggaggtg

SEQ ID NO: 16169 - DNA, 20 bp, Artificial Sequence
  Description of Artificial Sequence: Synthetic oligonucleotide
  Target: DMPK; (-) strand; PAM type: YTN; PAM sequence: CTT
aggaccacatctgtggaggt

SEQ ID NO: 16170 - DNA, 20 bp, Artificial Sequence
  Description of Artificial Sequence: Synthetic oligonucleotide
  Target: DMPK; (-) strand; PAM type: YTN; PAM sequence: TTG
gggtcccatgcccagtctta

SEQ ID NO: 16171 - DNA, 20 bp, Artificial Sequence
  Description of Artificial Sequence: Synthetic oligonucleotide
  Target: DMPK; (-) strand; PAM type: YTN; PAM sequence: CTT
ggggtcccatgcccagtctt

SEQ ID NO: 16172 - DNA, 20 bp, Artificial Sequence
  Description of Artificial Sequence: Synthetic oligonucleotide
  Target: DMPK; (-) strand; PAM type: YTN; PAM sequence: TTG
ccatcttggggtcccatgcc

SEQ ID NO: 16173 - DNA, 20 bp, Artificial Sequence
  Description of Artificial Sequence: Synthetic oligonucleotide
  Target: DMPK; (-) strand; PAM type: YTN; PAM sequence: CTC
aagttgccatcttggggtcc

SEQ ID NO: 16174 - DNA, 20 bp, Artificial Sequence
  Description of Artificial Sequence: Synthetic oligonucleotide
  Target: DMPK; (-) strand; PAM type: YTN; PAM sequence: CTG
acctcaagttgccatcttgg

SEQ ID NO: 16175 - DNA, 20 bp, Artificial Sequence
  Description of Artificial Sequence: Synthetic oligonucleotide
  Target: DMPK; (-) strand; PAM type: YTN; PAM sequence: CTG
agtggggtgtgctgacctca

SEQ ID NO: 16176 - DNA, 20 bp, Artificial Sequence
  Description of Artificial Sequence: Synthetic oligonucleotide
  Target: DMPK; (-) strand; PAM type: YTN; PAM sequence: TTC
ccacagctgagtggggtgtg

SEQ ID NO: 16177 - DNA, 20 bp, Artificial Sequence
  Description of Artificial Sequence: Synthetic oligonucleotide
  Target: DMPK; (-) strand; PAM type: YTN; PAM sequence: CTT
cccacagctgagtggggtgt

SEQ ID NO: 16178 - DNA, 20 bp, Artificial Sequence
  Description of Artificial Sequence: Synthetic oligonucleotide
  Target: DMPK; (-) strand; PAM type: YTN; PAM sequence: CTG
tccccttcccacagctgagt

SEQ ID NO: 16179 - DNA, 20 bp, Artificial Sequence
  Description of Artificial Sequence: Synthetic oligonucleotide
  Target: DMPK; (-) strand; PAM type: YTN; PAM sequence: TTC
ataccccagggaggagctgt

SEQ ID NO: 16180 - DNA, 20 bp, Artificial Sequence
  Description of Artificial Sequence: Synthetic oligonucleotide
  Target: DMPK; (-) strand; PAM type: YTN; PAM sequence: CTT
cataccccagggaggagctg

SEQ ID NO: 16181 - DNA, 20 bp, Artificial Sequence
  Description of Artificial Sequence: Synthetic oligonucleotide
  Target: DMPK; (-) strand; PAM type: YTN; PAM sequence: TTG
gaggggacagccacttcata

SEQ ID NO: 16182 - DNA, 20 bp, Artificial Sequence
  Description of Artificial Sequence: Synthetic oligonucleotide
  Target: DMPK; (-) strand; PAM type: YTN; PAM sequence: CTG
ggttggaggggacagccact

SEQ ID NO: 16183 - DNA, 20 bp, Artificial Sequence
  Description of Artificial Sequence: Synthetic oligonucleotide
  Target: DMPK; (-) strand; PAM type: YTN; PAM sequence: CTG
ctgggttggaggggacagcc

SEQ ID NO: 16184 - DNA, 20 bp, Artificial Sequence
  Description of Artificial Sequence: Synthetic oligonucleotide
  Target: DMPK; (-) strand; PAM type: YTN; PAM sequence: TTC
ccacaggagggactgctggg

SEQ ID NO: 16185 - DNA, 20 bp, Artificial Sequence
  Description of Artificial Sequence: Synthetic oligonucleotide
  Target: DMPK; (-) strand; PAM type: YTN; PAM sequence: CTG
agccgtgttcccacaggagg

SEQ ID NO: 16186 - DNA, 20 bp, Artificial Sequence
  Description of Artificial Sequence: Synthetic oligonucleotide
  Target: DMPK; (-) strand; PAM type: YTN; PAM sequence: CTA
ggtcctgagccgtgttccca

SEQ ID NO: 16187 - DNA, 20 bp, Artificial Sequence
  Description of Artificial Sequence: Synthetic oligonucleotide
  Target: DMPK; (-) strand; PAM type: YTN; PAM sequence: TTA
gaacccaggcgcatgtccag

SEQ ID NO: 16188 - DNA, 20 bp, Artificial Sequence
  Description of Artificial Sequence: Synthetic oligonucleotide
  Target: DMPK; (-) strand; PAM type: YTN; PAM sequence: CTA
ttagaacccaggcgcatgtc

SEQ ID NO: 16189 - DNA, 20 bp, Artificial Sequence
  Description of Artificial Sequence: Synthetic oligonucleotide
  Target: DMPK; (-) strand; PAM type: YTN; PAM sequence: CTC
tattagaacccaggcgcatg

SEQ ID NO: 16190 - DNA, 20 bp, Artificial Sequence
  Description of Artificial Sequence: Synthetic oligonucleotide
  Target: DMPK; (-) strand; PAM type: YTN; PAM sequence: TTG
aacccatcctctattagaac

SEQ ID NO: 16191 - DNA, 20 bp, Artificial Sequence
  Description of Artificial Sequence: Synthetic oligonucleotide
  Target: DMPK; (-) strand; PAM type: YTN; PAM sequence: CTG
aacggtgggtcaggattgaa

SEQ ID NO: 16192 - DNA, 20 bp, Artificial Sequence
  Description of Artificial Sequence: Synthetic oligonucleotide
  Target: DMPK; (-) strand; PAM type: YTN; PAM sequence: CTG
cggggcctgaacggtgggtc

SEQ ID NO: 16193 - DNA, 20 bp, Artificial Sequence
  Description of Artificial Sequence: Synthetic oligonucleotide
  Target: DMPK; (-) strand; PAM type: YTN; PAM sequence: CTG
aaccgctgcggggcctgaac

SEQ ID NO: 16194 - DNA, 20 bp, Artificial Sequence
  Description of Artificial Sequence: Synthetic oligonucleotide
  Target: DMPK; (-) strand; PAM type: YTN; PAM sequence: TTC
tgaaccgctgcggggcctga

SEQ ID NO: 16195 - DNA, 20 bp, Artificial Sequence
  Description of Artificial Sequence: Synthetic oligonucleotide
  Target: DMPK; (-) strand; PAM type: YTN; PAM sequence: TTG
attctgaaccgctgcggggc

SEQ ID NO: 16196 - DNA, 20 bp, Artificial Sequence
  Description of Artificial Sequence: Synthetic oligonucleotide
  Target: DMPK; (-) strand; PAM type: YTN; PAM sequence: CTT
gattctgaaccgctgcgggg

SEQ ID NO: 16197 - DNA, 20 bp, Artificial Sequence
  Description of Artificial Sequence: Synthetic oligonucleotide
  Target: DMPK; (-) strand; PAM type: YTN; PAM sequence: CTC
cagcttgattctgaaccgct

SEQ ID NO: 16198 - DNA, 20 bp, Artificial Sequence
  Description of Artificial Sequence: Synthetic oligonucleotide
  Target: DMPK; (-) strand; PAM type: YTN; PAM sequence: TTA
atgaactccagcttgattct

SEQ ID NO: 16199 - DNA, 20 bp, Artificial Sequence
  Description of Artificial Sequence: Synthetic oligonucleotide
  Target: DMPK; (-) strand; PAM type: YTN; PAM sequence: TTA
tcattaatgaactccagctt

SEQ ID NO: 16200 - DNA, 20 bp, Artificial Sequence
  Description of Artificial Sequence: Synthetic oligonucleotide
  Target: DMPK; (-) strand; PAM type: YTN; PAM sequence: CTT
atcattaatgaactccagct

SEQ ID NO: 16201 - DNA, 20 bp, Artificial Sequence
  Description of Artificial Sequence: Synthetic oligonucleotide
  Target: DMPK; (-) strand; PAM type: YTN; PAM sequence: CTA
taccttatcattaatgaact

SEQ ID NO: 16202 - DNA, 20 bp, Artificial Sequence
  Description of Artificial Sequence: Synthetic oligonucleotide
  Target: DMPK; (-) strand; PAM type: YTN; PAM sequence: TTA
cacatactataccttatcat

SEQ ID NO: 16203 - DNA, 20 bp, Artificial Sequence
  Description of Artificial Sequence: Synthetic oligonucleotide
  Target: DMPK; (-) strand; PAM type: YTN; PAM sequence: CTG
gacaacattacacatactat

SEQ ID NO: 16204 - DNA, 20 bp, Artificial Sequence
  Description of Artificial Sequence: Synthetic oligonucleotide
  Target: DMPK; (-) strand; PAM type: YTN; PAM sequence: TTA
ctggacaacattacacatac

SEQ ID NO: 16205 - DNA, 20 bp, Artificial Sequence
  Description of Artificial Sequence: Synthetic oligonucleotide
  Target: DMPK; (-) strand; PAM type: YTN; PAM sequence: TTA
ttactggacaacattacaca

SEQ ID NO: 16206 - DNA, 20 bp, Artificial Sequence
  Description of Artificial Sequence: Synthetic oligonucleotide
  Target: DMPK; (-) strand; PAM type: YTN; PAM sequence: TTT
attactggacaacattacac

SEQ ID NO: 16207 - DNA, 20 bp, Artificial Sequence
  Description of Artificial Sequence: Synthetic oligonucleotide
  Target: DMPK; (-) strand; PAM type: YTN; PAM sequence: TTT
tattactggacaacattaca

SEQ ID NO: 16208 - DNA, 20 bp, Artificial Sequence
  Description of Artificial Sequence: Synthetic oligonucleotide
  Target: DMPK; (-) strand; PAM type: YTN; PAM sequence: CTT
ttattactggacaacattac

SEQ ID NO: 16209 - DNA, 20 bp, Artificial Sequence
  Description of Artificial Sequence: Synthetic oligonucleotide
  Target: DMPK; (-) strand; PAM type: YTN; PAM sequence: CTA
gtcagcttttattactggac

SEQ ID NO: 16210 - DNA, 20 bp, Artificial Sequence
  Description of Artificial Sequence: Synthetic oligonucleotide
  Target: DMPK; (-) strand; PAM type: YTN; PAM sequence: TTC
tagtcagcttttattactgg

SEQ ID NO: 16211 - DNA, 20 bp, Artificial Sequence
  Description of Artificial Sequence: Synthetic oligonucleotide
  Target: DMPK; (-) strand; PAM type: YTN; PAM sequence: TTT
ctagtcagcttttattactg

SEQ ID NO: 16212 - DNA, 20 bp, Artificial Sequence
  Description of Artificial Sequence: Synthetic oligonucleotide
  Target: DMPK; (-) strand; PAM type: YTN; PAM sequence: TTT
tctagtcagcttttattact

SEQ ID NO: 16213 - DNA, 20 bp, Artificial Sequence
  Description of Artificial Sequence: Synthetic oligonucleotide
  Target: DMPK; (-) strand; PAM type: YTN; PAM sequence: TTG
gttttctagtcagcttttat

SEQ ID NO: 16214 - DNA, 20 bp, Artificial Sequence
  Description of Artificial Sequence: Synthetic oligonucleotide
  Target: DMPK; (-) strand; PAM type: YTN; PAM sequence: CTA
agagaacagttggttttcta

SEQ ID NO: 16215 - DNA, 20 bp, Artificial Sequence
  Description of Artificial Sequence: Synthetic oligonucleotide
  Target: DMPK; (-) strand; PAM type: YTN; PAM sequence: TTG
tctaagagaacagttggttt

SEQ ID NO: 16216 - DNA, 20 bp, Artificial Sequence
  Description of Artificial Sequence: Synthetic oligonucleotide
  Target: DMPK; (-) strand; PAM type: YTN; PAM sequence: TTT
gtctaagagaacagttggtt

SEQ ID NO: 16217 - DNA, 20 bp, Artificial Sequence
  Description of Artificial Sequence: Synthetic oligonucleotide
  Target: DMPK; (-) strand; PAM type: YTN; PAM sequence: CTT
tgtctaagagaacagttggt

SEQ ID NO: 16218 - DNA, 20 bp, Artificial Sequence
  Description of Artificial Sequence: Synthetic oligonucleotide
  Target: DMPK; (-) strand; PAM type: YTN; PAM sequence: CTA
ctttgtctaagagaacagtt

SEQ ID NO: 16219 - DNA, 20 bp, Artificial Sequence
  Description of Artificial Sequence: Synthetic oligonucleotide
  Target: DMPK; (-) strand; PAM type: YTN; PAM sequence: CTC
atgctactttgtctaagaga

SEQ ID NO: 16220 - DNA, 20 bp, Artificial Sequence
  Description of Artificial Sequence: Synthetic oligonucleotide
  Target: DMPK; (-) strand; PAM type: YTN; PAM sequence: TTC
ctcatgctactttgtctaag

SEQ ID NO: 16221 - DNA, 20 bp, Artificial Sequence
  Description of Artificial Sequence: Synthetic oligonucleotide
  Target: DMPK; (-) strand; PAM type: YTN; PAM sequence: CTT
cctcatgctactttgtctaa

SEQ ID NO: 16222 - DNA, 20 bp, Artificial Sequence
  Description of Artificial Sequence: Synthetic oligonucleotide
  Target: DMPK; (-) strand; PAM type: YTN; PAM sequence: TTC
cccttcctcatgctactttg

SEQ ID NO: 16223 - DNA, 20 bp, Artificial Sequence
  Description of Artificial Sequence: Synthetic oligonucleotide
  Target: DMPK; (-) strand; PAM type: YTN; PAM sequence: TTT
ccccttcctcatgctacttt

SEQ ID NO: 16224 - DNA, 20 bp, Artificial Sequence
  Description of Artificial Sequence: Synthetic oligonucleotide
  Target: DMPK; (-) strand; PAM type: YTN; PAM sequence: TTT
tccccttcctcatgctactt

SEQ ID NO: 16225 - DNA, 20 bp, Artificial Sequence
  Description of Artificial Sequence: Synthetic oligonucleotide
  Target: DMPK; (-) strand; PAM type: YTN; PAM sequence: TTT
ttccccttcctcatgctact

SEQ ID NO: 16226 - DNA, 20 bp, Artificial Sequence
  Description of Artificial Sequence: Synthetic oligonucleotide
  Target: DMPK; (-) strand; PAM type: YTN; PAM sequence: TTT
tttccccttcctcatgctac

SEQ ID NO: 16227 - DNA, 20 bp, Artificial Sequence
  Description of Artificial Sequence: Synthetic oligonucleotide
  Target: DMPK; (-) strand; PAM type: YTN; PAM sequence: TTT
ttttccccttcctcatgcta

SEQ ID NO: 16228 - DNA, 20 bp, Artificial Sequence
  Description of Artificial Sequence: Synthetic oligonucleotide
  Target: DMPK; (-) strand; PAM type: YTN; PAM sequence: TTG
tttttttccccttcctcatg

SEQ ID NO: 16229 - DNA, 20 bp, Artificial Sequence
  Description of Artificial Sequence: Synthetic oligonucleotide
  Target: DMPK; (-) strand; PAM type: YTN; PAM sequence: TTT
gtttttttccccttcctcat

SEQ ID NO: 16230 - DNA, 20 bp, Artificial Sequence
  Description of Artificial Sequence: Synthetic oligonucleotide
  Target: DMPK; (-) strand; PAM type: YTN; PAM sequence: TTG
gtttgtttttttccccttcc

SEQ ID NO: 16231 - DNA, 20 bp, Artificial Sequence
  Description of Artificial Sequence: Synthetic oligonucleotide
  Target: DMPK; (-) strand; PAM type: YTN; PAM sequence: TTT
ggtttgtttttttccccttc

SEQ ID NO: 16232 - DNA, 20 bp, Artificial Sequence
  Description of Artificial Sequence: Synthetic oligonucleotide
  Target: DMPK; (-) strand; PAM type: YTN; PAM sequence: TTT
tggtttgtttttttcccctt

SEQ ID NO: 16233 - DNA, 20 bp, Artificial Sequence
  Description of Artificial Sequence: Synthetic oligonucleotide
  Target: DMPK; (-) strand; PAM type: YTN; PAM sequence: TTT
ttggtttgtttttttcccct

SEQ ID NO: 16234 - DNA, 20 bp, Artificial Sequence
  Description of Artificial Sequence: Synthetic oligonucleotide
  Target: DMPK; (-) strand; PAM type: YTN; PAM sequence: TTT
tttggtttgtttttttcccc

SEQ ID NO: 16235 - DNA, 20 bp, Artificial Sequence
  Description of Artificial Sequence: Synthetic oligonucleotide
  Target: DMPK; (-) strand; PAM type: YTN; PAM sequence: TTT
ttttggtttgtttttttccc

SEQ ID NO: 16236 - DNA, 20 bp, Artificial Sequence
  Description of Artificial Sequence: Synthetic oligonucleotide
  Target: DMPK; (-) strand; PAM type: YTN; PAM sequence: TTA
aatagtggagaacaggtgtt

SEQ ID NO: 16237 - DNA, 20 bp, Artificial Sequence
  Description of Artificial Sequence: Synthetic oligonucleotide
  Target: DMPK; (-) strand; PAM type: YTN; PAM sequence: TTT
aaatagtggagaacaggtgt

SEQ ID NO: 16238 - DNA, 20 bp, Artificial Sequence
  Description of Artificial Sequence: Synthetic oligonucleotide
  Target: DMPK; (-) strand; PAM type: YTN; PAM sequence: CTG
acacatgtttaaatagtgga

SEQ ID NO: 16239 - DNA, 20 bp, Artificial Sequence
  Description of Artificial Sequence: Synthetic oligonucleotide
  Target: DMPK; (-) strand; PAM type: YTN; PAM sequence: CTC
acacgtgtactgacacatgt

SEQ ID NO: 16240 - DNA, 20 bp, Artificial Sequence
  Description of Artificial Sequence: Synthetic oligonucleotide
  Target: DMPK; (-) strand; PAM type: YTN; PAM sequence: CTG
gctcacacgtgtactgacac

SEQ ID NO: 16241 - DNA, 20 bp, Artificial Sequence
  Description of Artificial Sequence: Synthetic oligonucleotide
  Target: DMPK; (-) strand; PAM type: YTN; PAM sequence: CTC
accagatggcagtggtccct

SEQ ID NO: 16242 - DNA, 20 bp, Artificial Sequence
  Description of Artificial Sequence: Synthetic oligonucleotide
  Target: DMPK; (-) strand; PAM type: YTN; PAM sequence: CTC
gtgagctcaccagatggcag

SEQ ID NO: 16243 - DNA, 20 bp, Artificial Sequence
  Description of Artificial Sequence: Synthetic oligonucleotide
  Target: DMPK; (-) strand; PAM type: YTN; PAM sequence: TTG
atatctcgtgagctcaccag

SEQ ID NO: 16244 - DNA, 20 bp, Artificial Sequence
  Description of Artificial Sequence: Synthetic oligonucleotide
  Target: DMPK; (-) strand; PAM type: YTN; PAM sequence: TTA
gaaaatacagataaggaaaa

SEQ ID NO: 16245 - DNA, 20 bp, Artificial Sequence
  Description of Artificial Sequence: Synthetic oligonucleotide
  Target: DMPK; (-) strand; PAM type: YTN; PAM sequence: TTA
tcacaagtaaattagaaaat

SEQ ID NO: 16246 - DNA, 20 bp, Artificial Sequence
  Description of Artificial Sequence: Synthetic oligonucleotide
  Target: DMPK; (-) strand; PAM type: YTN; PAM sequence: CTT
atcacaagtaaattagaaaa

SEQ ID NO: 16247 - DNA, 20 bp, Artificial Sequence
  Description of Artificial Sequence: Synthetic oligonucleotide
  Target: DMPK; (-) strand; PAM type: YTN; PAM sequence: TTG
cttatcacaagtaaattaga

SEQ ID NO: 16248 - DNA, 20 bp, Artificial Sequence
  Description of Artificial Sequence: Synthetic oligonucleotide
  Target: DMPK; (-) strand; PAM type: YTN; PAM sequence: TTA
cacaaataatgcattgctta

SEQ ID NO: 16249 - DNA, 20 bp, Artificial Sequence
  Description of Artificial Sequence: Synthetic oligonucleotide
  Target: DMPK; (-) strand; PAM type: YTN; PAM sequence: TTA
attacacaaataatgcattg

SEQ ID NO: 16250 - DNA, 20 bp, Artificial Sequence
  Description of Artificial Sequence: Synthetic oligonucleotide
  Target: DMPK; (-) strand; PAM type: YTN; PAM sequence: CTC
aacaaaagtattaattacac

SEQ ID NO: 16251 - DNA, 20 bp, Artificial Sequence
  Description of Artificial Sequence: Synthetic oligonucleotide
  Target: DMPK; (-) strand; PAM type: YTN; PAM sequence: CTG
gtctcaacaaaagtattaat

SEQ ID NO: 16252 - DNA, 20 bp, Artificial Sequence
  Description of Artificial Sequence: Synthetic oligonucleotide
  Target: DMPK; (-) strand; PAM type: YTN; PAM sequence: CTA
ggcaacaaagtgagacctgg

SEQ ID NO: 16253 - DNA, 20 bp, Artificial Sequence
  Description of Artificial Sequence: Synthetic oligonucleotide
  Target: DMPK; (-) strand; PAM type: YTN; PAM sequence: TTC
cagcctaggcaacaaagtga

SEQ ID NO: 16254 - DNA, 20 bp, Artificial Sequence
  Description of Artificial Sequence: Synthetic oligonucleotide
  Target: DMPK; (-) strand; PAM type: YTN; PAM sequence: TTC
agtgagccatgatagattcc

SEQ ID NO: 16255 - DNA, 20 bp, Artificial Sequence
  Description of Artificial Sequence: Synthetic oligonucleotide
  Target: DMPK; (-) strand; PAM type: YTN; PAM sequence: CTT
cagtgagccatgatagattc

SEQ ID NO: 16256 - DNA, 20 bp, Artificial Sequence
  Description of Artificial Sequence: Synthetic oligonucleotide
  Target: DMPK; (-) strand; PAM type: YTN; PAM sequence: TTG
aggcttcagtgagccatgat

SEQ ID NO: 16257 - DNA, 20 bp, Artificial Sequence
  Description of Artificial Sequence: Synthetic oligonucleotide
  Target: DMPK; (-) strand; PAM type: YTN; PAM sequence: TTT
gaggcttcagtgagccatga

SEQ ID NO: 16258 - DNA, 20 bp, Artificial Sequence
  Description of Artificial Sequence: Synthetic oligonucleotide
  Target: DMPK; (-) strand; PAM type: YTN; PAM sequence: CTG
gagtttgaggcttcagtgag

SEQ ID NO: 16259 - DNA, 20 bp, Artificial Sequence
  Description of Artificial Sequence: Synthetic oligonucleotide
  Target: DMPK; (-) strand; PAM type: YTN; PAM sequence: TTG
agcctggagtttgaggcttc

SEQ ID NO: 16260 - DNA, 20 bp, Artificial Sequence
  Description of Artificial Sequence: Synthetic oligonucleotide
  Target: DMPK; (-) strand; PAM type: YTN; PAM sequence: CTT
gagcctggagtttgaggctt

SEQ ID NO: 16261 - DNA, 20 bp, Artificial Sequence
  Description of Artificial Sequence: Synthetic oligonucleotide
  Target: DMPK; (-) strand; PAM type: YTN; PAM sequence: CTG
aagtaggagaatcacttgag

SEQ ID NO: 16262 - DNA, 20 bp, Artificial Sequence
  Description of Artificial Sequence: Synthetic oligonucleotide
  Target: DMPK; (-) strand; PAM type: YTN; PAM sequence: CTC
aggagtctgaagtaggagaa

SEQ ID NO: 16263 - DNA, 20 bp, Artificial Sequence
  Description of Artificial Sequence: Synthetic oligonucleotide
  Target: DMPK; (-) strand; PAM type: YTN; PAM sequence: CTA
ctcaggagtctgaagtagga

SEQ ID NO: 16264 - DNA, 20 bp, Artificial Sequence
  Description of Artificial Sequence: Synthetic oligonucleotide
  Target: DMPK; (-) strand; PAM type: YTN; PAM sequence: CTA
gctactcaggagtctgaagt

SEQ ID NO: 16265 - DNA, 20 bp, Artificial Sequence
  Description of Artificial Sequence: Synthetic oligonucleotide
  Target: DMPK; (-) strand; PAM type: YTN; PAM sequence: CTG
cagtcctagctactcaggag

SEQ ID NO: 16266 - DNA, 20 bp, Artificial Sequence
  Description of Artificial Sequence: Synthetic oligonucleotide
  Target: DMPK; (-) strand; PAM type: YTN; PAM sequence: CTG
tgcctgcagtcctagctact

SEQ ID NO: 16267 - DNA, 20 bp, Artificial Sequence
  Description of Artificial Sequence: Synthetic oligonucleotide
  Target: DMPK; (-) strand; PAM type: YTN; PAM sequence: TTG
aaaaaatcgtgccaggcatg

SEQ ID NO: 16268 - DNA, 20 bp, Artificial Sequence
  Description of Artificial Sequence: Synthetic oligonucleotide
  Target: DMPK; (-) strand; PAM type: YTN; PAM sequence: CTA
caaaaaattgaaaaaatcgt

SEQ ID NO: 16269 - DNA, 20 bp, Artificial Sequence
  Description of Artificial Sequence: Synthetic oligonucleotide
  Target: DMPK; (-) strand; PAM type: YTN; PAM sequence: CTC
tacaaaaaattgaaaaaatc

SEQ ID NO: 16270 - DNA, 20 bp, Artificial Sequence
  Description of Artificial Sequence: Synthetic oligonucleotide
  Target: DMPK; (-) strand; PAM type: YTN; PAM sequence: CTG
tctctacaaaaaattgaaaa

SEQ ID NO: 16271 - DNA, 20 bp, Artificial Sequence
  Description of Artificial Sequence: Synthetic oligonucleotide
  Target: DMPK; (-) strand; PAM type: YTN; PAM sequence: CTG
agcaacataatgagaccctg

SEQ ID NO: 16272 - DNA, 20 bp, Artificial Sequence
  Description of Artificial Sequence: Synthetic oligonucleotide
  Target: DMPK; (-) strand; PAM type: YTN; PAM sequence: TTC
aagaccagcctgagcaacat

SEQ ID NO: 16273 - DNA, 20 bp, Artificial Sequence
  Description of Artificial Sequence: Synthetic oligonucleotide
  Target: DMPK; (-) strand; PAM type: YTN; PAM sequence: TTC
agcccaggagttcaagacca

SEQ ID NO: 16274 - DNA, 20 bp, Artificial Sequence
  Description of Artificial Sequence: Synthetic oligonucleotide
  Target: DMPK; (-) strand; PAM type: YTN; PAM sequence: CTT
cagcccaggagttcaagacc

SEQ ID NO: 16275 - DNA, 20 bp, Artificial Sequence
  Description of Artificial Sequence: Synthetic oligonucleotide
  Target: DMPK; (-) strand; PAM type: YTN; PAM sequence: TTG
cttcagcccaggagttcaag

SEQ ID NO: 16276 - DNA, 20 bp, Artificial Sequence
  Description of Artificial Sequence: Synthetic oligonucleotide
  Target: DMPK; (-) strand; PAM type: YTN; PAM sequence: CTG
aagtggacggattgcttcag

SEQ ID NO: 16277 - DNA, 20 bp, Artificial Sequence
  Description of Artificial Sequence: Synthetic oligonucleotide
  Target: DMPK; (-) strand; PAM type: YTN; PAM sequence: TTG
ggaggctgaagtggacggat

SEQ ID NO: 16278 - DNA, 20 bp, Artificial Sequence
  Description of Artificial Sequence: Synthetic oligonucleotide
  Target: DMPK; (-) strand; PAM type: YTN; PAM sequence: TTT
gggaggctgaagtggacgga

SEQ ID NO: 16279 - DNA, 20 bp, Artificial Sequence
  Description of Artificial Sequence: Synthetic oligonucleotide
  Target: DMPK; (-) strand; PAM type: YTN; PAM sequence: CTT
tgggaggctgaagtggacgg

SEQ ID NO: 16280 - DNA, 20 bp, Artificial Sequence
  Description of Artificial Sequence: Synthetic oligonucleotide
  Target: DMPK; (-) strand; PAM type: YTN; PAM sequence: TTG
gaatcccagcactttgggag

SEQ ID NO: 16281 - DNA, 20 bp, Artificial Sequence
  Description of Artificial Sequence: Synthetic oligonucleotide
  Target: DMPK; (-) strand; PAM type: YTN; PAM sequence: CTT
ggaatcccagcactttggga

SEQ ID NO: 16282 - DNA, 20 bp, Artificial Sequence
  Description of Artificial Sequence: Synthetic oligonucleotide
  Target: DMPK; (-) strand; PAM type: YTN; PAM sequence: CTC
acgcttggaatcccagcact

SEQ ID NO: 16283 - DNA, 20 bp, Artificial Sequence
  Description of Artificial Sequence: Synthetic oligonucleotide
  Target: DMPK; (-) strand; PAM type: YTN; PAM sequence: CTG
ggcatggtggctcacgcttg

SEQ ID NO: 16284 - DNA, 20 bp, Artificial Sequence
  Description of Artificial Sequence: Synthetic oligonucleotide
  Target: DMPK; (-) strand; PAM type: YTN; PAM sequence: TTA
caggctgggcatggtggctc

SEQ ID NO: 16285 - DNA, 20 bp, Artificial Sequence
  Description of Artificial Sequence: Synthetic oligonucleotide
  Target: DMPK; (-) strand; PAM type: YTN; PAM sequence: TTT
acaggctgggcatggtggct

SEQ ID NO: 16286 - DNA, 20 bp, Artificial Sequence
  Description of Artificial Sequence: Synthetic oligonucleotide
  Target: DMPK; (-) strand; PAM type: YTN; PAM sequence: CTA
atttacaggctgggcatggt

SEQ ID NO: 16287 - DNA, 20 bp, Artificial Sequence
  Description of Artificial Sequence: Synthetic oligonucleotide
  Target: DMPK; (-) strand; PAM type: YTN; PAM sequence: CTC
aaaaaaaaaaaaaaaaaagt

SEQ ID NO: 16288 - DNA, 20 bp, Artificial Sequence
  Description of Artificial Sequence: Synthetic oligonucleotide
  Target: DMPK; (-) strand; PAM type: YTN; PAM sequence: TTC
atctcaaaaaaaaaaaaaaa

SEQ ID NO: 16289 - DNA, 20 bp, Artificial Sequence
  Description of Artificial Sequence: Synthetic oligonucleotide
  Target: DMPK; (-) strand; PAM type: YTN; PAM sequence: CTT
catctcaaaaaaaaaaaaaa

SEQ ID NO: 16290 - DNA, 20 bp, Artificial Sequence
  Description of Artificial Sequence: Synthetic oligonucleotide
  Target: DMPK; (-) strand; PAM type: YTN; PAM sequence: CTG
ggcaacaagagtgaaacttc

SEQ ID NO: 16291 - DNA, 20 bp, Artificial Sequence
  Description of Artificial Sequence: Synthetic oligonucleotide
  Target: DMPK; (-) strand; PAM type: YTN; PAM sequence: TTC
cagcctgggcaacaagagtg

SEQ ID NO: 16292 - DNA, 20 bp, Artificial Sequence
  Description of Artificial Sequence: Synthetic oligonucleotide
  Target: DMPK; (-) strand; PAM type: YTN; PAM sequence: TTG
cattccagcctgggcaacaa

SEQ ID NO: 16293 - DNA, 20 bp, Artificial Sequence
  Description of Artificial Sequence: Synthetic oligonucleotide
  Target: DMPK; (-) strand; PAM type: YTN; PAM sequence: CTG
agatcgtgccattgcattcc

SEQ ID NO: 16294 - DNA, 20 bp, Artificial Sequence
  Description of Artificial Sequence: Synthetic oligonucleotide
  Target: DMPK; (-) strand; PAM type: YTN; PAM sequence: TTG
tggtgagctgagatcgtgcc

SEQ ID NO: 16295 - DNA, 20 bp, Artificial Sequence
  Description of Artificial Sequence: Synthetic oligonucleotide
  Target: DMPK; (-) strand; PAM type: YTN; PAM sequence: CTG
aggcaggagaatcagaaccc

SEQ ID NO: 16296 - DNA, 20 bp, Artificial Sequence
  Description of Artificial Sequence: Synthetic oligonucleotide
  Target: DMPK; (-) strand; PAM type: YTN; PAM sequence: CTC
aggaggctgaggcaggagaa

SEQ ID NO: 16297 - DNA, 20 bp, Artificial Sequence
  Description of Artificial Sequence: Synthetic oligonucleotide
  Target: DMPK; (-) strand; PAM type: YTN; PAM sequence: CTA
ctcaggaggctgaggcagga

SEQ ID NO: 16298 - DNA, 20 bp, Artificial Sequence
  Description of Artificial Sequence: Synthetic oligonucleotide
  Target: DMPK; (-) strand; PAM type: YTN; PAM sequence: CTG
taatcccagctactcaggag

SEQ ID NO: 16299 - DNA, 20 bp, Artificial Sequence
  Description of Artificial Sequence: Synthetic oligonucleotide
  Target: DMPK; (-) strand; PAM type: YTN; PAM sequence: TTA
gccaggcgtggtggcatata

SEQ ID NO: 16300 - DNA, 20 bp, Artificial Sequence
  Description of Artificial Sequence: Synthetic oligonucleotide
  Target: DMPK; (-) strand; PAM type: YTN; PAM sequence: CTA
aaaaacaaaattagccaggc

SEQ ID NO: 16301 - DNA, 20 bp, Artificial Sequence
  Description of Artificial Sequence: Synthetic oligonucleotide
  Target: DMPK; (-) strand; PAM type: YTN; PAM sequence: CTA
ctaaaaaacaaaattagcca

SEQ ID NO: 16302 - DNA, 20 bp, Artificial Sequence
  Description of Artificial Sequence: Synthetic oligonucleotide
  Target: DMPK; (-) strand; PAM type: YTN; PAM sequence: CTC
tactaaaaaacaaaattagc

SEQ ID NO: 16303 - DNA, 20 bp, Artificial Sequence
  Description of Artificial Sequence: Synthetic oligonucleotide
  Target: DMPK; (-) strand; PAM type: YTN; PAM sequence: CTC
atctctactaaaaaacaaaa

SEQ ID NO: 16304 - DNA, 20 bp, Artificial Sequence
  Description of Artificial Sequence: Synthetic oligonucleotide
  Target: DMPK; (-) strand; PAM type: YTN; PAM sequence: CTG
accaacgtggagaaacctca

SEQ ID NO: 16305 - DNA, 20 bp, Artificial Sequence
  Description of Artificial Sequence: Synthetic oligonucleotide
  Target: DMPK; (-) strand; PAM type: YTN; PAM sequence: TTC
gagaccagcctgaccaacgt

SEQ ID NO: 16306 - DNA, 20 bp, Artificial Sequence
  Description of Artificial Sequence: Synthetic oligonucleotide
  Target: DMPK; (-) strand; PAM type: YTN; PAM sequence: CTG
aggtcaggagttcgagacca

SEQ ID NO: 16307 - DNA, 20 bp, Artificial Sequence
  Description of Artificial Sequence: Synthetic oligonucleotide
  Target: DMPK; (-) strand; PAM type: YTN; PAM sequence: TTG
ggaggatgaggtgggtggat

SEQ ID NO: 16308 - DNA, 20 bp, Artificial Sequence
  Description of Artificial Sequence: Synthetic oligonucleotide
  Target: DMPK; (-) strand; PAM type: YTN; PAM sequence: TTT
gggaggatgaggtgggtgga

SEQ ID NO: 16309 - DNA, 20 bp, Artificial Sequence
  Description of Artificial Sequence: Synthetic oligonucleotide
  Target: DMPK; (-) strand; PAM type: YTN; PAM sequence: CTT
tgggaggatgaggtgggtgg

SEQ ID NO: 16310 - DNA, 20 bp, Artificial Sequence
  Description of Artificial Sequence: Synthetic oligonucleotide
  Target: DMPK; (-) strand; PAM type: YTN; PAM sequence: TTC
cagtgctttgggaggatgag

SEQ ID NO: 16311 - DNA, 20 bp, Artificial Sequence
  Description of Artificial Sequence: Synthetic oligonucleotide
  Target: DMPK; (-) strand; PAM type: YTN; PAM sequence: CTG
taattccagtgctttgggag

SEQ ID NO: 16312 - DNA, 20 bp, Artificial Sequence
  Description of Artificial Sequence: Synthetic oligonucleotide
  Target: DMPK; (-) strand; PAM type: YTN; PAM sequence: CTC
acgcctgtaattccagtgct

SEQ ID NO: 16313 - DNA, 20 bp, Artificial Sequence
  Description of Artificial Sequence: Synthetic oligonucleotide
  Target: DMPK; (-) strand; PAM type: YTN; PAM sequence: TTA
ggccgggtgtggtggctcac

SEQ ID NO: 16314 - DNA, 20 bp, Artificial Sequence
  Description of Artificial Sequence: Synthetic oligonucleotide
  Target: DMPK; (-) strand; PAM type: YTN; PAM sequence: TTT
aggccgggtgtggtggctca

SEQ ID NO: 16315 - DNA, 20 bp, Artificial Sequence
  Description of Artificial Sequence: Synthetic oligonucleotide
  Target: DMPK; (-) strand; PAM type: YTN; PAM sequence: TTA
tttaggccgggtgtggtggc

SEQ ID NO: 16316 - DNA, 20 bp, Artificial Sequence
  Description of Artificial Sequence: Synthetic oligonucleotide
  Target: DMPK; (-) strand; PAM type: YTN; PAM sequence: TTT
atttaggccgggtgtggtgg

SEQ ID NO: 16317 - DNA, 20 bp, Artificial Sequence
  Description of Artificial Sequence: Synthetic oligonucleotide
  Target: DMPK; (-) strand; PAM type: YTN; PAM sequence: CTC
aaaaaaaaaaaaaaaaaagt

SEQ ID NO: 16318 - DNA, 20 bp, Artificial Sequence
  Description of Artificial Sequence: Synthetic oligonucleotide
  Target: DMPK; (-) strand; PAM type: YTN; PAM sequence: CTC
cgtctcaaaaaaaaaaaaaa

SEQ ID NO: 16319 - DNA, 20 bp, Artificial Sequence
  Description of Artificial Sequence: Synthetic oligonucleotide
  Target: DMPK; (-) strand; PAM type: YTN; PAM sequence: CTG
ggcgacagagcaagactccg

SEQ ID NO: 16320 - DNA, 20 bp, Artificial Sequence
  Description of Artificial Sequence: Synthetic oligonucleotide
  Target: DMPK; (-) strand; PAM type: YTN; PAM sequence: CTC
cagcctgggcgacagagcaa

SEQ ID NO: 16321 - DNA, 20 bp, Artificial Sequence
  Description of Artificial Sequence: Synthetic oligonucleotide
  Target: DMPK; (-) strand; PAM type: YTN; PAM sequence: CTG
cactccagcctgggcgacag

SEQ ID NO: 16322 - DNA, 20 bp, Artificial Sequence
  Description of Artificial Sequence: Synthetic oligonucleotide
  Target: DMPK; (-) strand; PAM type: YTN; PAM sequence: TTG
cagtgagccgagatcatgcc

SEQ ID NO: 16323 - DNA, 20 bp, Artificial Sequence
  Description of Artificial Sequence: Synthetic oligonucleotide
  Target: DMPK; (-) strand; PAM type: YTN; PAM sequence: CTT
gcagtgagccgagatcatgc

SEQ ID NO: 16324 - DNA, 20 bp, Artificial Sequence
  Description of Artificial Sequence: Synthetic oligonucleotide
  Target: DMPK; (-) strand; PAM type: YTN; PAM sequence: TTG
ggaggcgaggcaggagaatg

SEQ ID NO: 16325 - DNA, 20 bp, Artificial Sequence
  Description of Artificial Sequence: Synthetic oligonucleotide
  Target: DMPK; (-) strand; PAM type: YTN; PAM sequence: CTT
gggaggcgaggcaggagaat

SEQ ID NO: 16326 - DNA, 20 bp, Artificial Sequence
  Description of Artificial Sequence: Synthetic oligonucleotide
  Target: DMPK; (-) strand; PAM type: YTN; PAM sequence: CTA
cttgggaggcgaggcaggag

SEQ ID NO: 16327 - DNA, 20 bp, Artificial Sequence
  Description of Artificial Sequence: Synthetic oligonucleotide
  Target: DMPK; (-) strand; PAM type: YTN; PAM sequence: TTG
cggtcccagctacttgggag

SEQ ID NO: 16328 - DNA, 20 bp, Artificial Sequence
  Description of Artificial Sequence: Synthetic oligonucleotide
  Target: DMPK; (-) strand; PAM type: YTN; PAM sequence: CTT
gcggtcccagctacttggga

SEQ ID NO: 16329 - DNA, 20 bp, Artificial Sequence
  Description of Artificial Sequence: Synthetic oligonucleotide
  Target: DMPK; (-) strand; PAM type: YTN; PAM sequence: TTA
gccgggcatggtggcgggcg

SEQ ID NO: 16330 - DNA, 20 bp, Artificial Sequence
  Description of Artificial Sequence: Synthetic oligonucleotide
  Target: DMPK; (-) strand; PAM type: YTN; PAM sequence: CTA
aaaatacaaaaaaattagcc

SEQ ID NO: 16331 - DNA, 20 bp, Artificial Sequence
  Description of Artificial Sequence: Synthetic oligonucleotide
  Target: DMPK; (-) strand; PAM type: YTN; PAM sequence: CTA
ctaaaaatacaaaaaaatta

SEQ ID NO: 16332 - DNA, 20 bp, Artificial Sequence
  Description of Artificial Sequence: Synthetic oligonucleotide
  Target: DMPK; (-) strand; PAM type: YTN; PAM sequence: CTC
tactaaaaatacaaaaaaat

SEQ ID NO: 16333 - DNA, 20 bp, Artificial Sequence
  Description of Artificial Sequence: Synthetic oligonucleotide
  Target: DMPK; (-) strand; PAM type: YTN; PAM sequence: CTA
acacggtgaaaccccgtctc

SEQ ID NO: 16334 - DNA, 20 bp, Artificial Sequence
  Description of Artificial Sequence: Synthetic oligonucleotide
  Target: DMPK; (-) strand; PAM type: YTN; PAM sequence: CTG
gctaacacggtgaaaccccg

SEQ ID NO: 16335 - DNA, 20 bp, Artificial Sequence
  Description of Artificial Sequence: Synthetic oligonucleotide
  Target: DMPK; (-) strand; PAM type: YTN; PAM sequence: TTG
ggaggccaaggcaggtggat

SEQ ID NO: 16336 - DNA, 20 bp, Artificial Sequence
  Description of Artificial Sequence: Synthetic oligonucleotide
  Target: DMPK; (-) strand; PAM type: YTN; PAM sequence: TTT
gggaggccaaggcaggtgga

SEQ ID NO: 16337 - DNA, 20 bp, Artificial Sequence
  Description of Artificial Sequence: Synthetic oligonucleotide
  Target: DMPK; (-) strand; PAM type: YTN; PAM sequence: CTT
tgggaggccaaggcaggtgg

SEQ ID NO: 16338 - DNA, 20 bp, Artificial Sequence
  Description of Artificial Sequence: Synthetic oligonucleotide
  Target: DMPK; (-) strand; PAM type: YTN; PAM sequence: CTA
gcactttgggaggccaaggc

SEQ ID NO: 16339 - DNA, 20 bp, Artificial Sequence
  Description of Artificial Sequence: Synthetic oligonucleotide
  Target: DMPK; (-) strand; PAM type: YTN; PAM sequence: CTG
taatcctagcactttgggag

SEQ ID NO: 16340 - DNA, 20 bp, Artificial Sequence
  Description of Artificial Sequence: Synthetic oligonucleotide
  Target: DMPK; (-) strand; PAM type: YTN; PAM sequence: CTC
acgcctgtaatcctagcact

SEQ ID NO: 16341 - DNA, 20 bp, Artificial Sequence
  Description of Artificial Sequence: Synthetic oligonucleotide
  Target: DMPK; (-) strand; PAM type: YTN; PAM sequence: TTA
ggcgggccgcggtggctcac

SEQ ID NO: 16342 - DNA, 20 bp, Artificial Sequence
  Description of Artificial Sequence: Synthetic oligonucleotide
  Target: DMPK; (-) strand; PAM type: YTN; PAM sequence: TTT
aggcgggccgcggtggctca

SEQ ID NO: 16343 - DNA, 20 bp, Artificial Sequence
  Description of Artificial Sequence: Synthetic oligonucleotide
  Target: DMPK; (-) strand; PAM type: YTN; PAM sequence: TTA
atttaggcgggccgcggtgg

SEQ ID NO: 16344 - DNA, 20 bp, Artificial Sequence
  Description of Artificial Sequence: Synthetic oligonucleotide
  Target: DMPK; (-) strand; PAM type: YTN; PAM sequence: TTA
aaagtattaatttaggcggg

SEQ ID NO: 16345 - DNA, 20 bp, Artificial Sequence
  Description of Artificial Sequence: Synthetic oligonucleotide
  Target: DMPK; (-) strand; PAM type: YTN; PAM sequence: TTT
aaaagtattaatttaggcgg

SEQ ID NO: 16346 - DNA, 20 bp, Artificial Sequence
  Description of Artificial Sequence: Synthetic oligonucleotide
  Target: DMPK; (-) strand; PAM type: YTN; PAM sequence: TTG
aatcagccatataacaataa

SEQ ID NO: 16347 - DNA, 20 bp, Artificial Sequence
  Description of Artificial Sequence: Synthetic oligonucleotide
  Target: DMPK; (-) strand; PAM type: YTN; PAM sequence: TTT
gaatcagccatataacaata

SEQ ID NO: 16348 - DNA, 20 bp, Artificial Sequence
  Description of Artificial Sequence: Synthetic oligonucleotide
  Target: DMPK; (-) strand; PAM type: YTN; PAM sequence: CTT
tgaatcagccatataacaat

SEQ ID NO: 16349 - DNA, 20 bp, Artificial Sequence
  Description of Artificial Sequence: Synthetic oligonucleotide
  Target: DMPK; (-) strand; PAM type: YTN; PAM sequence: TTC
tttgaatcagccatataaca

SEQ ID NO: 16350 - DNA, 20 bp, Artificial Sequence
  Description of Artificial Sequence: Synthetic oligonucleotide
  Target: DMPK; (-) strand; PAM type: YTN; PAM sequence: TTG
taaaagaatgcaaattcttt

SEQ ID NO: 16351 - DNA, 20 bp, Artificial Sequence
  Description of Artificial Sequence: Synthetic oligonucleotide
  Target: DMPK; (-) strand; PAM type: YTN; PAM sequence: TTA
caatcagttgtaaaagaatg

SEQ ID NO: 16352 - DNA, 20 bp, Artificial Sequence
  Description of Artificial Sequence: Synthetic oligonucleotide
  Target: DMPK; (-) strand; PAM type: YTN; PAM sequence: TTT
acaatcagttgtaaaagaat

SEQ ID NO: 16353 - DNA, 20 bp, Artificial Sequence
  Description of Artificial Sequence: Synthetic oligonucleotide
  Target: DMPK; (-) strand; PAM type: YTN; PAM sequence: TTT
tacaatcagttgtaaaagaa

SEQ ID NO: 16354 - DNA, 20 bp, Artificial Sequence
  Description of Artificial Sequence: Synthetic oligonucleotide
  Target: DMPK; (-) strand; PAM type: YTN; PAM sequence: CTT
ttacaatcagttgtaaaaga

SEQ ID NO: 16355 - DNA, 20 bp, Artificial Sequence
  Description of Artificial Sequence: Synthetic oligonucleotide
  Target: DMPK; (-) strand; PAM type: YTN; PAM sequence: TTA
gacttttacaatcagttgta

SEQ ID NO: 16356 - DNA, 20 bp, Artificial Sequence
  Description of Artificial Sequence: Synthetic oligonucleotide
  Target: DMPK; (-) strand; PAM type: YTN; PAM sequence: TTT
agacttttacaatcagttgt

SEQ ID NO: 16357 - DNA, 20 bp, Artificial Sequence
  Description of Artificial Sequence: Synthetic oligonucleotide
  Target: DMPK; (-) strand; PAM type: YTN; PAM sequence: TTG
gaaaatatgaagtttagact

SEQ ID NO: 16358 - DNA, 20 bp, Artificial Sequence
  Description of Artificial Sequence: Synthetic oligonucleotide
  Target: DMPK; (-) strand; PAM type: YTN; PAM sequence: CTT
ggaaaatatgaagtttagac

SEQ ID NO: 16359 - DNA, 20 bp, Artificial Sequence
  Description of Artificial Sequence: Synthetic oligonucleotide
  Target: DMPK; (-) strand; PAM type: YTN; PAM sequence: TTC
agaacttggaaaatatgaag

SEQ ID NO: 16360 - DNA, 20 bp, Artificial Sequence
  Description of Artificial Sequence: Synthetic oligonucleotide
  Target: DMPK; (-) strand; PAM type: YTN; PAM sequence: CTT
cagaacttggaaaatatgaa

SEQ ID NO: 16361 - DNA, 20 bp, Artificial Sequence
  Description of Artificial Sequence: Synthetic oligonucleotide
  Target: DMPK; (-) strand; PAM type: YTN; PAM sequence: CTG
tagtacacagagccacagga

SEQ ID NO: 16362 - DNA, 20 bp, Artificial Sequence
  Description of Artificial Sequence: Synthetic oligonucleotide
  Target: DMPK; (-) strand; PAM type: YTN; PAM sequence: TTA
cgtctgtagtacacagagcc

SEQ ID NO: 16363 - DNA, 20 bp, Artificial Sequence
  Description of Artificial Sequence: Synthetic oligonucleotide
  Target: DMPK; (-) strand; PAM type: YTN; PAM sequence: TTT
acgtctgtagtacacagagc

SEQ ID NO: 16364 - DNA, 20 bp, Artificial Sequence
  Description of Artificial Sequence: Synthetic oligonucleotide
  Target: DMPK; (-) strand; PAM type: YTN; PAM sequence: TTT
tacgtctgtagtacacagag

SEQ ID NO: 16365 - DNA, 20 bp, Artificial Sequence
  Description of Artificial Sequence: Synthetic oligonucleotide
  Target: DMPK; (-) strand; PAM type: YTN; PAM sequence: CTT
ttacgtctgtagtacacaga

SEQ ID NO: 16366 - DNA, 20 bp, Artificial Sequence
  Description of Artificial Sequence: Synthetic oligonucleotide
  Target: DMPK; (-) strand; PAM type: YTN; PAM sequence: TTA
acttttacgtctgtagtaca

SEQ ID NO: 16367 - DNA, 20 bp, Artificial Sequence
  Description of Artificial Sequence: Synthetic oligonucleotide
  Target: DMPK; (-) strand; PAM type: YTN; PAM sequence: TTG
taaccattaacttttacgtc

SEQ ID NO: 16368 - DNA, 20 bp, Artificial Sequence
  Description of Artificial Sequence: Synthetic oligonucleotide
  Target: DMPK; (-) strand; PAM type: YTN; PAM sequence: CTT
gtaaccattaacttttacgt

SEQ ID NO: 16369 - DNA, 20 bp, Artificial Sequence
  Description of Artificial Sequence: Synthetic oligonucleotide
  Target: DMPK; (-) strand; PAM type: YTN; PAM sequence: TTC
ccagaatcttgtaaccatta

SEQ ID NO: 16370 - DNA, 20 bp, Artificial Sequence
  Description of Artificial Sequence: Synthetic oligonucleotide
  Target: DMPK; (-) strand; PAM type: YTN; PAM sequence: CTT
cccagaatcttgtaaccatt

SEQ ID NO: 16371 - DNA, 20 bp, Artificial Sequence
  Description of Artificial Sequence: Synthetic oligonucleotide
  Target: DMPK; (-) strand; PAM type: YTN; PAM sequence: CTG
ggcttcccagaatcttgtaa

SEQ ID NO: 16372 - DNA, 20 bp, Artificial Sequence
  Description of Artificial Sequence: Synthetic oligonucleotide
  Target: DMPK; (-) strand; PAM type: YTN; PAM sequence: CTC
agagtcacagactgggcttc

SEQ ID NO: 16373 - DNA, 20 bp, Artificial Sequence
  Description of Artificial Sequence: Synthetic oligonucleotide
  Target: DMPK; (-) strand; PAM type: YTN; PAM sequence: TTA
aaacctcagagtcacagact

SEQ ID NO: 16374 - DNA, 20 bp, Artificial Sequence
  Description of Artificial Sequence: Synthetic oligonucleotide
  Target: DMPK; (-) strand; PAM type: YTN; PAM sequence: TTT
aaaacctcagagtcacagac

SEQ ID NO: 16375 - DNA, 20 bp, Artificial Sequence
  Description of Artificial Sequence: Synthetic oligonucleotide
  Target: DMPK; (-) strand; PAM type: YTN; PAM sequence: TTT
taaaacctcagagtcacaga

SEQ ID NO: 16376 - DNA, 20 bp, Artificial Sequence
  Description of Artificial Sequence: Synthetic oligonucleotide
  Target: DMPK; (-) strand; PAM type: YTN; PAM sequence: TTG
aattttaaaacctcagagtc

SEQ ID NO: 16377 - DNA, 20 bp, Artificial Sequence
  Description of Artificial Sequence: Synthetic oligonucleotide
  Target: DMPK; (-) strand; PAM type: YTN; PAM sequence: TTA
gattgaattttaaaacctca

SEQ ID NO: 16378 - DNA, 20 bp, Artificial Sequence
  Description of Artificial Sequence: Synthetic oligonucleotide
  Target: DMPK; (-) strand; PAM type: YTN; PAM sequence: TTC
aaaatgttagattgaatttt

SEQ ID NO: 16379 - DNA, 20 bp, Artificial Sequence
  Description of Artificial Sequence: Synthetic oligonucleotide
  Target: DMPK; (-) strand; PAM type: YTN; PAM sequence: CTT
caaaatgttagattgaattt

SEQ ID NO: 16380 - DNA, 20 bp, Artificial Sequence
  Description of Artificial Sequence: Synthetic oligonucleotide
  Target: DMPK; (-) strand; PAM type: YTN; PAM sequence: CTA
tgtacttcaaaatgttagat

SEQ ID NO: 16381 - DNA, 20 bp, Artificial Sequence
  Description of Artificial Sequence: Synthetic oligonucleotide
  Target: DMPK; (-) strand; PAM type: YTN; PAM sequence: TTC
agatctatgtacttcaaaat

SEQ ID NO: 16382 - DNA, 20 bp, Artificial Sequence
  Description of Artificial Sequence: Synthetic oligonucleotide
  Target: DMPK; (-) strand; PAM type: YTN; PAM sequence: TTT
cagatctatgtacttcaaaa

SEQ ID NO: 16383 - DNA, 20 bp, Artificial Sequence
  Description of Artificial Sequence: Synthetic oligonucleotide
  Target: DMPK; (-) strand; PAM type: YTN; PAM sequence: TTT
tcagatctatgtacttcaaa

SEQ ID NO: 16384 - DNA, 20 bp, Artificial Sequence
  Description of Artificial Sequence: Synthetic oligonucleotide
  Target: DMPK; (-) strand; PAM type: YTN; PAM sequence: TTA
aattttcagatctatgtact

SEQ ID NO: 16385 - DNA, 20 bp, Artificial Sequence
  Description of Artificial Sequence: Synthetic oligonucleotide
  Target: DMPK; (-) strand; PAM type: YTN; PAM sequence: CTT
aaattttcagatctatgtac

SEQ ID NO: 16386 - DNA, 20 bp, Artificial Sequence
  Description of Artificial Sequence: Synthetic oligonucleotide
  Target: DMPK; (-) strand; PAM type: YTN; PAM sequence: TTG
gaggaccttaaattttcaga

SEQ ID NO: 16387 - DNA, 20 bp, Artificial Sequence
  Description of Artificial Sequence: Synthetic oligonucleotide
  Target: DMPK; (-) strand; PAM type: YTN; PAM sequence: CTA
agaggccagagttggaggac

SEQ ID NO: 16388 - DNA, 20 bp, Artificial Sequence
  Description of Artificial Sequence: Synthetic oligonucleotide
  Target: DMPK; (-) strand; PAM type: YTN; PAM sequence: CTC
ctaagaggccagagttggag

SEQ ID NO: 16389 - DNA, 20 bp, Artificial Sequence
  Description of Artificial Sequence: Synthetic oligonucleotide
  Target: DMPK; (-) strand; PAM type: YTN; PAM sequence: TTG
ggcccaaagactcctaagag

SEQ ID NO: 16390 - DNA, 20 bp, Artificial Sequence
  Description of Artificial Sequence: Synthetic oligonucleotide
  Target: DMPK; (-) strand; PAM type: YTN; PAM sequence: TTT
gggcccaaagactcctaaga

SEQ ID NO: 16391 - DNA, 20 bp, Artificial Sequence
  Description of Artificial Sequence: Synthetic oligonucleotide
  Target: DMPK; (-) strand; PAM type: YTN; PAM sequence: TTT
tgggcccaaagactcctaag

SEQ ID NO: 16392 - DNA, 20 bp, Artificial Sequence
  Description of Artificial Sequence: Synthetic oligonucleotide
  Target: DMPK; (-) strand; PAM type: YTN; PAM sequence: CTG
ttttgggcccaaagactcct

SEQ ID NO: 16393 - DNA, 20 bp, Artificial Sequence
  Description of Artificial Sequence: Synthetic oligonucleotide
  Target: DMPK; (-) strand; PAM type: YTN; PAM sequence: TTA
ctgttttgggcccaaagact

SEQ ID NO: 16394 - DNA, 20 bp, Artificial Sequence
  Description of Artificial Sequence: Synthetic oligonucleotide
  Target: DMPK; (-) strand; PAM type: YTN; PAM sequence: CTT
actgttttgggcccaaagac

SEQ ID NO: 16395 - DNA, 20 bp, Artificial Sequence
  Description of Artificial Sequence: Synthetic oligonucleotide
  Target: DMPK; (-) strand; PAM type: YTN; PAM sequence: TTG
gaaccttactgttttgggcc

SEQ ID NO: 16396 - DNA, 20 bp, Artificial Sequence
  Description of Artificial Sequence: Synthetic oligonucleotide
  Target: DMPK; (-) strand; PAM type: YTN; PAM sequence: CTT
ggaaccttactgttttgggc

SEQ ID NO: 16397 - DNA, 20 bp, Artificial Sequence
  Description of Artificial Sequence: Synthetic oligonucleotide
  Target: DMPK; (-) strand; PAM type: YTN; PAM sequence: TTG
caggatcagtcttggaacct

SEQ ID NO: 16398 - DNA, 20 bp, Artificial Sequence
  Description of Artificial Sequence: Synthetic oligonucleotide
  Target: DMPK; (-) strand; PAM type: YTN; PAM sequence: TTG
gcagccaatggagttgcagg

SEQ ID NO: 16399 - DNA, 20 bp, Artificial Sequence
  Description of Artificial Sequence: Synthetic oligonucleotide
  Target: DMPK; (-) strand; PAM type: YTN; PAM sequence: CTT
ggcagccaatggagttgcag

SEQ ID NO: 16400 - DNA, 20 bp, Artificial Sequence
  Description of Artificial Sequence: Synthetic oligonucleotide
  Target: DMPK; (-) strand; PAM type: YTN; PAM sequence: CTC
cttggcagccaatggagttg

SEQ ID NO: 16401 - DNA, 20 bp, Artificial Sequence
  Description of Artificial Sequence: Synthetic oligonucleotide
  Target: DMPK; (-) strand; PAM type: YTN; PAM sequence: CTG
ctccttggcagccaatggag

SEQ ID NO: 16402 - DNA, 20 bp, Artificial Sequence
  Description of Artificial Sequence: Synthetic oligonucleotide
  Target: DMPK; (-) strand; PAM type: YTN; PAM sequence: CTG
ggtcctgctccttggcagcc

SEQ ID NO: 16403 - DNA, 20 bp, Artificial Sequence
  Description of Artificial Sequence: Synthetic oligonucleotide
  Target: DMPK; (-) strand; PAM type: YTN; PAM sequence: TTC
ctgggtcctgctccttggca

SEQ ID NO: 16404 - DNA, 20 bp, Artificial Sequence
  Description of Artificial Sequence: Synthetic oligonucleotide
  Target: DMPK; (-) strand; PAM type: YTN; PAM sequence: CTT
cctgggtcctgctccttggc

SEQ ID NO: 16405 - DNA, 20 bp, Artificial Sequence
  Description of Artificial Sequence: Synthetic oligonucleotide
  Target: DMPK; (-) strand; PAM type: YTN; PAM sequence: TTG
agcttcctgggtcctgctcc

SEQ ID NO: 16406 - DNA, 20 bp, Artificial Sequence
  Description of Artificial Sequence: Synthetic oligonucleotide
  Target: DMPK; (-) strand; PAM type: YTN; PAM sequence: CTT
gagcttcctgggtcctgctc

SEQ ID NO: 16407 - DNA, 20 bp, Artificial Sequence
  Description of Artificial Sequence: Synthetic oligonucleotide
  Target: DMPK; (-) strand; PAM type: YTN; PAM sequence: CTG
cttgagcttcctgggtcctg

SEQ ID NO: 16408 - DNA, 20 bp, Artificial Sequence
  Description of Artificial Sequence: Synthetic oligonucleotide
  Target: DMPK; (-) strand; PAM type: YTN; PAM sequence: CTC
caggggccacgaggctgctt

SEQ ID NO: 16409 - DNA, 20 bp, Artificial Sequence
  Description of Artificial Sequence: Synthetic oligonucleotide
  Target: DMPK; (-) strand; PAM type: YTN; PAM sequence: CTG
gacggcctccaggggccacg

SEQ ID NO: 16410 - DNA, 20 bp, Artificial Sequence
  Description of Artificial Sequence: Synthetic oligonucleotide
  Target: DMPK; (-) strand; PAM type: YTN; PAM sequence: CTG
ccctggacggcctccagggg

SEQ ID NO: 16411 - DNA, 20 bp, Artificial Sequence
  Description of Artificial Sequence: Synthetic oligonucleotide
  Target: DMPK; (-) strand; PAM type: YTN; PAM sequence: CTC
aggtaagcactgccctggac

SEQ ID NO: 16412 - DNA, 20 bp, Artificial Sequence
  Description of Artificial Sequence: Synthetic oligonucleotide
  Target: DMPK; (-) strand; PAM type: YTN; PAM sequence: CTG
catggccctcaggtaagcac

SEQ ID NO: 16413 - DNA, 20 bp, Artificial Sequence
  Description of Artificial Sequence: Synthetic oligonucleotide
  Target: DMPK; (-) strand; PAM type: YTN; PAM sequence: CTC
ctgcatggccctcaggtaag

SEQ ID NO: 16414 - DNA, 20 bp, Artificial Sequence
  Description of Artificial Sequence: Synthetic oligonucleotide
  Target: DMPK; (-) strand; PAM type: YTN; PAM sequence: CTA
ctcctgcatggccctcaggt

SEQ ID NO: 16415 - DNA, 20 bp, Artificial Sequence
  Description of Artificial Sequence: Synthetic oligonucleotide
  Target: DMPK; (-) strand; PAM type: YTN; PAM sequence: CTC
ctactcctgcatggccctca

SEQ ID NO: 16416 - DNA, 20 bp, Artificial Sequence
  Description of Artificial Sequence: Synthetic oligonucleotide
  Target: DMPK; (-) strand; PAM type: YTN; PAM sequence: CTA
ctcctactcctgcatggccc

SEQ ID NO: 16417 - DNA, 20 bp, Artificial Sequence
  Description of Artificial Sequence: Synthetic oligonucleotide
  Target: DMPK; (-) strand; PAM type: YTN; PAM sequence: TTG
tgggctactcctactcctgc

SEQ ID NO: 16418 - DNA, 20 bp, Artificial Sequence
  Description of Artificial Sequence: Synthetic oligonucleotide
  Target: DMPK; (-) strand; PAM type: YTN; PAM sequence: TTT
gtgggctactcctactcctg

SEQ ID NO: 16419 - DNA, 20 bp, Artificial Sequence
  Description of Artificial Sequence: Synthetic oligonucleotide
  Target: DMPK; (-) strand; PAM type: YTN; PAM sequence: TTT
tgtgggctactcctactcct

SEQ ID NO: 16420 - DNA, 20 bp, Artificial Sequence
  Description of Artificial Sequence: Synthetic oligonucleotide
  Target: DMPK; (-) strand; PAM type: YTN; PAM sequence: CTT
ttgtgggctactcctactcc

SEQ ID NO: 16421 - DNA, 20 bp, Artificial Sequence
  Description of Artificial Sequence: Synthetic oligonucleotide
  Target: DMPK; (-) strand; PAM type: YTN; PAM sequence: CTG
ccttttgtgggctactccta

SEQ ID NO: 16422 - DNA, 20 bp, Artificial Sequence
  Description of Artificial Sequence: Synthetic oligonucleotide
  Target: DMPK; (-) strand; PAM type: YTN; PAM sequence: CTA
ggggtccacctgccttttgt

SEQ ID NO: 16423 - DNA, 20 bp, Artificial Sequence
  Description of Artificial Sequence: Synthetic oligonucleotide
  Target: DMPK; (-) strand; PAM type: YTN; PAM sequence: TTC
gggaaggtgcgccgctaggg

SEQ ID NO: 16424 - DNA, 20 bp, Artificial Sequence
  Description of Artificial Sequence: Synthetic oligonucleotide
  Target: DMPK; (-) strand; PAM type: YTN; PAM sequence: CTG
tcggacattcgggaaggtgc

SEQ ID NO: 16425 - DNA, 20 bp, Artificial Sequence
  Description of Artificial Sequence: Synthetic oligonucleotide
  Target: DMPK; (-) strand; PAM type: YTN; PAM sequence: TTG
cgcaggagacactgtcggac

SEQ ID NO: 16426 - DNA, 20 bp, Artificial Sequence
  Description of Artificial Sequence: Synthetic oligonucleotide
  Target: DMPK; (-) strand; PAM type: YTN; PAM sequence: CTT
gcgcaggagacactgtcgga

SEQ ID NO: 16427 - DNA, 20 bp, Artificial Sequence
  Description of Artificial Sequence: Synthetic oligonucleotide
  Target: DMPK; (-) strand; PAM type: YTN; PAM sequence: CTG
tgtgtcttgcgcaggagaca

SEQ ID NO: 16428 - DNA, 20 bp, Artificial Sequence
  Description of Artificial Sequence: Synthetic oligonucleotide
  Target: DMPK; (-) strand; PAM type: YTN; PAM sequence: CTC
acatctgtgtgtcttgcgca

SEQ ID NO: 16429 - DNA, 20 bp, Artificial Sequence
  Description of Artificial Sequence: Synthetic oligonucleotide
  Target: DMPK; (-) strand; PAM type: YTN; PAM sequence: CTG
ctcacatctgtgtgtcttgc

SEQ ID NO: 16430 - DNA, 20 bp, Artificial Sequence
  Description of Artificial Sequence: Synthetic oligonucleotide
  Target: DMPK; (-) strand; PAM type: YTN; PAM sequence: CTG
ctgctcacatctgtgtgtct

SEQ ID NO: 16431 - DNA, 20 bp, Artificial Sequence
  Description of Artificial Sequence: Synthetic oligonucleotide
  Target: DMPK; (-) strand; PAM type: YTN; PAM sequence: CTG
acgactgctgctcacatctg

SEQ ID NO: 16432 - DNA, 20 bp, Artificial Sequence
  Description of Artificial Sequence: Synthetic oligonucleotide
  Target: DMPK; (-) strand; PAM type: YTN; PAM sequence: TTG
gggggaacatgtaagccaag

SEQ ID NO: 16433 - DNA, 20 bp, Artificial Sequence
  Description of Artificial Sequence: Synthetic oligonucleotide
  Target: DMPK; (-) strand; PAM type: YTN; PAM sequence: TTT
ggggggaacatgtaagccaa

SEQ ID NO: 16434 - DNA, 20 bp, Artificial Sequence
  Description of Artificial Sequence: Synthetic oligonucleotide
  Target: DMPK; (-) strand; PAM type: YTN; PAM sequence: CTG
gtttggggggaacatgtaag

SEQ ID NO: 16435 - DNA, 20 bp, Artificial Sequence
  Description of Artificial Sequence: Synthetic oligonucleotide
  Target: DMPK; (-) strand; PAM type: YTN; PAM sequence: TTG
gggctggtttggggggaaca

SEQ ID NO: 16436 - DNA, 20 bp, Artificial Sequence
  Description of Artificial Sequence: Synthetic oligonucleotide
  Target: DMPK; (-) strand; PAM type: YTN; PAM sequence: CTG
agttggggctggtttggggg

SEQ ID NO: 16437 - DNA, 20 bp, Artificial Sequence
  Description of Artificial Sequence: Synthetic oligonucleotide
  Target: DMPK; (-) strand; PAM type: YTN; PAM sequence: TTA
gataagccctgagttggggc

SEQ ID NO: 16438 - DNA, 20 bp, Artificial Sequence
  Description of Artificial Sequence: Synthetic oligonucleotide
  Target: DMPK; (-) strand; PAM type: YTN; PAM sequence: TTT
agataagccctgagttgggg

SEQ ID NO: 16439 - DNA, 20 bp, Artificial Sequence
  Description of Artificial Sequence: Synthetic oligonucleotide
  Target: DMPK; (-) strand; PAM type: YTN; PAM sequence: CTT
tagataagccctgagttggg

SEQ ID NO: 16440 - DNA, 20 bp, Artificial Sequence
  Description of Artificial Sequence: Synthetic oligonucleotide
  Target: DMPK; (-) strand; PAM type: YTN; PAM sequence: CTG
gaggggccactttagataag

SEQ ID NO: 16441 - DNA, 20 bp, Artificial Sequence
  Description of Artificial Sequence: Synthetic oligonucleotide
  Target: DMPK; (-) strand; PAM type: YTN; PAM sequence: CTC
cgtatcaaagaaaaagaaaa

SEQ ID NO: 16442 - DNA, 20 bp, Artificial Sequence
  Description of Artificial Sequence: Synthetic oligonucleotide
  Target: DMPK; (-) strand; PAM type: YTN; PAM sequence: CTG
ggtaacagagcgagactccg

SEQ ID NO: 16443 - DNA, 20 bp, Artificial Sequence
  Description of Artificial Sequence: Synthetic oligonucleotide
  Target: DMPK; (-) strand; PAM type: YTN; PAM sequence: CTC
cagcctgggtaacagagcga

SEQ ID NO: 16444 - DNA, 20 bp, Artificial Sequence
  Description of Artificial Sequence: Synthetic oligonucleotide
  Target: DMPK; (-) strand; PAM type: YTN; PAM sequence: CTG
cactccagcctgggtaacag

SEQ ID NO: 16445 - DNA, 20 bp, Artificial Sequence
  Description of Artificial Sequence: Synthetic oligonucleotide
  Target: DMPK; (-) strand; PAM type: YTN; PAM sequence: TTG
caccactgcactccagcctg

SEQ ID NO: 16446 - DNA, 20 bp, Artificial Sequence
  Description of Artificial Sequence: Synthetic oligonucleotide
  Target: DMPK; (-) strand; PAM type: YTN; PAM sequence: CTG
agattgcaccactgcactcc

SEQ ID NO: 16447 - DNA, 20 bp, Artificial Sequence
  Description of Artificial Sequence: Synthetic oligonucleotide
  Target: DMPK; (-) strand; PAM type: YTN; PAM sequence: TTG
cagtgagctgagattgcacc

SEQ ID NO: 16448 - DNA, 20 bp, Artificial Sequence
  Description of Artificial Sequence: Synthetic oligonucleotide
  Target: DMPK; (-) strand; PAM type: YTN; PAM sequence: CTG
ggaggcggaggttgcagtga

SEQ ID NO: 16449 - DNA, 20 bp, Artificial Sequence
  Description of Artificial Sequence: Synthetic oligonucleotide
  Target: DMPK; (-) strand; PAM type: YTN; PAM sequence: CTG
aacctgggaggcggaggttg

SEQ ID NO: 16450 - DNA, 20 bp, Artificial Sequence
  Description of Artificial Sequence: Synthetic oligonucleotide
  Target: DMPK; (-) strand; PAM type: YTN; PAM sequence: CTG
aggcaggagaatcgcctgaa

SEQ ID NO: 16451 - DNA, 20 bp, Artificial Sequence
  Description of Artificial Sequence: Synthetic oligonucleotide
  Target: DMPK; (-) strand; PAM type: YTN; PAM sequence: CTC
aggacgctgaggcaggagaa

SEQ ID NO: 16452 - DNA, 20 bp, Artificial Sequence
  Description of Artificial Sequence: Synthetic oligonucleotide
  Target: DMPK; (-) strand; PAM type: YTN; PAM sequence: CTA
ctcaggacgctgaggcagga

SEQ ID NO: 16453 - DNA, 20 bp, Artificial Sequence
  Description of Artificial Sequence: Synthetic oligonucleotide
  Target: DMPK; (-) strand; PAM type: YTN; PAM sequence: CTC
agctactcaggacgctgagg

SEQ ID NO: 16454 - DNA, 20 bp, Artificial Sequence
  Description of Artificial Sequence: Synthetic oligonucleotide
  Target: DMPK; (-) strand; PAM type: YTN; PAM sequence: CTG
taatctcagctactcaggac

SEQ ID NO: 16455 - DNA, 20 bp, Artificial Sequence
  Description of Artificial Sequence: Synthetic oligonucleotide
  Target: DMPK; (-) strand; PAM type: YTN; PAM sequence: TTA
gccaggcgtggtagagggcg

SEQ ID NO: 16456 - DNA, 20 bp, Artificial Sequence
  Description of Artificial Sequence: Synthetic oligonucleotide
  Target: DMPK; (-) strand; PAM type: YTN; PAM sequence: CTA
ccaaaaatataaaaaattag

SEQ ID NO: 16457 - DNA, 20 bp, Artificial Sequence
  Description of Artificial Sequence: Synthetic oligonucleotide
  Target: DMPK; (-) strand; PAM type: YTN; PAM sequence: CTC
taccaaaaatataaaaaatt

SEQ ID NO: 16458 - DNA, 20 bp, Artificial Sequence
  Description of Artificial Sequence: Synthetic oligonucleotide
  Target: DMPK; (-) strand; PAM type: YTN; PAM sequence: CTG
gccagcgtggcgaaaccccg

SEQ ID NO: 16459 - DNA, 20 bp, Artificial Sequence
  Description of Artificial Sequence: Synthetic oligonucleotide
  Target: DMPK; (-) strand; PAM type: YTN; PAM sequence: TTG
aggtcagaagatggagacca

SEQ ID NO: 16460 - DNA, 20 bp, Artificial Sequence
  Description of Artificial Sequence: Synthetic oligonucleotide
  Target: DMPK; (-) strand; PAM type: YTN; PAM sequence: CTT
gaggtcagaagatggagacc

SEQ ID NO: 16461 - DNA, 20 bp, Artificial Sequence
  Description of Artificial Sequence: Synthetic oligonucleotide
  Target: DMPK; (-) strand; PAM type: YTN; PAM sequence: CTG
aggtaggcggatcacttgag

SEQ ID NO: 16462 - DNA, 20 bp, Artificial Sequence
  Description of Artificial Sequence: Synthetic oligonucleotide
  Target: DMPK; (-) strand; PAM type: YTN; PAM sequence: CTA
caacagctgaggtaggcgga

SEQ ID NO: 16463 - DNA, 20 bp, Artificial Sequence
  Description of Artificial Sequence: Synthetic oligonucleotide
  Target: DMPK; (-) strand; PAM type: YTN; PAM sequence: TTG
ggactacaacagctgaggta

SEQ ID NO: 16464 - DNA, 20 bp, Artificial Sequence
  Description of Artificial Sequence: Synthetic oligonucleotide
  Target: DMPK; (-) strand; PAM type: YTN; PAM sequence: TTT
gggactacaacagctgaggt

SEQ ID NO: 16465 - DNA, 20 bp, Artificial Sequence
  Description of Artificial Sequence: Synthetic oligonucleotide
  Target: DMPK; (-) strand; PAM type: YTN; PAM sequence: TTG
agcccagagtttgggactac

SEQ ID NO: 16466 - DNA, 20 bp, Artificial Sequence
  Description of Artificial Sequence: Synthetic oligonucleotide
  Target: DMPK; (-) strand; PAM type: YTN; PAM sequence: CTT
gagcccagagtttgggacta

SEQ ID NO: 16467 - DNA, 20 bp, Artificial Sequence
  Description of Artificial Sequence: Synthetic oligonucleotide
  Target: DMPK; (-) strand; PAM type: YTN; PAM sequence: CTG
cttgagcccagagtttggga

SEQ ID NO: 16468 - DNA, 20 bp, Artificial Sequence
  Description of Artificial Sequence: Synthetic oligonucleotide
  Target: DMPK; (-) strand; PAM type: YTN; PAM sequence: TTG
gaggactgcttgagcccaga

SEQ ID NO: 16469 - DNA, 20 bp, Artificial Sequence
  Description of Artificial Sequence: Synthetic oligonucleotide
  Target: DMPK; (-) strand; PAM type: YTN; PAM sequence: CTG
aggttggaggactgcttgag

SEQ ID NO: 16470 - DNA, 20 bp, Artificial Sequence
  Description of Artificial Sequence: Synthetic oligonucleotide
  Target: DMPK; (-) strand; PAM type: YTN; PAM sequence: TTG
ggaggctgaggttggaggac

SEQ ID NO: 16471 - DNA, 20 bp, Artificial Sequence
  Description of Artificial Sequence: Synthetic oligonucleotide
  Target: DMPK; (-) strand; PAM type: YTN; PAM sequence: TTT
gggaggctgaggttggagga

SEQ ID NO: 16472 - DNA, 20 bp, Artificial Sequence
  Description of Artificial Sequence: Synthetic oligonucleotide
  Target: DMPK; (-) strand; PAM type: YTN; PAM sequence: CTT
tgggaggctgaggttggagg

SEQ ID NO: 16473 - DNA, 20 bp, Artificial Sequence
  Description of Artificial Sequence: Synthetic oligonucleotide
  Target: DMPK; (-) strand; PAM type: YTN; PAM sequence: TTG
taatcccagcactttgggag

SEQ ID NO: 16474 - DNA, 20 bp, Artificial Sequence
  Description of Artificial Sequence: Synthetic oligonucleotide
  Target: DMPK; (-) strand; PAM type: YTN; PAM sequence: TTT
gtaatcccagcactttggga

SEQ ID NO: 16475 - DNA, 20 bp, Artificial Sequence
  Description of Artificial Sequence: Synthetic oligonucleotide
  Target: DMPK; (-) strand; PAM type: YTN; PAM sequence: TTA
tatttgtaatcccagcactt

SEQ ID NO: 16476 - DNA, 20 bp, Artificial Sequence
  Description of Artificial Sequence: Synthetic oligonucleotide
  Target: DMPK; (-) strand; PAM type: YTN; PAM sequence: CTT
atatttgtaatcccagcact

SEQ ID NO: 16477 - DNA, 20 bp, Artificial Sequence
  Description of Artificial Sequence: Synthetic oligonucleotide
  Target: DMPK; (-) strand; PAM type: YTN; PAM sequence: CTG
ggcacagtggcttatatttg

SEQ ID NO: 16478 - DNA, 20 bp, Artificial Sequence
  Description of Artificial Sequence: Synthetic oligonucleotide
  Target: DMPK; (-) strand; PAM type: YTN; PAM sequence: CTG
ggctgggcacagtggcttat

SEQ ID NO: 16479 - DNA, 20 bp, Artificial Sequence
  Description of Artificial Sequence: Synthetic oligonucleotide
  Target: DMPK; (-) strand; PAM type: YTN; PAM sequence: CTA
aaaaaaaaaaacagaactgg

SEQ ID NO: 16480 - DNA, 20 bp, Artificial Sequence
  Description of Artificial Sequence: Synthetic oligonucleotide
  Target: DMPK; (-) strand; PAM type: YTN; PAM sequence: CTC
catctaaaaaaaaaaaacag

SEQ ID NO: 16481 - DNA, 20 bp, Artificial Sequence
  Description of Artificial Sequence: Synthetic oligonucleotide
  Target: DMPK; (-) strand; PAM type: YTN; PAM sequence: CTG
ggagacagcaagactccatc

SEQ ID NO: 16482 - DNA, 20 bp, Artificial Sequence
  Description of Artificial Sequence: Synthetic oligonucleotide
  Target: DMPK; (-) strand; PAM type: YTN; PAM sequence: CTA
ggctgggagacagcaagact

SEQ ID NO: 16483 - DNA, 20 bp, Artificial Sequence
  Description of Artificial Sequence: Synthetic oligonucleotide
  Target: DMPK; (-) strand; PAM type: YTN; PAM sequence: CTC
taggctgggagacagcaaga

SEQ ID NO: 16484 - DNA, 20 bp, Artificial Sequence
  Description of Artificial Sequence: Synthetic oligonucleotide
  Target: DMPK; (-) strand; PAM type: YTN; PAM sequence: CTG
cactctaggctgggagacag

SEQ ID NO: 16485 - DNA, 20 bp, Artificial Sequence
  Description of Artificial Sequence: Synthetic oligonucleotide
  Target: DMPK; (-) strand; PAM type: YTN; PAM sequence: TTG
tgccactgcactctaggctg

SEQ ID NO: 16486 - DNA, 20 bp, Artificial Sequence
  Description of Artificial Sequence: Synthetic oligonucleotide
  Target: DMPK; (-) strand; PAM type: YTN; PAM sequence: CTG
gggttgtgccactgcactct

SEQ ID NO: 16487 - DNA, 20 bp, Artificial Sequence
  Description of Artificial Sequence: Synthetic oligonucleotide
  Target: DMPK; (-) strand; PAM type: YTN; PAM sequence: TTG
cagtgggctggggttgtgcc

SEQ ID NO: 16488 - DNA, 20 bp, Artificial Sequence
  Description of Artificial Sequence: Synthetic oligonucleotide
  Target: DMPK; (-) strand; PAM type: YTN; PAM sequence: TTT
gcagtgggctggggttgtgc

SEQ ID NO: 16489 - DNA, 20 bp, Artificial Sequence
  Description of Artificial Sequence: Synthetic oligonucleotide
  Target: DMPK; (-) strand; PAM type: YTN; PAM sequence: CTG
ggaggcagagtttgcagtgg

SEQ ID NO: 16490 - DNA, 20 bp, Artificial Sequence
  Description of Artificial Sequence: Synthetic oligonucleotide
  Target: DMPK; (-) strand; PAM type: YTN; PAM sequence: TTG
aacctgggaggcagagtttg

SEQ ID NO: 16491 - DNA, 20 bp, Artificial Sequence
  Description of Artificial Sequence: Synthetic oligonucleotide
  Target: DMPK; (-) strand; PAM type: YTN; PAM sequence: TTG
attgaacctgggaggcagag

SEQ ID NO: 16492 - DNA, 20 bp, Artificial Sequence
  Description of Artificial Sequence: Synthetic oligonucleotide
  Target: DMPK; (-) strand; PAM type: YTN; PAM sequence: CTT
gattgaacctgggaggcaga

SEQ ID NO: 16493 - DNA, 20 bp, Artificial Sequence
  Description of Artificial Sequence: Synthetic oligonucleotide
  Target: DMPK; (-) strand; PAM type: YTN; PAM sequence: CTG
aggcaggagaatcgcttgat

SEQ ID NO: 16494 - DNA, 20 bp, Artificial Sequence
  Description of Artificial Sequence: Synthetic oligonucleotide
  Target: DMPK; (-) strand; PAM type: YTN; PAM sequence: CTC
aggaggctgaggcaggagaa

SEQ ID NO: 16495 - DNA, 20 bp, Artificial Sequence
  Description of Artificial Sequence: Synthetic oligonucleotide
  Target: DMPK; (-) strand; PAM type: YTN; PAM sequence: CTA
ctcaggaggctgaggcagga

SEQ ID NO: 16496 - DNA, 20 bp, Artificial Sequence
  Description of Artificial Sequence: Synthetic oligonucleotide
  Target: DMPK; (-) strand; PAM type: YTN; PAM sequence: CTG
taatgccagctactcaggag

SEQ ID NO: 16497 - DNA, 20 bp, Artificial Sequence
  Description of Artificial Sequence: Synthetic oligonucleotide
  Target: DMPK; (-) strand; PAM type: YTN; PAM sequence: TTG
gtggcgtatgcctgtaatgc

SEQ ID NO: 16498 - DNA, 20 bp, Artificial Sequence
  Description of Artificial Sequence: Synthetic oligonucleotide
  Target: DMPK; (-) strand; PAM type: YTN; PAM sequence: CTT
ggtggcgtatgcctgtaatg

SEQ ID NO: 16499 - DNA, 20 bp, Artificial Sequence
  Description of Artificial Sequence: Synthetic oligonucleotide
  Target: DMPK; (-) strand; PAM type: YTN; PAM sequence: TTA
gccaggcttggtggcgtatg

SEQ ID NO: 16500 - DNA, 20 bp, Artificial Sequence
  Description of Artificial Sequence: Synthetic oligonucleotide
  Target: DMPK; (-) strand; PAM type: YTN; PAM sequence: TTT
agccaggcttggtggcgtat

SEQ ID NO: 16501 - DNA, 20 bp, Artificial Sequence
  Description of Artificial Sequence: Synthetic oligonucleotide
  Target: DMPK; (-) strand; PAM type: YTN; PAM sequence: CTA
aaaatacaaaatttagccag

SEQ ID NO: 16502 - DNA, 20 bp, Artificial Sequence
  Description of Artificial Sequence: Synthetic oligonucleotide
  Target: DMPK; (-) strand; PAM type: YTN; PAM sequence: CTA
ctaaaaatacaaaatttagc

SEQ ID NO: 16503 - DNA, 20 bp, Artificial Sequence
  Description of Artificial Sequence: Synthetic oligonucleotide
  Target: DMPK; (-) strand; PAM type: YTN; PAM sequence: CTG
tgtctactaaaaatacaaaa

SEQ ID NO: 16504 - DNA, 20 bp, Artificial Sequence
  Description of Artificial Sequence: Synthetic oligonucleotide
  Target: DMPK; (-) strand; PAM type: YTN; PAM sequence: CTG
gccaacatggtgaaaccctg

SEQ ID NO: 16505 - DNA, 20 bp, Artificial Sequence
  Description of Artificial Sequence: Synthetic oligonucleotide
  Target: DMPK; (-) strand; PAM type: YTN; PAM sequence: TTC
aagaccagcctggccaacat

SEQ ID NO: 16506 - DNA, 20 bp, Artificial Sequence
  Description of Artificial Sequence: Synthetic oligonucleotide
  Target: DMPK; (-) strand; PAM type: YTN; PAM sequence: CTG
gaagtcaggagttcaagacc

SEQ ID NO: 16507 - DNA, 20 bp, Artificial Sequence
  Description of Artificial Sequence: Synthetic oligonucleotide
  Target: DMPK; (-) strand; PAM type: YTN; PAM sequence: CTG
aggcaggcagatcactggaa

SEQ ID NO: 16508 - DNA, 20 bp, Artificial Sequence
  Description of Artificial Sequence: Synthetic oligonucleotide
  Target: DMPK; (-) strand; PAM type: YTN; PAM sequence: TTG
ggaggctgaggcaggcagat

SEQ ID NO: 16509 - DNA, 20 bp, Artificial Sequence
  Description of Artificial Sequence: Synthetic oligonucleotide
  Target: DMPK; (-) strand; PAM type: YTN; PAM sequence: TTT
gggaggctgaggcaggcaga

SEQ ID NO: 16510 - DNA, 20 bp, Artificial Sequence
  Description of Artificial Sequence: Synthetic oligonucleotide
  Target: DMPK; (-) strand; PAM type: YTN; PAM sequence: CTT
tgggaggctgaggcaggcag

SEQ ID NO: 16511 - DNA, 20 bp, Artificial Sequence
  Description of Artificial Sequence: Synthetic oligonucleotide
  Target: DMPK; (-) strand; PAM type: YTN; PAM sequence: CTG
taatcccagaactttgggag

SEQ ID NO: 16512 - DNA, 20 bp, Artificial Sequence
  Description of Artificial Sequence: Synthetic oligonucleotide
  Target: DMPK; (-) strand; PAM type: YTN; PAM sequence: TTC
acgcctgtaatcccagaact

SEQ ID NO: 16513 - DNA, 20 bp, Artificial Sequence
  Description of Artificial Sequence: Synthetic oligonucleotide
  Target: DMPK; (-) strand; PAM type: YTN; PAM sequence: TTG
ggcaaggtggttcacgcctg

SEQ ID NO: 16514 - DNA, 20 bp, Artificial Sequence
  Description of Artificial Sequence: Synthetic oligonucleotide
  Target: DMPK; (-) strand; PAM type: YTN; PAM sequence: CTC
aaaaaaaaaaaaaaaaaaaa

SEQ ID NO: 16515 - DNA, 20 bp, Artificial Sequence
  Description of Artificial Sequence: Synthetic oligonucleotide
  Target: DMPK; (-) strand; PAM type: YTN; PAM sequence: CTG
tctcaaaaaaaaaaaaaaaa

SEQ ID NO: 16516 - DNA, 20 bp, Artificial Sequence
  Description of Artificial Sequence: Synthetic oligonucleotide
  Target: DMPK; (-) strand; PAM type: YTN; PAM sequence: CTC
tgtctcaaaaaaaaaaaaaa

SEQ ID NO: 16517 - DNA, 20 bp, Artificial Sequence
  Description of Artificial Sequence: Synthetic oligonucleotide
  Target: DMPK; (-) strand; PAM type: YTN; PAM sequence: CTG
ggtgacagagtgagactctg

SEQ ID NO: 16518 - DNA, 20 bp, Artificial Sequence
  Description of Artificial Sequence: Synthetic oligonucleotide
  Target: DMPK; (-) strand; PAM type: YTN; PAM sequence: CTC
cagtctgggtgacagagtga

SEQ ID NO: 16519 - DNA, 20 bp, Artificial Sequence
  Description of Artificial Sequence: Synthetic oligonucleotide
  Target: DMPK; (-) strand; PAM type: YTN; PAM sequence: CTA
cactccagtctgggtgacag

SEQ ID NO: 16520 - DNA, 20 bp, Artificial Sequence
  Description of Artificial Sequence: Synthetic oligonucleotide
  Target: DMPK; (-) strand; PAM type: YTN; PAM sequence: TTG
cagtgagccaagatcatgcc

SEQ ID NO: 16521 - DNA, 20 bp, Artificial Sequence
  Description of Artificial Sequence: Synthetic oligonucleotide
  Target: DMPK; (-) strand; PAM type: YTN; PAM sequence: TTT
gcagtgagccaagatcatgc

SEQ ID NO: 16522 - DNA, 20 bp, Artificial Sequence
  Description of Artificial Sequence: Synthetic oligonucleotide
  Target: DMPK; (-) strand; PAM type: YTN; PAM sequence: CTG
ggaggcagagtttgcagtga

SEQ ID NO: 16523 - DNA, 20 bp, Artificial Sequence
  Description of Artificial Sequence: Synthetic oligonucleotide
  Target: DMPK; (-) strand; PAM type: YTN; PAM sequence: TTG
aacctgggaggcagagtttg

SEQ ID NO: 16524 - DNA, 20 bp, Artificial Sequence
  Description of Artificial Sequence: Synthetic oligonucleotide
  Target: DMPK; (-) strand; PAM type: YTN; PAM sequence: CTT
gaacctgggaggcagagttt

SEQ ID NO: 16525 - DNA, 20 bp, Artificial Sequence
  Description of Artificial Sequence: Synthetic oligonucleotide
  Target: DMPK; (-) strand; PAM type: YTN; PAM sequence: TTG
cttgaacctgggaggcagag

SEQ ID NO: 16526 - DNA, 20 bp, Artificial Sequence
  Description of Artificial Sequence: Synthetic oligonucleotide
  Target: DMPK; (-) strand; PAM type: YTN; PAM sequence: CTG
aggcaggagaattgcttgaa

SEQ ID NO: 16527 - DNA, 20 bp, Artificial Sequence
  Description of Artificial Sequence: Synthetic oligonucleotide
  Target: DMPK; (-) strand; PAM type: YTN; PAM sequence: CTG
gggaagctgaggcaggagaa

SEQ ID NO: 16528 - DNA, 20 bp, Artificial Sequence
  Description of Artificial Sequence: Synthetic oligonucleotide
  Target: DMPK; (-) strand; PAM type: YTN; PAM sequence: TTA
ctggggaagctgaggcagga

SEQ ID NO: 16529 - DNA, 20 bp, Artificial Sequence
  Description of Artificial Sequence: Synthetic oligonucleotide
  Target: DMPK; (-) strand; PAM type: YTN; PAM sequence: TTC
cagttactggggaagctgag

SEQ ID NO: 16530 - DNA, 20 bp, Artificial Sequence
  Description of Artificial Sequence: Synthetic oligonucleotide
  Target: DMPK; (-) strand; PAM type: YTN; PAM sequence: CTG
taattccagttactggggaa

SEQ ID NO: 16531 - DNA, 20 bp, Artificial Sequence
  Description of Artificial Sequence: Synthetic oligonucleotide
  Target: DMPK; (-) strand; PAM type: YTN; PAM sequence: CTC
gggtgcctgtaattccagtt

SEQ ID NO: 16532 - DNA, 20 bp, Artificial Sequence
  Description of Artificial Sequence: Synthetic oligonucleotide
  Target: DMPK; (-) strand; PAM type: YTN; PAM sequence: CTG
ggtgtggtctcgggtgcctg

SEQ ID NO: 16533 - DNA, 20 bp, Artificial Sequence
  Description of Artificial Sequence: Synthetic oligonucleotide
  Target: DMPK; (-) strand; PAM type: YTN; PAM sequence: TTA
gctgggtgtggtctcgggtg

SEQ ID NO: 16534 - DNA, 20 bp, Artificial Sequence
  Description of Artificial Sequence: Synthetic oligonucleotide
  Target: DMPK; (-) strand; PAM type: YTN; PAM sequence: CTA
aaaatacaagaaaattagct

SEQ ID NO: 16535 - DNA, 20 bp, Artificial Sequence
  Description of Artificial Sequence: Synthetic oligonucleotide
  Target: DMPK; (-) strand; PAM type: YTN; PAM sequence: CTA
ctaaaaatacaagaaaatta

SEQ ID NO: 16536 - DNA, 20 bp, Artificial Sequence
  Description of Artificial Sequence: Synthetic oligonucleotide
  Target: DMPK; (-) strand; PAM type: YTN; PAM sequence: CTC
tactaaaaatacaagaaaat

SEQ ID NO: 16537 - DNA, 20 bp, Artificial Sequence
  Description of Artificial Sequence: Synthetic oligonucleotide
  Target: DMPK; (-) strand; PAM type: YTN; PAM sequence: CTG
gccaacacggtgaaaccccg

SEQ ID NO: 16538 - DNA, 20 bp, Artificial Sequence
  Description of Artificial Sequence: Synthetic oligonucleotide
  Target: DMPK; (-) strand; PAM type: YTN; PAM sequence: CTA
ggctggccaacacggtgaaa

SEQ ID NO: 16539 - DNA, 20 bp, Artificial Sequence
  Description of Artificial Sequence: Synthetic oligonucleotide
  Target: DMPK; (-) strand; PAM type: YTN; PAM sequence: TTG
agactaggctggccaacacg

SEQ ID NO: 16540 - DNA, 20 bp, Artificial Sequence
  Description of Artificial Sequence: Synthetic oligonucleotide
  Target: DMPK; (-) strand; PAM type: YTN; PAM sequence: TTT
gagactaggctggccaacac

SEQ ID NO: 16541 - DNA, 20 bp, Artificial Sequence
  Description of Artificial Sequence: Synthetic oligonucleotide
  Target: DMPK; (-) strand; PAM type: YTN; PAM sequence: TTT
tgagactaggctggccaaca

SEQ ID NO: 16542 - DNA, 20 bp, Artificial Sequence
  Description of Artificial Sequence: Synthetic oligonucleotide
  Target: DMPK; (-) strand; PAM type: YTN; PAM sequence: TTG
ggagtccaaggccggtgggt

SEQ ID NO: 16543 - DNA, 20 bp, Artificial Sequence
  Description of Artificial Sequence: Synthetic oligonucleotide
  Target: DMPK; (-) strand; PAM type: YTN; PAM sequence: TTT
gggagtccaaggccggtggg

SEQ ID NO: 16544 - DNA, 20 bp, Artificial Sequence
  Description of Artificial Sequence: Synthetic oligonucleotide
  Target: DMPK; (-) strand; PAM type: YTN; PAM sequence: CTT
tgggagtccaaggccggtgg

SEQ ID NO: 16545 - DNA, 20 bp, Artificial Sequence
  Description of Artificial Sequence: Synthetic oligonucleotide
  Target: DMPK; (-) strand; PAM type: YTN; PAM sequence: CTG
taatcccagcactttgggag

SEQ ID NO: 16546 - DNA, 20 bp, Artificial Sequence
  Description of Artificial Sequence: Synthetic oligonucleotide
  Target: DMPK; (-) strand; PAM type: YTN; PAM sequence: CTC
atgcctgtaatcccagcact

SEQ ID NO: 16547 - DNA, 20 bp, Artificial Sequence
  Description of Artificial Sequence: Synthetic oligonucleotide
  Target: DMPK; (-) strand; PAM type: YTN; PAM sequence: CTG
tggctcatgcctgtaatccc

SEQ ID NO: 16548 - DNA, 20 bp, Artificial Sequence
  Description of Artificial Sequence: Synthetic oligonucleotide
  Target: DMPK; (-) strand; PAM type: YTN; PAM sequence: CTG
gaccgcggccgggcgctgtg

SEQ ID NO: 16549 - DNA, 20 bp, Artificial Sequence
  Description of Artificial Sequence: Synthetic oligonucleotide
  Target: DMPK; (-) strand; PAM type: YTN; PAM sequence: CTC
agaaaaaaaaaaaaaaaaaa

SEQ ID NO: 16550 - DNA, 20 bp, Artificial Sequence
  Description of Artificial Sequence: Synthetic oligonucleotide
  Target: DMPK; (-) strand; PAM type: YTN; PAM sequence: CTG
tctcagaaaaaaaaaaaaaa

SEQ ID NO: 16551 - DNA, 20 bp, Artificial Sequence
  Description of Artificial Sequence: Synthetic oligonucleotide
  Target: DMPK; (-) strand; PAM type: YTN; PAM sequence: CTC
tgtctcagaaaaaaaaaaaa

SEQ ID NO: 16552 - DNA, 20 bp, Artificial Sequence
  Description of Artificial Sequence: Synthetic oligonucleotide
  Target: DMPK; (-) strand; PAM type: YTN; PAM sequence: CTG
ggcgacagagcgagactctg

SEQ ID NO: 16553 - DNA, 20 bp, Artificial Sequence
  Description of Artificial Sequence: Synthetic oligonucleotide
  Target: DMPK; (-) strand; PAM type: YTN; PAM sequence: CTC
cagcctgggcgacagagcga

SEQ ID NO: 16554 - DNA, 20 bp, Artificial Sequence
  Description of Artificial Sequence: Synthetic oligonucleotide
  Target: DMPK; (-) strand; PAM type: YTN; PAM sequence: CTG
cactccagcctgggcgacag

SEQ ID NO: 16555 - DNA, 20 bp, Artificial Sequence
  Description of Artificial Sequence: Synthetic oligonucleotide
  Target: DMPK; (-) strand; PAM type: YTN; PAM sequence: TTG
cagtgagccgagatcgtgcc

SEQ ID NO: 16556 - DNA, 20 bp, Artificial Sequence
  Description of Artificial Sequence: Synthetic oligonucleotide
  Target: DMPK; (-) strand; PAM type: YTN; PAM sequence: TTT
gcagtgagccgagatcgtgc

SEQ ID NO: 16557 - DNA, 20 bp, Artificial Sequence
  Description of Artificial Sequence: Synthetic oligonucleotide
  Target: DMPK; (-) strand; PAM type: YTN; PAM sequence: CTG
aggcaggagaatggcgtgaa

SEQ ID NO: 16558 - DNA, 20 bp, Artificial Sequence
  Description of Artificial Sequence: Synthetic oligonucleotide
  Target: DMPK; (-) strand; PAM type: YTN; PAM sequence: CTC
aggaggctgaggcaggagaa

SEQ ID NO: 16559 - DNA, 20 bp, Artificial Sequence
  Description of Artificial Sequence: Synthetic oligonucleotide
  Target: DMPK; (-) strand; PAM type: YTN; PAM sequence: CTA
ctcaggaggctgaggcagga

SEQ ID NO: 16560 - DNA, 20 bp, Artificial Sequence
  Description of Artificial Sequence: Synthetic oligonucleotide
  Target: DMPK; (-) strand; PAM type: YTN; PAM sequence: CTG
tagtcccagctactcaggag

SEQ ID NO: 16561 - DNA, 20 bp, Artificial Sequence
  Description of Artificial Sequence: Synthetic oligonucleotide
  Target: DMPK; (-) strand; PAM type: YTN; PAM sequence: TTA
gccaggcgtggtggcgggcg

SEQ ID NO: 16562 - DNA, 20 bp, Artificial Sequence
  Description of Artificial Sequence: Synthetic oligonucleotide
  Target: DMPK; (-) strand; PAM type: YTN; PAM sequence: CTA
aaaatacaaaaaattagcca

SEQ ID NO: 16563 - DNA, 20 bp, Artificial Sequence
  Description of Artificial Sequence: Synthetic oligonucleotide
  Target: DMPK; (-) strand; PAM type: YTN; PAM sequence: CTC
ctaaaaatacaaaaaattag

SEQ ID NO: 16564 - DNA, 20 bp, Artificial Sequence
  Description of Artificial Sequence: Synthetic oligonucleotide
  Target: DMPK; (-) strand; PAM type: YTN; PAM sequence: CTC
tcctaaaaatacaaaaaatt

SEQ ID NO: 16565 - DNA, 20 bp, Artificial Sequence
  Description of Artificial Sequence: Synthetic oligonucleotide
  Target: DMPK; (-) strand; PAM type: YTN; PAM sequence: CTA
acacggtgaaaccccatctc

SEQ ID NO: 16566 - DNA, 20 bp, Artificial Sequence
  Description of Artificial Sequence: Synthetic oligonucleotide
  Target: DMPK; (-) strand; PAM type: YTN; PAM sequence: TTG
gctaacacggtgaaacccca

SEQ ID NO: 16567 - DNA, 20 bp, Artificial Sequence
  Description of Artificial Sequence: Synthetic oligonucleotide
  Target: DMPK; (-) strand; PAM type: YTN; PAM sequence: CTT
ggctaacacggtgaaacccc

SEQ ID NO: 16568 - DNA, 20 bp, Artificial Sequence
  Description of Artificial Sequence: Synthetic oligonucleotide
  Target: DMPK; (-) strand; PAM type: YTN; PAM sequence: TTG
ggaggccgaggcgggtggat

SEQ ID NO: 16569 - DNA, 20 bp, Artificial Sequence
  Description of Artificial Sequence: Synthetic oligonucleotide
  Target: DMPK; (-) strand; PAM type: YTN; PAM sequence: TTT
gggaggccgaggcgggtgga

SEQ ID NO: 16570 - DNA, 20 bp, Artificial Sequence
  Description of Artificial Sequence: Synthetic oligonucleotide
  Target: DMPK; (-) strand; PAM type: YTN; PAM sequence: CTT
tgggaggccgaggcgggtgg

SEQ ID NO: 16571 - DNA, 20 bp, Artificial Sequence
  Description of Artificial Sequence: Synthetic oligonucleotide
  Target: DMPK; (-) strand; PAM type: YTN; PAM sequence: CTC
agcactttgggaggccgagg

SEQ ID NO: 16572 - DNA, 20 bp, Artificial Sequence
  Description of Artificial Sequence: Synthetic oligonucleotide
  Target: DMPK; (-) strand; PAM type: YTN; PAM sequence: CTG
taatctcagcactttgggag

SEQ ID NO: 16573 - DNA, 20 bp, Artificial Sequence
  Description of Artificial Sequence: Synthetic oligonucleotide
  Target: DMPK; (-) strand; PAM type: YTN; PAM sequence: CTC
acgcctgtaatctcagcact

SEQ ID NO: 16574 - DNA, 20 bp, Artificial Sequence
  Description of Artificial Sequence: Synthetic oligonucleotide
  Target: DMPK; (-) strand; PAM type: YTN; PAM sequence: CTG
gccgggcgtggtggctcacg

SEQ ID NO: 16575 - DNA, 20 bp, Artificial Sequence
  Description of Artificial Sequence: Synthetic oligonucleotide
  Target: DMPK; (-) strand; PAM type: YTN; PAM sequence: CTG
ggctggccgggcgtggtggc

SEQ ID NO: 16576 - DNA, 20 bp, Artificial Sequence
  Description of Artificial Sequence: Synthetic oligonucleotide
  Target: DMPK; (-) strand; PAM type: YTN; PAM sequence: TTA
aaaaataggctgggctggcc

SEQ ID NO: 16577 - DNA, 20 bp, Artificial Sequence
  Description of Artificial Sequence: Synthetic oligonucleotide
  Target: DMPK; (-) strand; PAM type: YTN; PAM sequence: CTG
aaattaaaaaataggctggg

SEQ ID NO: 16578 - DNA, 20 bp, Artificial Sequence
  Description of Artificial Sequence: Synthetic oligonucleotide
  Target: DMPK; (-) strand; PAM type: YTN; PAM sequence: CTC
aaaaataagataaactgaaa

SEQ ID NO: 16579 - DNA, 20 bp, Artificial Sequence
  Description of Artificial Sequence: Synthetic oligonucleotide
  Target: DMPK; (-) strand; PAM type: YTN; PAM sequence: CTG
tctcaaaaataagataaact

SEQ ID NO: 16580 - DNA, 20 bp, Artificial Sequence
  Description of Artificial Sequence: Synthetic oligonucleotide
  Target: DMPK; (-) strand; PAM type: YTN; PAM sequence: CTC
tgtctcaaaaataagataaa

SEQ ID NO: 16581 - DNA, 20 bp, Artificial Sequence
  Description of Artificial Sequence: Synthetic oligonucleotide
  Target: DMPK; (-) strand; PAM type: YTN; PAM sequence: CTG
ggcaacggagagagactctg

SEQ ID NO: 16582 - DNA, 20 bp, Artificial Sequence
  Description of Artificial Sequence: Synthetic oligonucleotide
  Target: DMPK; (-) strand; PAM type: YTN; PAM sequence: CTC
cagcctgggcaacggagaga

SEQ ID NO: 16583 - DNA, 20 bp, Artificial Sequence
  Description of Artificial Sequence: Synthetic oligonucleotide
  Target: DMPK; (-) strand; PAM type: YTN; PAM sequence: CTG
cactccagcctgggcaacgg

SEQ ID NO: 16584 - DNA, 20 bp, Artificial Sequence
  Description of Artificial Sequence: Synthetic oligonucleotide
  Target: DMPK; (-) strand; PAM type: YTN; PAM sequence: TTG
tgccactgcactccagcctg

SEQ ID NO: 16585 - DNA, 20 bp, Artificial Sequence
  Description of Artificial Sequence: Synthetic oligonucleotide
  Target: DMPK; (-) strand; PAM type: YTN; PAM sequence: CTG
tgattgtgccactgcactcc

SEQ ID NO: 16586 - DNA, 20 bp, Artificial Sequence
  Description of Artificial Sequence: Synthetic oligonucleotide
  Target: DMPK; (-) strand; PAM type: YTN; PAM sequence: CTG
cagtgagctgtgattgtgcc

SEQ ID NO: 16587 - DNA, 20 bp, Artificial Sequence
  Description of Artificial Sequence: Synthetic oligonucleotide
  Target: DMPK; (-) strand; PAM type: YTN; PAM sequence: TTG
agcccaggaggtcaaggctg

SEQ ID NO: 16588 - DNA, 20 bp, Artificial Sequence
  Description of Artificial Sequence: Synthetic oligonucleotide
  Target: DMPK; (-) strand; PAM type: YTN; PAM sequence: CTT
gagcccaggaggtcaaggct

SEQ ID NO: 16589 - DNA, 20 bp, Artificial Sequence
  Description of Artificial Sequence: Synthetic oligonucleotide
  Target: DMPK; (-) strand; PAM type: YTN; PAM sequence: CTA
gggtggccgacgtgggcttg

SEQ ID NO: 16590 - DNA, 20 bp, Artificial Sequence
  Description of Artificial Sequence: Synthetic oligonucleotide
  Target: DMPK; (-) strand; PAM type: YTN; PAM sequence: CTA
ctagggtggccgacgtgggc

SEQ ID NO: 16591 - DNA, 20 bp, Artificial Sequence
  Description of Artificial Sequence: Synthetic oligonucleotide
  Target: DMPK; (-) strand; PAM type: YTN; PAM sequence: CTC
agctactagggtggccgacg

SEQ ID NO: 16592 - DNA, 20 bp, Artificial Sequence
  Description of Artificial Sequence: Synthetic oligonucleotide
  Target: DMPK; (-) strand; PAM type: YTN; PAM sequence: CTG
tatactcagctactagggtg

SEQ ID NO: 16593 - DNA, 20 bp, Artificial Sequence
  Description of Artificial Sequence: Synthetic oligonucleotide
  Target: DMPK; (-) strand; PAM type: YTN; PAM sequence: TTG
ggcgtggtggcgcatgcctg

SEQ ID NO: 16594 - DNA, 20 bp, Artificial Sequence
  Description of Artificial Sequence: Synthetic oligonucleotide
  Target: DMPK; (-) strand; PAM type: YTN; PAM sequence: TTG
gttgggcgtggtggcgcatg

SEQ ID NO: 16595 - DNA, 20 bp, Artificial Sequence
  Description of Artificial Sequence: Synthetic oligonucleotide
  Target: DMPK; (-) strand; PAM type: YTN; PAM sequence: TTA
aaaattggttgggcgtggtg

SEQ ID NO: 16596 - DNA, 20 bp, Artificial Sequence
  Description of Artificial Sequence: Synthetic oligonucleotide
  Target: DMPK; (-) strand; PAM type: YTN; PAM sequence: TTT
aaaaattggttgggcgtggt

SEQ ID NO: 16597 - DNA, 20 bp, Artificial Sequence
  Description of Artificial Sequence: Synthetic oligonucleotide
  Target: DMPK; (-) strand; PAM type: YTN; PAM sequence: TTT
taaaaattggttgggcgtgg

SEQ ID NO: 16598 - DNA, 20 bp, Artificial Sequence
  Description of Artificial Sequence: Synthetic oligonucleotide
  Target: DMPK; (-) strand; PAM type: YTN; PAM sequence: CTA
caaaaatgttttaaaaattg

SEQ ID NO: 16599 - DNA, 20 bp, Artificial Sequence
  Description of Artificial Sequence: Synthetic oligonucleotide
  Target: DMPK; (-) strand; PAM type: YTN; PAM sequence: CTC
tacaaaaatgttttaaaaat

SEQ ID NO: 16600 - DNA, 20 bp, Artificial Sequence
  Description of Artificial Sequence: Synthetic oligonucleotide
  Target: DMPK; (-) strand; PAM type: YTN; PAM sequence: CTG
ggcaatgtggtgagaccccc

SEQ ID NO: 16601 - DNA, 20 bp, Artificial Sequence
  Description of Artificial Sequence: Synthetic oligonucleotide
  Target: DMPK; (-) strand; PAM type: YTN; PAM sequence: TTC
gagaccagcctgggcaatgt

SEQ ID NO: 16602 - DNA, 20 bp, Artificial Sequence
  Description of Artificial Sequence: Synthetic oligonucleotide
  Target: DMPK; (-) strand; PAM type: YTN; PAM sequence: TTG
agcccaggagttcgagacca

SEQ ID NO: 16603 - DNA, 20 bp, Artificial Sequence
  Description of Artificial Sequence: Synthetic oligonucleotide
  Target: DMPK; (-) strand; PAM type: YTN; PAM sequence: CTT
gagcccaggagttcgagacc

SEQ ID NO: 16604 - DNA, 20 bp, Artificial Sequence
  Description of Artificial Sequence: Synthetic oligonucleotide
  Target: DMPK; (-) strand; PAM type: YTN; PAM sequence: TTG
cttgagcccaggagttcgag

SEQ ID NO: 16605 - DNA, 20 bp, Artificial Sequence
  Description of Artificial Sequence: Synthetic oligonucleotide
  Target: DMPK; (-) strand; PAM type: YTN; PAM sequence: TTG
gcaggccgaagtgggtggat

SEQ ID NO: 16606 - DNA, 20 bp, Artificial Sequence
  Description of Artificial Sequence: Synthetic oligonucleotide
  Target: DMPK; (-) strand; PAM type: YTN; PAM sequence: TTT
ggcaggccgaagtgggtgga

SEQ ID NO: 16607 - DNA, 20 bp, Artificial Sequence
  Description of Artificial Sequence: Synthetic oligonucleotide
  Target: DMPK; (-) strand; PAM type: YTN; PAM sequence: CTG
taaccccagcaatttggcag

SEQ ID NO: 16608 - DNA, 20 bp, Artificial Sequence
  Description of Artificial Sequence: Synthetic oligonucleotide
  Target: DMPK; (-) strand; PAM type: YTN; PAM sequence: CTC
acgcctgtaaccccagcaat

SEQ ID NO: 16609 - DNA, 20 bp, Artificial Sequence
  Description of Artificial Sequence: Synthetic oligonucleotide
  Target: DMPK; (-) strand; PAM type: YTN; PAM sequence: CTG
aagggaagcaacaggataca

SEQ ID NO: 16610 - DNA, 20 bp, Artificial Sequence
  Description of Artificial Sequence: Synthetic oligonucleotide
  Target: DMPK; (-) strand; PAM type: YTN; PAM sequence: TTA
tggagagtgtggcaggtgcc

SEQ ID NO: 16611 - DNA, 20 bp, Artificial Sequence
  Description of Artificial Sequence: Synthetic oligonucleotide
  Target: DMPK; (-) strand; PAM type: YTN; PAM sequence: TTA
gagaattatggagagtgtgg

SEQ ID NO: 16612 - DNA, 20 bp, Artificial Sequence
  Description of Artificial Sequence: Synthetic oligonucleotide
  Target: DMPK; (-) strand; PAM type: YTN; PAM sequence: CTA
gagaattagagaattatgga

SEQ ID NO: 16613 - DNA, 20 bp, Artificial Sequence
  Description of Artificial Sequence: Synthetic oligonucleotide
  Target: DMPK; (-) strand; PAM type: YTN; PAM sequence: TTG
cagtctagagaattagagaa

SEQ ID NO: 16614 - DNA, 20 bp, Artificial Sequence
  Description of Artificial Sequence: Synthetic oligonucleotide
  Target: DMPK; (-) strand; PAM type: YTN; PAM sequence: CTC
atccagttgcagtctagaga

SEQ ID NO: 16615 - DNA, 20 bp, Artificial Sequence
  Description of Artificial Sequence: Synthetic oligonucleotide
  Target: DMPK; (-) strand; PAM type: YTN; PAM sequence: CTG
ccctcatccagttgcagtct

SEQ ID NO: 16616 - DNA, 20 bp, Artificial Sequence
  Description of Artificial Sequence: Synthetic oligonucleotide
  Target: DMPK; (-) strand; PAM type: YTN; PAM sequence: CTG
gtccctgccctcatccagtt

SEQ ID NO: 16617 - DNA, 20 bp, Artificial Sequence
  Description of Artificial Sequence: Synthetic oligonucleotide
  Target: DMPK; (-) strand; PAM type: YTN; PAM sequence: CTC
tggtccctgccctcatccag

SEQ ID NO: 16618 - DNA, 20 bp, Artificial Sequence
  Description of Artificial Sequence: Synthetic oligonucleotide
  Target: DMPK; (-) strand; PAM type: YTN; PAM sequence: CTG
gggatccagcacggaccaga

SEQ ID NO: 16619 - DNA, 20 bp, Artificial Sequence
  Description of Artificial Sequence: Synthetic oligonucleotide
  Target: DMPK; (-) strand; PAM type: YTN; PAM sequence: CTG
aacaatactggggatccagc

SEQ ID NO: 16620 - DNA, 20 bp, Artificial Sequence
  Description of Artificial Sequence: Synthetic oligonucleotide
  Target: DMPK; (-) strand; PAM type: YTN; PAM sequence: TTG
ctgaacaatactggggatcc

SEQ ID NO: 16621 - DNA, 20 bp, Artificial Sequence
  Description of Artificial Sequence: Synthetic oligonucleotide
  Target: DMPK; (-) strand; PAM type: YTN; PAM sequence: TTT
gctgaacaatactggggatc

SEQ ID NO: 16622 - DNA, 20 bp, Artificial Sequence
  Description of Artificial Sequence: Synthetic oligonucleotide
  Target: DMPK; (-) strand; PAM type: YTN; PAM sequence: TTT
tgctgaacaatactggggat

SEQ ID NO: 16623 - DNA, 20 bp, Artificial Sequence
  Description of Artificial Sequence: Synthetic oligonucleotide
  Target: DMPK; (-) strand; PAM type: YTN; PAM sequence: CTT
ttgctgaacaatactgggga

SEQ ID NO: 16624 - DNA, 20 bp, Artificial Sequence
  Description of Artificial Sequence: Synthetic oligonucleotide
  Target: DMPK; (-) strand; PAM type: YTN; PAM sequence: CTG
ggtgcccttttgctgaacaa

SEQ ID NO: 16625 - DNA, 20 bp, Artificial Sequence
  Description of Artificial Sequence: Synthetic oligonucleotide
  Target: DMPK; (-) strand; PAM type: YTN; PAM sequence: CTC
tgggtgcccttttgctgaac

SEQ ID NO: 16626 - DNA, 20 bp, Artificial Sequence
  Description of Artificial Sequence: Synthetic oligonucleotide
  Target: DMPK; (-) strand; PAM type: YTN; PAM sequence: CTC
ggctctgggtgcccttttgc

SEQ ID NO: 16627 - DNA, 20 bp, Artificial Sequence
  Description of Artificial Sequence: Synthetic oligonucleotide
  Target: DMPK; (-) strand; PAM type: YTN; PAM sequence: TTG
ctcggctctgggtgcccttt

SEQ ID NO: 16628 - DNA, 20 bp, Artificial Sequence
  Description of Artificial Sequence: Synthetic oligonucleotide
  Target: DMPK; (-) strand; PAM type: YTN; PAM sequence: CTT
gctcggctctgggtgccctt

SEQ ID NO: 16629 - DNA, 20 bp, Artificial Sequence
  Description of Artificial Sequence: Synthetic oligonucleotide
  Target: DMPK; (-) strand; PAM type: YTN; PAM sequence: CTG
tcatggcatgcttgctcggc

SEQ ID NO: 16630 - DNA, 20 bp, Artificial Sequence
  Description of Artificial Sequence: Synthetic oligonucleotide
  Target: DMPK; (-) strand; PAM type: YTN; PAM sequence: TTC
accgtgtaacaagctgtcat

SEQ ID NO: 16631 - DNA, 20 bp, Artificial Sequence
  Description of Artificial Sequence: Synthetic oligonucleotide
  Target: DMPK; (-) strand; PAM type: YTN; PAM sequence: CTT
caccgtgtaacaagctgtca

SEQ ID NO: 16632 - DNA, 20 bp, Artificial Sequence
  Description of Artificial Sequence: Synthetic oligonucleotide
  Target: DMPK; (-) strand; PAM type: YTN; PAM sequence: CTC
ttcaccgtgtaacaagctgt

SEQ ID NO: 16633 - DNA, 20 bp, Artificial Sequence
  Description of Artificial Sequence: Synthetic oligonucleotide
  Target: DMPK; (-) strand; PAM type: YTN; PAM sequence: CTC
tcttcaccgtgtaacaagct

SEQ ID NO: 16634 - DNA, 20 bp, Artificial Sequence
  Description of Artificial Sequence: Synthetic oligonucleotide
  Target: DMPK; (-) strand; PAM type: YTN; PAM sequence: TTA
ggccgtctctcttcaccgtg

SEQ ID NO: 16635 - DNA, 20 bp, Artificial Sequence
  Description of Artificial Sequence: Synthetic oligonucleotide
  Target: DMPK; (-) strand; PAM type: YTN; PAM sequence: CTT
aggccgtctctcttcaccgt

SEQ ID NO: 16636 - DNA, 20 bp, Artificial Sequence
  Description of Artificial Sequence: Synthetic oligonucleotide
  Target: DMPK; (-) strand; PAM type: YTN; PAM sequence: CTC
ccttaggccgtctctcttca

SEQ ID NO: 16637 - DNA, 20 bp, Artificial Sequence
  Description of Artificial Sequence: Synthetic oligonucleotide
  Target: DMPK; (-) strand; PAM type: YTN; PAM sequence: CTC
ctcccttaggccgtctctct

SEQ ID NO: 16638 - DNA, 20 bp, Artificial Sequence
  Description of Artificial Sequence: Synthetic oligonucleotide
  Target: DMPK; (-) strand; PAM type: YTN; PAM sequence: CTC
ctcctcccttaggccgtctc

SEQ ID NO: 16639 - DNA, 20 bp, Artificial Sequence
  Description of Artificial Sequence: Synthetic oligonucleotide
  Target: DMPK; (-) strand; PAM type: YTN; PAM sequence: TTG
gagggatgagaagcaggaga

SEQ ID NO: 16640 - DNA, 20 bp, Artificial Sequence
  Description of Artificial Sequence: Synthetic oligonucleotide
  Target: DMPK; (-) strand; PAM type: YTN; PAM sequence: CTT
ggagggatgagaagcaggag

SEQ ID NO: 16641 - DNA, 20 bp, Artificial Sequence
  Description of Artificial Sequence: Synthetic oligonucleotide
  Target: DMPK; (-) strand; PAM type: YTN; PAM sequence: CTG
agacttggagggatgagaag

SEQ ID NO: 16642 - DNA, 20 bp, Artificial Sequence
  Description of Artificial Sequence: Synthetic oligonucleotide
  Target: DMPK; (-) strand; PAM type: YTN; PAM sequence: CTG
agctgagacttggagggatg

SEQ ID NO: 16643 - DNA, 20 bp, Artificial Sequence
  Description of Artificial Sequence: Synthetic oligonucleotide
  Target: DMPK; (-) strand; PAM type: YTN; PAM sequence: CTA
tctgagctgagacttggagg

SEQ ID NO: 16644 - DNA, 20 bp, Artificial Sequence
  Description of Artificial Sequence: Synthetic oligonucleotide
  Target: DMPK; (-) strand; PAM type: YTN; PAM sequence: CTG
gagtggggagctatctgagc

SEQ ID NO: 16645 - DNA, 20 bp, Artificial Sequence
  Description of Artificial Sequence: Synthetic oligonucleotide
  Target: DMPK; (-) strand; PAM type: YTN; PAM sequence: TTC
tggagtggggagctatctga

SEQ ID NO: 16646 - DNA, 20 bp, Artificial Sequence
  Description of Artificial Sequence: Synthetic oligonucleotide
  Target: DMPK; (-) strand; PAM type: YTN; PAM sequence: TTT
ctggagtggggagctatctg

SEQ ID NO: 16647 - DNA, 20 bp, Artificial Sequence
  Description of Artificial Sequence: Synthetic oligonucleotide
  Target: DMPK; (-) strand; PAM type: YTN; PAM sequence: CTT
tctggagtggggagctatct

SEQ ID NO: 16648 - DNA, 20 bp, Artificial Sequence
  Description of Artificial Sequence: Synthetic oligonucleotide
  Target: DMPK; (-) strand; PAM type: YTN; PAM sequence: CTG
gagggctttctggagtgggg

SEQ ID NO: 16649 - DNA, 20 bp, Artificial Sequence
  Description of Artificial Sequence: Synthetic oligonucleotide
  Target: DMPK; (-) strand; PAM type: YTN; PAM sequence: CTC
agcaaggaaggtcctggagg

SEQ ID NO: 16650 - DNA, 20 bp, Artificial Sequence
  Description of Artificial Sequence: Synthetic oligonucleotide
  Target: DMPK; (-) strand; PAM type: YTN; PAM sequence: CTG
actcagcaaggaaggtcctg

SEQ ID NO: 16651 - DNA, 20 bp, Artificial Sequence
  Description of Artificial Sequence: Synthetic oligonucleotide
  Target: DMPK; (-) strand; PAM type: YTN; PAM sequence: CTC
ctgactcagcaaggaaggtc

SEQ ID NO: 16652 - DNA, 20 bp, Artificial Sequence
  Description of Artificial Sequence: Synthetic oligonucleotide
  Target: DMPK; (-) strand; PAM type: YTN; PAM sequence: CTG
agacaatggagtgcaggggg

SEQ ID NO: 16653 - DNA, 20 bp, Artificial Sequence
  Description of Artificial Sequence: Synthetic oligonucleotide
  Target: DMPK; (-) strand; PAM type: YTN; PAM sequence: TTC
agacagtaaggccccagagt

SEQ ID NO: 16654 - DNA, 20 bp, Artificial Sequence
  Description of Artificial Sequence: Synthetic oligonucleotide
  Target: DMPK; (-) strand; PAM type: YTN; PAM sequence: CTT
cagacagtaaggccccagag

SEQ ID NO: 16655 - DNA, 20 bp, Artificial Sequence
  Description of Artificial Sequence: Synthetic oligonucleotide
  Target: DMPK; (-) strand; PAM type: YTN; PAM sequence: TTA
cagtccagtgggggaacaca

SEQ ID NO: 16656 - DNA, 20 bp, Artificial Sequence
  Description of Artificial Sequence: Synthetic oligonucleotide
  Target: DMPK; (-) strand; PAM type: YTN; PAM sequence: CTT
acagtccagtgggggaacac

SEQ ID NO: 16657 - DNA, 20 bp, Artificial Sequence
  Description of Artificial Sequence: Synthetic oligonucleotide
  Target: DMPK; (-) strand; PAM type: YTN; PAM sequence: CTA
gacttacagtccagtggggg

SEQ ID NO: 16658 - DNA, 20 bp, Artificial Sequence
  Description of Artificial Sequence: Synthetic oligonucleotide
  Target: DMPK; (-) strand; PAM type: YTN; PAM sequence: CTG
aggacccagcagtgacctag

SEQ ID NO: 16659 - DNA, 20 bp, Artificial Sequence
  Description of Artificial Sequence: Synthetic oligonucleotide
  Target: DMPK; (-) strand; PAM type: YTN; PAM sequence: CTA
ctgaggacccagcagtgacc

SEQ ID NO: 16660 - DNA, 20 bp, Artificial Sequence
  Description of Artificial Sequence: Synthetic oligonucleotide
  Target: DMPK; (-) strand; PAM type: YTN; PAM sequence: CTA
ctactgaggacccagcagtg

SEQ ID NO: 16661 - DNA, 20 bp, Artificial Sequence
  Description of Artificial Sequence: Synthetic oligonucleotide
  Target: DMPK; (-) strand; PAM type: YTN; PAM sequence: CTG
tgcccatctactactgagga

SEQ ID NO: 16662 - DNA, 20 bp, Artificial Sequence
  Description of Artificial Sequence: Synthetic oligonucleotide
  Target: DMPK; (-) strand; PAM type: YTN; PAM sequence: CTC
tgtgcccatctactactgag

SEQ ID NO: 16663 - DNA, 20 bp, Artificial Sequence
  Description of Artificial Sequence: Synthetic oligonucleotide
  Target: DMPK; (-) strand; PAM type: YTN; PAM sequence: CTG
ctctgtgcccatctactact

SEQ ID NO: 16664 - DNA, 20 bp, Artificial Sequence
  Description of Artificial Sequence: Synthetic oligonucleotide
  Target: DMPK; (-) strand; PAM type: YTN; PAM sequence: TTC
cccagagcacctgctctgtg

SEQ ID NO: 16665 - DNA, 20 bp, Artificial Sequence
  Description of Artificial Sequence: Synthetic oligonucleotide
  Target: DMPK; (-) strand; PAM type: YTN; PAM sequence: CTC
attccccagagcacctgctc

SEQ ID NO: 16666 - DNA, 20 bp, Artificial Sequence
  Description of Artificial Sequence: Synthetic oligonucleotide
  Target: DMPK; (-) strand; PAM type: YTN; PAM sequence: CTG
aatcactcattccccagagc

SEQ ID NO: 16667 - DNA, 20 bp, Artificial Sequence
  Description of Artificial Sequence: Synthetic oligonucleotide
  Target: DMPK; (-) strand; PAM type: YTN; PAM sequence: CTG
gggtcctgaatcactcattc

SEQ ID NO: 16668 - DNA, 20 bp, Artificial Sequence
  Description of Artificial Sequence: Synthetic oligonucleotide
  Target: DMPK; (-) strand; PAM type: YTN; PAM sequence: TTC
tggggtcctgaatcactcat

SEQ ID NO: 16669 - DNA, 20 bp, Artificial Sequence
  Description of Artificial Sequence: Synthetic oligonucleotide
  Target: DMPK; (-) strand; PAM type: YTN; PAM sequence: CTT
ctggggtcctgaatcactca

SEQ ID NO: 16670 - DNA, 20 bp, Artificial Sequence
  Description of Artificial Sequence: Synthetic oligonucleotide
  Target: DMPK; (-) strand; PAM type: YTN; PAM sequence: CTA
ccttctggggtcctgaatca

SEQ ID NO: 16671 - DNA, 20 bp, Artificial Sequence
  Description of Artificial Sequence: Synthetic oligonucleotide
  Target: DMPK; (-) strand; PAM type: YTN; PAM sequence: TTG
gagtaaggacagtgcctacc

SEQ ID NO: 16672 - DNA, 20 bp, Artificial Sequence
  Description of Artificial Sequence: Synthetic oligonucleotide
  Target: DMPK; (-) strand; PAM type: YTN; PAM sequence: CTC
cataaagttggagtaaggac

SEQ ID NO: 16673 - DNA, 20 bp, Artificial Sequence
  Description of Artificial Sequence: Synthetic oligonucleotide
  Target: DMPK; (-) strand; PAM type: YTN; PAM sequence: CTC
cctccataaagttggagtaa

SEQ ID NO: 16674 - DNA, 20 bp, Artificial Sequence
  Description of Artificial Sequence: Synthetic oligonucleotide
  Target: DMPK; (-) strand; PAM type: YTN; PAM sequence: CTC
cccatgctccctccataaag

SEQ ID NO: 16675 - DNA, 20 bp, Artificial Sequence
  Description of Artificial Sequence: Synthetic oligonucleotide
  Target: DMPK; (-) strand; PAM type: YTN; PAM sequence: CTG
cgggaacctccccatgctcc

SEQ ID NO: 16676 - DNA, 20 bp, Artificial Sequence
  Description of Artificial Sequence: Synthetic oligonucleotide
  Target: DMPK; (-) strand; PAM type: YTN; PAM sequence: CTC
ggctgcgggaacctccccat

SEQ ID NO: 16677 - DNA, 20 bp, Artificial Sequence
  Description of Artificial Sequence: Synthetic oligonucleotide
  Target: DMPK; (-) strand; PAM type: YTN; PAM sequence: CTG
ctcggctgcgggaacctccc

SEQ ID NO: 16678 - DNA, 20 bp, Artificial Sequence
  Description of Artificial Sequence: Synthetic oligonucleotide
  Target: DMPK; (-) strand; PAM type: YTN; PAM sequence: CTG
tggcccctgctcggctgcgg

SEQ ID NO: 16679 - DNA, 20 bp, Artificial Sequence
  Description of Artificial Sequence: Synthetic oligonucleotide
  Target: DMPK; (-) strand; PAM type: YTN; PAM sequence: CTG
ccatggtgagcgggggcggg

SEQ ID NO: 16680 - DNA, 20 bp, Artificial Sequence
  Description of Artificial Sequence: Synthetic oligonucleotide
  Target: DMPK; (-) strand; PAM type: YTN; PAM sequence: CTC
actgccatggtgagcggggg

SEQ ID NO: 16681 - DNA, 20 bp, Artificial Sequence
  Description of Artificial Sequence: Synthetic oligonucleotide
  Target: DMPK; (-) strand; PAM type: YTN; PAM sequence: TTG
gtggaggacgggctcactgc

SEQ ID NO: 16682 - DNA, 20 bp, Artificial Sequence
  Description of Artificial Sequence: Synthetic oligonucleotide
  Target: DMPK; (-) strand; PAM type: YTN; PAM sequence: CTT
ggtggaggacgggctcactg

SEQ ID NO: 16683 - DNA, 20 bp, Artificial Sequence
  Description of Artificial Sequence: Synthetic oligonucleotide
  Target: DMPK; (-) strand; PAM type: YTN; PAM sequence: TTC
gacttggtggaggacgggct

SEQ ID NO: 16684 - DNA, 20 bp, Artificial Sequence
  Description of Artificial Sequence: Synthetic oligonucleotide
  Target: DMPK; (-) strand; PAM type: YTN; PAM sequence: CTT
cgacttggtggaggacgggc

SEQ ID NO: 16685 - DNA, 20 bp, Artificial Sequence
  Description of Artificial Sequence: Synthetic oligonucleotide
  Target: DMPK; (-) strand; PAM type: YTN; PAM sequence: TTC
gaaggtgccaccgacacatg

SEQ ID NO: 16686 - DNA, 20 bp, Artificial Sequence
  Description of Artificial Sequence: Synthetic oligonucleotide
  Target: DMPK; (-) strand; PAM type: YTN; PAM sequence: TTT
cgaaggtgccaccgacacat

SEQ ID NO: 16687 - DNA, 20 bp, Artificial Sequence
  Description of Artificial Sequence: Synthetic oligonucleotide
  Target: DMPK; (-) strand; PAM type: YTN; PAM sequence: TTA
caccggatttcgaaggtgcc

SEQ ID NO: 16688 - DNA, 20 bp, Artificial Sequence
  Description of Artificial Sequence: Synthetic oligonucleotide
  Target: DMPK; (-) strand; PAM type: YTN; PAM sequence: TTT
acaccggatttcgaaggtgc

SEQ ID NO: 16689 - DNA, 20 bp, Artificial Sequence
  Description of Artificial Sequence: Synthetic oligonucleotide
  Target: DMPK; (-) strand; PAM type: YTN; PAM sequence: CTT
tacaccggatttcgaaggtg

SEQ ID NO: 16690 - DNA, 20 bp, Artificial Sequence
  Description of Artificial Sequence: Synthetic oligonucleotide
  Target: DMPK; (-) strand; PAM type: YTN; PAM sequence: CTC
cgggacagcgtgcccccctt

SEQ ID NO: 16691 - DNA, 20 bp, Artificial Sequence
  Description of Artificial Sequence: Synthetic oligonucleotide
  Target: DMPK; (-) strand; PAM type: YTN; PAM sequence: CTG
ggatggtctccgggacagcg

SEQ ID NO: 16692 - DNA, 20 bp, Artificial Sequence
  Description of Artificial Sequence: Synthetic oligonucleotide
  Target: DMPK; (-) strand; PAM type: YTN; PAM sequence: CTC
gactgggatggtctccggga

SEQ ID NO: 16693 - DNA, 20 bp, Artificial Sequence
  Description of Artificial Sequence: Synthetic oligonucleotide
  Target: DMPK; (-) strand; PAM type: YTN; PAM sequence: TTG
gcctcgactgggatggtctc

SEQ ID NO: 16694 - DNA, 20 bp, Artificial Sequence
  Description of Artificial Sequence: Synthetic oligonucleotide
  Target: DMPK; (-) strand; PAM type: YTN; PAM sequence: TTT
ggcctcgactgggatggtct

SEQ ID NO: 16695 - DNA, 20 bp, Artificial Sequence
  Description of Artificial Sequence: Synthetic oligonucleotide
  Target: DMPK; (-) strand; PAM type: YTN; PAM sequence: CTT
tggcctcgactgggatggtc

SEQ ID NO: 16696 - DNA, 20 bp, Artificial Sequence
  Description of Artificial Sequence: Synthetic oligonucleotide
  Target: DMPK; (-) strand; PAM type: YTN; PAM sequence: TTC
tttggcctcgactgggatgg

SEQ ID NO: 16697 - DNA, 20 bp, Artificial Sequence
  Description of Artificial Sequence: Synthetic oligonucleotide
  Target: DMPK; (-) strand; PAM type: YTN; PAM sequence: CTT
ctttggcctcgactgggatg

SEQ ID NO: 16698 - DNA, 20 bp, Artificial Sequence
  Description of Artificial Sequence: Synthetic oligonucleotide
  Target: DMPK; (-) strand; PAM type: YTN; PAM sequence: TTC
ttctttggcctcgactggga

SEQ ID NO: 16699 - DNA, 20 bp, Artificial Sequence
  Description of Artificial Sequence: Synthetic oligonucleotide
  Target: DMPK; (-) strand; PAM type: YTN; PAM sequence: CTT
cttctttggcctcgactggg

SEQ ID NO: 16700 - DNA, 20 bp, Artificial Sequence
  Description of Artificial Sequence: Synthetic oligonucleotide
  Target: DMPK; (-) strand; PAM type: YTN; PAM sequence: TTC
cggacacatcccttcttctt

SEQ ID NO: 16701 - DNA, 20 bp, Artificial Sequence
  Description of Artificial Sequence: Synthetic oligonucleotide
  Target: DMPK; (-) strand; PAM type: YTN; PAM sequence: CTT
ccggacacatcccttcttct

SEQ ID NO: 16702 - DNA, 20 bp, Artificial Sequence
  Description of Artificial Sequence: Synthetic oligonucleotide
  Target: DMPK; (-) strand; PAM type: YTN; PAM sequence: CTG
ggccggggtggagcaggcga

SEQ ID NO: 16703 - DNA, 20 bp, Artificial Sequence
  Description of Artificial Sequence: Synthetic oligonucleotide
  Target: DMPK; (-) strand; PAM type: YTN; PAM sequence: CTG
tgtcccccggagacacggct

SEQ ID NO: 16704 - DNA, 20 bp, Artificial Sequence
  Description of Artificial Sequence: Synthetic oligonucleotide
  Target: DMPK; (-) strand; PAM type: YTN; PAM sequence: TTG
ctgtgtcccccggagacacg

SEQ ID NO: 16705 - DNA, 20 bp, Artificial Sequence
  Description of Artificial Sequence: Synthetic oligonucleotide
  Target: DMPK; (-) strand; PAM type: YTN; PAM sequence: TTC
agcggttgctgtgtcccccg

SEQ ID NO: 16706 - DNA, 20 bp, Artificial Sequence
  Description of Artificial Sequence: Synthetic oligonucleotide
  Target: DMPK; (-) strand; PAM type: YTN; PAM sequence: TTC
attcagcggttgctgtgtcc

SEQ ID NO: 16707 - DNA, 20 bp, Artificial Sequence
  Description of Artificial Sequence: Synthetic oligonucleotide
  Target: DMPK; (-) strand; PAM type: YTN; PAM sequence: CTT
cattcagcggttgctgtgtc

SEQ ID NO: 16708 - DNA, 20 bp, Artificial Sequence
  Description of Artificial Sequence: Synthetic oligonucleotide
  Target: DMPK; (-) strand; PAM type: YTN; PAM sequence: CTC
gagacttcattcagcggttg

SEQ ID NO: 16709 - DNA, 20 bp, Artificial Sequence
  Description of Artificial Sequence: Synthetic oligonucleotide
  Target: DMPK; (-) strand; PAM type: YTN; PAM sequence: CTG
aggaggctcgagacttcatt

SEQ ID NO: 16710 - DNA, 20 bp, Artificial Sequence
  Description of Artificial Sequence: Synthetic oligonucleotide
  Target: DMPK; (-) strand; PAM type: YTN; PAM sequence: CTG
gtggacgaaggggtccctga

SEQ ID NO: 16711 - DNA, 20 bp, Artificial Sequence
  Description of Artificial Sequence: Synthetic oligonucleotide
  Target: DMPK; (-) strand; PAM type: YTN; PAM sequence: CTG
ccgctggtggacgaaggggt

SEQ ID NO: 16712 - DNA, 20 bp, Artificial Sequence
  Description of Artificial Sequence: Synthetic oligonucleotide
  Target: DMPK; (-) strand; PAM type: YTN; PAM sequence: CTC
tgccgctggtggacgaaggg

SEQ ID NO: 16713 - DNA, 20 bp, Artificial Sequence
  Description of Artificial Sequence: Synthetic oligonucleotide
  Target: DMPK; (-) strand; PAM type: YTN; PAM sequence: CTC
tctgccgctggtggacgaag

SEQ ID NO: 16714 - DNA, 20 bp, Artificial Sequence
  Description of Artificial Sequence: Synthetic oligonucleotide
  Target: DMPK; (-) strand; PAM type: YTN; PAM sequence: CTC
tctctgccgctggtggacga

SEQ ID NO: 16715 - DNA, 20 bp, Artificial Sequence
  Description of Artificial Sequence: Synthetic oligonucleotide
  Target: DMPK; (-) strand; PAM type: YTN; PAM sequence: CTG
agcaggagcacctctctctg

SEQ ID NO: 16716 - DNA, 20 bp, Artificial Sequence
  Description of Artificial Sequence: Synthetic oligonucleotide
  Target: DMPK; (-) strand; PAM type: YTN; PAM sequence: CTC
tgagcaggagcacctctctc

SEQ ID NO: 16717 - DNA, 20 bp, Artificial Sequence
  Description of Artificial Sequence: Synthetic oligonucleotide
  Target: DMPK; (-) strand; PAM type: YTN; PAM sequence: CTC
cctctgagcaggagcacctc

SEQ ID NO: 16718 - DNA, 20 bp, Artificial Sequence
  Description of Artificial Sequence: Synthetic oligonucleotide
  Target: DMPK; (-) strand; PAM type: YTN; PAM sequence: CTC
tccctctgagcaggagcacc

SEQ ID NO: 16719 - DNA, 20 bp, Artificial Sequence
  Description of Artificial Sequence: Synthetic oligonucleotide
  Target: DMPK; (-) strand; PAM type: YTN; PAM sequence: CTC
ctctccctctgagcaggagc

SEQ ID NO: 16720 - DNA, 20 bp, Artificial Sequence
  Description of Artificial Sequence: Synthetic oligonucleotide
  Target: DMPK; (-) strand; PAM type: YTN; PAM sequence: CTA
tcgcctcctctccctctgag

SEQ ID NO: 16721 - DNA, 20 bp, Artificial Sequence
  Description of Artificial Sequence: Synthetic oligonucleotide
  Target: DMPK; (-) strand; PAM type: YTN; PAM sequence: CTC
ccaggctatcgcctcctctc

SEQ ID NO: 16722 - DNA, 20 bp, Artificial Sequence
  Description of Artificial Sequence: Synthetic oligonucleotide
  Target: DMPK; (-) strand; PAM type: YTN; PAM sequence: CTC
ccggtaggcgctcccaggct

SEQ ID NO: 16723 - DNA, 20 bp, Artificial Sequence
  Description of Artificial Sequence: Synthetic oligonucleotide
  Target: DMPK; (-) strand; PAM type: YTN; PAM sequence: CTC
tcccggtaggcgctcccagg

SEQ ID NO: 16724 - DNA, 20 bp, Artificial Sequence
  Description of Artificial Sequence: Synthetic oligonucleotide
  Target: DMPK; (-) strand; PAM type: YTN; PAM sequence: CTG
gcctctcccggtaggcgctc

SEQ ID NO: 16725 - DNA, 20 bp, Artificial Sequence
  Description of Artificial Sequence: Synthetic oligonucleotide
  Target: DMPK; (-) strand; PAM type: YTN; PAM sequence: CTA
caaggtgagcacggccgcag

SEQ ID NO: 16726 - DNA, 20 bp, Artificial Sequence
  Description of Artificial Sequence: Synthetic oligonucleotide
  Target: DMPK; (-) strand; PAM type: YTN; PAM sequence: CTA
tggcaagatcgtccactaca

SEQ ID NO: 16727 - DNA, 20 bp, Artificial Sequence
  Description of Artificial Sequence: Synthetic oligonucleotide
  Target: DMPK; (-) strand; PAM type: YTN; PAM sequence: TTC
cacggcggagacctatggca

SEQ ID NO: 16728 - DNA, 20 bp, Artificial Sequence
  Description of Artificial Sequence: Synthetic oligonucleotide
  Target: DMPK; (-) strand; PAM type: YTN; PAM sequence: CTA
cgcggattccacggcggaga

SEQ ID NO: 16729 - DNA, 20 bp, Artificial Sequence
  Description of Artificial Sequence: Synthetic oligonucleotide
  Target: DMPK; (-) strand; PAM type: YTN; PAM sequence: TTC
tacgcggattccacggcgga

SEQ ID NO: 16730 - DNA, 20 bp, Artificial Sequence
  Description of Artificial Sequence: Synthetic oligonucleotide
  Target: DMPK; (-) strand; PAM type: YTN; PAM sequence: CTT
ctacgcggattccacggcgg

SEQ ID NO: 16731 - DNA, 20 bp, Artificial Sequence
  Description of Artificial Sequence: Synthetic oligonucleotide
  Target: DMPK; (-) strand; PAM type: YTN; PAM sequence: CTA
tgggcagacgcccttctacg

SEQ ID NO: 16732 - DNA, 20 bp, Artificial Sequence
  Description of Artificial Sequence: Synthetic oligonucleotide
  Target: DMPK; (-) strand; PAM type: YTN; PAM sequence: TTC
tatgggcagacgcccttcta

SEQ ID NO: 16733 - DNA, 20 bp, Artificial Sequence
  Description of Artificial Sequence: Synthetic oligonucleotide
  Target: DMPK; (-) strand; PAM type: YTN; PAM sequence: CTA
tgaaatgttctatgggcaga

SEQ ID NO: 16734 - DNA, 20 bp, Artificial Sequence
  Description of Artificial Sequence: Synthetic oligonucleotide
  Target: DMPK; (-) strand; PAM type: YTN; PAM sequence: TTC
gcctatgaaatgttctatgg

SEQ ID NO: 16735 - DNA, 20 bp, Artificial Sequence
  Description of Artificial Sequence: Synthetic oligonucleotide
  Target: DMPK; (-) strand; PAM type: YTN; PAM sequence: CTG
ggtgtattcgcctatgaaat

SEQ ID NO: 16736 - DNA, 20 bp, Artificial Sequence
  Description of Artificial Sequence: Synthetic oligonucleotide
  Target: DMPK; (-) strand; PAM type: YTN; PAM sequence: CTG
gtgggcgctgggtgtattcg

SEQ ID NO: 16737 - DNA, 20 bp, Artificial Sequence
  Description of Artificial Sequence: Synthetic oligonucleotide
  Target: DMPK; (-) strand; PAM type: YTN; PAM sequence: CTA
cgggcccgagtgtgactggt

SEQ ID NO: 16738 - DNA, 20 bp, Artificial Sequence
  Description of Artificial Sequence: Synthetic oligonucleotide
  Target: DMPK; (-) strand; PAM type: YTN; PAM sequence: CTG
ggacaggcagctacgggccc

SEQ ID NO: 16739 - DNA, 20 bp, Artificial Sequence
  Description of Artificial Sequence: Synthetic oligonucleotide
  Target: DMPK; (-) strand; PAM type: YTN; PAM sequence: CTG
tgggcggtgggcctgggaca

SEQ ID NO: 16740 - DNA, 20 bp, Artificial Sequence
  Description of Artificial Sequence: Synthetic oligonucleotide
  Target: DMPK; (-) strand; PAM type: YTN; PAM sequence: CTG
caggctgtgggcggtgggcc

SEQ ID NO: 16741 - DNA, 20 bp, Artificial Sequence
  Description of Artificial Sequence: Synthetic oligonucleotide
  Target: DMPK; (-) strand; PAM type: YTN; PAM sequence: CTG
tcccccgagatcctgcaggc

SEQ ID NO: 16742 - DNA, 20 bp, Artificial Sequence
  Description of Artificial Sequence: Synthetic oligonucleotide
  Target: DMPK; (-) strand; PAM type: YTN; PAM sequence: CTA
cctgtcccccgagatcctgc

SEQ ID NO: 16743 - DNA, 20 bp, Artificial Sequence
  Description of Artificial Sequence: Synthetic oligonucleotide
  Target: DMPK; (-) strand; PAM type: YTN; PAM sequence: CTG
tgggcaccccagactacctg

SEQ ID NO: 16744 - DNA, 20 bp, Artificial Sequence
  Description of Artificial Sequence: Synthetic oligonucleotide
  Target: DMPK; (-) strand; PAM type: YTN; PAM sequence: CTG
gtggctgtgggcaccccaga

SEQ ID NO: 16745 - DNA, 20 bp, Artificial Sequence
  Description of Artificial Sequence: Synthetic oligonucleotide
  Target: DMPK; (-) strand; PAM type: YTN; PAM sequence: TTG
gtccaggtgcggtcgctggt

SEQ ID NO: 16746 - DNA, 20 bp, Artificial Sequence
  Description of Artificial Sequence: Synthetic oligonucleotide
  Target: DMPK; (-) strand; PAM type: YTN; PAM sequence: TTT
ggtccaggtgcggtcgctgg

SEQ ID NO: 16747 - DNA, 20 bp, Artificial Sequence
  Description of Artificial Sequence: Synthetic oligonucleotide
  Target: DMPK; (-) strand; PAM type: YTN; PAM sequence: TTT
tggtccaggtgcggtcgctg

SEQ ID NO: 16748 - DNA, 20 bp, Artificial Sequence
  Description of Artificial Sequence: Synthetic oligonucleotide
  Target: DMPK; (-) strand; PAM type: YTN; PAM sequence: CTT
ttggtccaggtgcggtcgct

SEQ ID NO: 16749 - DNA, 20 bp, Artificial Sequence
  Description of Artificial Sequence: Synthetic oligonucleotide
  Target: DMPK; (-) strand; PAM type: YTN; PAM sequence: CTC
cttttggtccaggtgcggtc

SEQ ID NO: 16750 - DNA, 20 bp, Artificial Sequence
  Description of Artificial Sequence: Synthetic oligonucleotide
  Target: DMPK; (-) strand; PAM type: YTN; PAM sequence: CTG
ctccttttggtccaggtgcg

SEQ ID NO: 16751 - DNA, 20 bp, Artificial Sequence
  Description of Artificial Sequence: Synthetic oligonucleotide
  Target: DMPK; (-) strand; PAM type: YTN; PAM sequence: CTC
tgctccttttggtccaggtg

SEQ ID NO: 16752 - DNA, 20 bp, Artificial Sequence
  Description of Artificial Sequence: Synthetic oligonucleotide
  Target: DMPK; (-) strand; PAM type: YTN; PAM sequence: CTC
gctctgctccttttggtcca

SEQ ID NO: 16753 - DNA, 20 bp, Artificial Sequence
  Description of Artificial Sequence: Synthetic oligonucleotide
  Target: DMPK; (-) strand; PAM type: YTN; PAM sequence: CTG
gtgggcccagaggggtgggc

SEQ ID NO: 16754 - DNA, 20 bp, Artificial Sequence
  Description of Artificial Sequence: Synthetic oligonucleotide
  Target: DMPK; (-) strand; PAM type: YTN; PAM sequence: TTG
gaaggagggcccagagctgg

SEQ ID NO: 16755 - DNA, 20 bp, Artificial Sequence
  Description of Artificial Sequence: Synthetic oligonucleotide
  Target: DMPK; (-) strand; PAM type: YTN; PAM sequence: TTG
gggagtggttggaaggaggg

SEQ ID NO: 16756 - DNA, 20 bp, Artificial Sequence
  Description of Artificial Sequence: Synthetic oligonucleotide
  Target: DMPK; (-) strand; PAM type: YTN; PAM sequence: TTT
ggggagtggttggaaggagg

SEQ ID NO: 16757 - DNA, 20 bp, Artificial Sequence
  Description of Artificial Sequence: Synthetic oligonucleotide
  Target: DMPK; (-) strand; PAM type: YTN; PAM sequence: CTA
agcatttggggagtggttgg

SEQ ID NO: 16758 - DNA, 20 bp, Artificial Sequence
  Description of Artificial Sequence: Synthetic oligonucleotide
  Target: DMPK; (-) strand; PAM type: YTN; PAM sequence: TTA
gaccaggcagagggaggggc

SEQ ID NO: 16759 - DNA, 20 bp, Artificial Sequence
  Description of Artificial Sequence: Synthetic oligonucleotide
  Target: DMPK; (-) strand; PAM type: YTN; PAM sequence: CTG
tgtggcggagtattagacca

SEQ ID NO: 16760 - DNA, 20 bp, Artificial Sequence
  Description of Artificial Sequence: Synthetic oligonucleotide
  Target: DMPK; (-) strand; PAM type: YTN; PAM sequence: TTA
agtgtgcatctgtgtggcgg

SEQ ID NO: 16761 - DNA, 20 bp, Artificial Sequence
  Description of Artificial Sequence: Synthetic oligonucleotide
  Target: DMPK; (-) strand; PAM type: YTN; PAM sequence: CTT
aagtgtgcatctgtgtggcg

SEQ ID NO: 16762 - DNA, 20 bp, Artificial Sequence
  Description of Artificial Sequence: Synthetic oligonucleotide
  Target: DMPK; (-) strand; PAM type: YTN; PAM sequence: TTG
gaggggaaaagaggtggtgt

SEQ ID NO: 16763 - DNA, 20 bp, Artificial Sequence
  Description of Artificial Sequence: Synthetic oligonucleotide
  Target: DMPK; (-) strand; PAM type: YTN; PAM sequence: TTT
ggaggggaaaagaggtggtg

SEQ ID NO: 16764 - DNA, 20 bp, Artificial Sequence
  Description of Artificial Sequence: Synthetic oligonucleotide
  Target: DMPK; (-) strand; PAM type: YTN; PAM sequence: CTG
gatttggaggggaaaagagg

SEQ ID NO: 16765 - DNA, 20 bp, Artificial Sequence
  Description of Artificial Sequence: Synthetic oligonucleotide
  Target: DMPK; (-) strand; PAM type: YTN; PAM sequence: CTG
atgagggatggaaggcacag

SEQ ID NO: 16766 - DNA, 20 bp, Artificial Sequence
  Description of Artificial Sequence: Synthetic oligonucleotide
  Target: DMPK; (-) strand; PAM type: YTN; PAM sequence: CTG
ctgatgagggatggaaggca

SEQ ID NO: 16767 - DNA, 20 bp, Artificial Sequence
  Description of Artificial Sequence: Synthetic oligonucleotide
  Target: DMPK; (-) strand; PAM type: YTN; PAM sequence: CTG
gggctgctgatgagggatgg

SEQ ID NO: 16768 - DNA, 20 bp, Artificial Sequence
  Description of Artificial Sequence: Synthetic oligonucleotide
  Target: DMPK; (-) strand; PAM type: YTN; PAM sequence: CTG
gccacagagcaactggggct

SEQ ID NO: 16769 - DNA, 20 bp, Artificial Sequence
  Description of Artificial Sequence: Synthetic oligonucleotide
  Target: DMPK; (-) strand; PAM type: YTN; PAM sequence: CTG
cgggcagatggaacggtgag

SEQ ID NO: 16770 - DNA, 20 bp, Artificial Sequence
  Description of Artificial Sequence: Synthetic oligonucleotide
  Target: DMPK; (-) strand; PAM type: YTN; PAM sequence: CTC
aagctgcgggcagatggaac

SEQ ID NO: 16771 - DNA, 20 bp, Artificial Sequence
  Description of Artificial Sequence: Synthetic oligonucleotide
  Target: DMPK; (-) strand; PAM type: YTN; PAM sequence: TTG
cctcaagctgcgggcagatg

SEQ ID NO: 16772 - DNA, 20 bp, Artificial Sequence
  Description of Artificial Sequence: Synthetic oligonucleotide
  Target: DMPK; (-) strand; PAM type: YTN; PAM sequence: CTT
gcctcaagctgcgggcagat

SEQ ID NO: 16773 - DNA, 20 bp, Artificial Sequence
  Description of Artificial Sequence: Synthetic oligonucleotide
  Target: DMPK; (-) strand; PAM type: YTN; PAM sequence: CTC
ttgcctcaagctgcgggcag

SEQ ID NO: 16774 - DNA, 20 bp, Artificial Sequence
  Description of Artificial Sequence: Synthetic oligonucleotide
  Target: DMPK; (-) strand; PAM type: YTN; PAM sequence: TTC
ggctcttgcctcaagctgcg

SEQ ID NO: 16775 - DNA, 20 bp, Artificial Sequence
  Description of Artificial Sequence: Synthetic oligonucleotide
  Target: DMPK; (-) strand; PAM type: YTN; PAM sequence: CTT
cggctcttgcctcaagctgc

SEQ ID NO: 16776 - DNA, 20 bp, Artificial Sequence
  Description of Artificial Sequence: Synthetic oligonucleotide
  Target: DMPK; (-) strand; PAM type: YTN; PAM sequence: CTG
gccgacttcggctcttgcct

SEQ ID NO: 16777 - DNA, 20 bp, Artificial Sequence
  Description of Artificial Sequence: Synthetic oligonucleotide
  Target: DMPK; (-) strand; PAM type: YTN; PAM sequence: CTG
tggccacatccgcctggccg

SEQ ID NO: 16778 - DNA, 20 bp, Artificial Sequence
  Description of Artificial Sequence: Synthetic oligonucleotide
  Target: DMPK; (-) strand; PAM type: YTN; PAM sequence: CTG
gaccgctgtggccacatccg

SEQ ID NO: 16779 - DNA, 20 bp, Artificial Sequence
  Description of Artificial Sequence: Synthetic oligonucleotide
  Target: DMPK; (-) strand; PAM type: YTN; PAM sequence: CTG
ctggaccgctgtggccacat

SEQ ID NO: 16780 - DNA, 20 bp, Artificial Sequence
  Description of Artificial Sequence: Synthetic oligonucleotide
  Target: DMPK; (-) strand; PAM type: YTN; PAM sequence: CTC
cgtgcagggacatcaaaccc

SEQ ID NO: 16781 - DNA, 20 bp, Artificial Sequence
  Description of Artificial Sequence: Synthetic oligonucleotide
  Target: DMPK; (-) strand; PAM type: YTN; PAM sequence: TTC
ctccgtgcagggacatcaaa

SEQ ID NO: 16782 - DNA, 20 bp, Artificial Sequence
  Description of Artificial Sequence: Synthetic oligonucleotide
  Target: DMPK; (-) strand; PAM type: YTN; PAM sequence: TTT
cctccgtgcagggacatcaa

SEQ ID NO: 16783 - DNA, 20 bp, Artificial Sequence
  Description of Artificial Sequence: Synthetic oligonucleotide
  Target: DMPK; (-) strand; PAM type: YTN; PAM sequence: TTT
tcctccgtgcagggacatca

SEQ ID NO: 16784 - DNA, 20 bp, Artificial Sequence
  Description of Artificial Sequence: Synthetic oligonucleotide
  Target: DMPK; (-) strand; PAM type: YTN; PAM sequence: CTT
ttcctccgtgcagggacatc

SEQ ID NO: 16785 - DNA, 20 bp, Artificial Sequence
  Description of Artificial Sequence: Synthetic oligonucleotide
  Target: DMPK; (-) strand; PAM type: YTN; PAM sequence: CTC
ttttcctccgtgcagggaca

SEQ ID NO: 16786 - DNA, 20 bp, Artificial Sequence
  Description of Artificial Sequence: Synthetic oligonucleotide
  Target: DMPK; (-) strand; PAM type: YTN; PAM sequence: TTC
tcttttcctccgtgcaggga

SEQ ID NO: 16787 - DNA, 20 bp, Artificial Sequence
  Description of Artificial Sequence: Synthetic oligonucleotide
  Target: DMPK; (-) strand; PAM type: YTN; PAM sequence: CTT
ctcttttcctccgtgcaggg

SEQ ID NO: 16788 - DNA, 20 bp, Artificial Sequence
  Description of Artificial Sequence: Synthetic oligonucleotide
  Target: DMPK; (-) strand; PAM type: YTN; PAM sequence: TTA
tcccacccttctcttttcct

SEQ ID NO: 16789 - DNA, 20 bp, Artificial Sequence
  Description of Artificial Sequence: Synthetic oligonucleotide
  Target: DMPK; (-) strand; PAM type: YTN; PAM sequence: TTT
atcccacccttctcttttcc

SEQ ID NO: 16790 - DNA, 20 bp, Artificial Sequence
  Description of Artificial Sequence: Synthetic oligonucleotide
  Target: DMPK; (-) strand; PAM type: YTN; PAM sequence: TTC
atttatcccacccttctctt

SEQ ID NO: 16791 - DNA, 20 bp, Artificial Sequence
  Description of Artificial Sequence: Synthetic oligonucleotide
  Target: DMPK; (-) strand; PAM type: YTN; PAM sequence: CTG
gtgggaccacagaagggagg

SEQ ID NO: 16792 - DNA, 20 bp, Artificial Sequence
  Description of Artificial Sequence: Synthetic oligonucleotide
  Target: DMPK; (-) strand; PAM type: YTN; PAM sequence: CTG
cccggaggggcggagcctgg

SEQ ID NO: 16793 - DNA, 20 bp, Artificial Sequence
  Description of Artificial Sequence: Synthetic oligonucleotide
  Target: DMPK; (-) strand; PAM type: YTN; PAM sequence: CTA
caggggcggaacccgaggaa

SEQ ID NO: 16794 - DNA, 20 bp, Artificial Sequence
  Description of Artificial Sequence: Synthetic oligonucleotide
  Target: DMPK; (-) strand; PAM type: YTN; PAM sequence: CTG
tagaagccctacaggggcgg

SEQ ID NO: 16795 - DNA, 20 bp, Artificial Sequence
  Description of Artificial Sequence: Synthetic oligonucleotide
  Target: DMPK; (-) strand; PAM type: YTN; PAM sequence: CTG
ggagtaggggtcagaactgt

SEQ ID NO: 16796 - DNA, 20 bp, Artificial Sequence
  Description of Artificial Sequence: Synthetic oligonucleotide
  Target: DMPK; (-) strand; PAM type: YTN; PAM sequence: TTG
gggcccaccggggggtgcct

SEQ ID NO: 16797 - DNA, 20 bp, Artificial Sequence
  Description of Artificial Sequence: Synthetic oligonucleotide
  Target: DMPK; (-) strand; PAM type: YTN; PAM sequence: TTG
gttggggcccaccggggggt

SEQ ID NO: 16798 - DNA, 20 bp, Artificial Sequence
  Description of Artificial Sequence: Synthetic oligonucleotide
  Target: DMPK; (-) strand; PAM type: YTN; PAM sequence: CTT
ggttggggcccaccgggggg

SEQ ID NO: 16799 - DNA, 20 bp, Artificial Sequence
  Description of Artificial Sequence: Synthetic oligonucleotide
  Target: DMPK; (-) strand; PAM type: YTN; PAM sequence: TTC
ttggttggggcccaccgggg

SEQ ID NO: 16800 - DNA, 20 bp, Artificial Sequence
  Description of Artificial Sequence: Synthetic oligonucleotide
  Target: DMPK; (-) strand; PAM type: YTN; PAM sequence: CTT
cttggttggggcccaccggg

SEQ ID NO: 16801 - DNA, 20 bp, Artificial Sequence
  Description of Artificial Sequence: Synthetic oligonucleotide
  Target: DMPK; (-) strand; PAM type: YTN; PAM sequence: CTG
gagagggaccttcttggttg

SEQ ID NO: 16802 - DNA, 20 bp, Artificial Sequence
  Description of Artificial Sequence: Synthetic oligonucleotide
  Target: DMPK; (-) strand; PAM type: YTN; PAM sequence: TTG
gaaggtcagagcccagagag

SEQ ID NO: 16803 - DNA, 20 bp, Artificial Sequence
  Description of Artificial Sequence: Synthetic oligonucleotide
  Target: DMPK; (-) strand; PAM type: YTN; PAM sequence: CTT
ggaaggtcagagcccagaga

SEQ ID NO: 16804 - DNA, 20 bp, Artificial Sequence
  Description of Artificial Sequence: Synthetic oligonucleotide
  Target: DMPK; (-) strand; PAM type: YTN; PAM sequence: TTC
ttggaaggtcagagcccaga

SEQ ID NO: 16805 - DNA, 20 bp, Artificial Sequence
  Description of Artificial Sequence: Synthetic oligonucleotide
  Target: DMPK; (-) strand; PAM type: YTN; PAM sequence: CTG
gccgggttcttggaaggtca

SEQ ID NO: 16806 - DNA, 20 bp, Artificial Sequence
  Description of Artificial Sequence: Synthetic oligonucleotide
  Target: DMPK; (-) strand; PAM type: YTN; PAM sequence: TTC
cctggccgggttcttggaag

SEQ ID NO: 16807 - DNA, 20 bp, Artificial Sequence
  Description of Artificial Sequence: Synthetic oligonucleotide
  Target: DMPK; (-) strand; PAM type: YTN; PAM sequence: TTG
ttccctggccgggttcttgg

SEQ ID NO: 16808 - DNA, 20 bp, Artificial Sequence
  Description of Artificial Sequence: Synthetic oligonucleotide
  Target: DMPK; (-) strand; PAM type: YTN; PAM sequence: CTT
gttccctggccgggttcttg

SEQ ID NO: 16809 - DNA, 20 bp, Artificial Sequence
  Description of Artificial Sequence: Synthetic oligonucleotide
  Target: DMPK; (-) strand; PAM type: YTN; PAM sequence: CTA
cgtgcacaggtgggtgcagc

SEQ ID NO: 16810 - DNA, 20 bp, Artificial Sequence
  Description of Artificial Sequence: Synthetic oligonucleotide
  Target: DMPK; (-) strand; PAM type: YTN; PAM sequence: TTG
gctacgtgcacaggtgggtg

SEQ ID NO: 16811 - DNA, 20 bp, Artificial Sequence
  Description of Artificial Sequence: Synthetic oligonucleotide
  Target: DMPK; (-) strand; PAM type: YTN; PAM sequence: CTT
ggctacgtgcacaggtgggt

SEQ ID NO: 16812 - DNA, 20 bp, Artificial Sequence
  Description of Artificial Sequence: Synthetic oligonucleotide
  Target: DMPK; (-) strand; PAM type: YTN; PAM sequence: CTC
ggtgcaccggcttggctacg

SEQ ID NO: 16813 - DNA, 20 bp, Artificial Sequence
  Description of Artificial Sequence: Synthetic oligonucleotide
  Target: DMPK; (-) strand; PAM type: YTN; PAM sequence: TTG
tcatggccatagactcggtg

SEQ ID NO: 16814 - DNA, 20 bp, Artificial Sequence
  Description of Artificial Sequence: Synthetic oligonucleotide
  Target: DMPK; (-) strand; PAM type: YTN; PAM sequence: CTG
gcggagattgtcatggccat

SEQ ID NO: 16815 - DNA, 20 bp, Artificial Sequence
  Description of Artificial Sequence: Synthetic oligonucleotide
  Target: DMPK; (-) strand; PAM type: YTN; PAM sequence: CTA
cctggcggagattgtcatgg

SEQ ID NO: 16816 - DNA, 20 bp, Artificial Sequence
  Description of Artificial Sequence: Synthetic oligonucleotide
  Target: DMPK; (-) strand; PAM type: YTN; PAM sequence: TTC
tacctggcggagattgtcat

SEQ ID NO: 16817 - DNA, 20 bp, Artificial Sequence
  Description of Artificial Sequence: Synthetic oligonucleotide
  Target: DMPK; (-) strand; PAM type: YTN; PAM sequence: CTT
ctacctggcggagattgtca

SEQ ID NO: 16818 - DNA, 20 bp, Artificial Sequence
  Description of Artificial Sequence: Synthetic oligonucleotide
  Target: DMPK; (-) strand; PAM type: YTN; PAM sequence: TTC
cggccgagatggcgcgcttc

SEQ ID NO: 16819 - DNA, 20 bp, Artificial Sequence
  Description of Artificial Sequence: Synthetic oligonucleotide
  Target: DMPK; (-) strand; PAM type: YTN; PAM sequence: TTG
gggagcggattccggccgag

SEQ ID NO: 16820 - DNA, 20 bp, Artificial Sequence
  Description of Artificial Sequence: Synthetic oligonucleotide
  Target: DMPK; (-) strand; PAM type: YTN; PAM sequence: TTT
ggggagcggattccggccga

SEQ ID NO: 16821 - DNA, 20 bp, Artificial Sequence
  Description of Artificial Sequence: Synthetic oligonucleotide
  Target: DMPK; (-) strand; PAM type: YTN; PAM sequence: CTG
agcaagtttggggagcggat

SEQ ID NO: 16822 - DNA, 20 bp, Artificial Sequence
  Description of Artificial Sequence: Synthetic oligonucleotide
  Target: DMPK; (-) strand; PAM type: YTN; PAM sequence: CTG
ctgagcaagtttggggagcg

SEQ ID NO: 16823 - DNA, 20 bp, Artificial Sequence
  Description of Artificial Sequence: Synthetic oligonucleotide
  Target: DMPK; (-) strand; PAM type: YTN; PAM sequence: CTG
acactgctgagcaagtttgg

SEQ ID NO: 16824 - DNA, 20 bp, Artificial Sequence
  Description of Artificial Sequence: Synthetic oligonucleotide
  Target: DMPK; (-) strand; PAM type: YTN; PAM sequence: CTG
ctgacactgctgagcaagtt

SEQ ID NO: 16825 - DNA, 20 bp, Artificial Sequence
  Description of Artificial Sequence: Synthetic oligonucleotide
  Target: DMPK; (-) strand; PAM type: YTN; PAM sequence: TTA
cgtgggcggggacctgctga

SEQ ID NO: 16826 - DNA, 20 bp, Artificial Sequence
  Description of Artificial Sequence: Synthetic oligonucleotide
  Target: DMPK; (-) strand; PAM type: YTN; PAM sequence: CTG
gtcatggagtattacgtggg

SEQ ID NO: 16827 - DNA, 20 bp, Artificial Sequence
  Description of Artificial Sequence: Synthetic oligonucleotide
  Target: DMPK; (-) strand; PAM type: YTN; PAM sequence: CTC
agtacctggtcatggagtat

SEQ ID NO: 16828 - DNA, 20 bp, Artificial Sequence
  Description of Artificial Sequence: Synthetic oligonucleotide
  Target: DMPK; (-) strand; PAM type: YTN; PAM sequence: TTC
tcagtacctggtcatggagt

SEQ ID NO: 16829 - DNA, 20 bp, Artificial Sequence
  Description of Artificial Sequence: Synthetic oligonucleotide
  Target: DMPK; (-) strand; PAM type: YTN; PAM sequence: CTT
ctcagtacctggtcatggag

SEQ ID NO: 16830 - DNA, 20 bp, Artificial Sequence
  Description of Artificial Sequence: Synthetic oligonucleotide
  Target: DMPK; (-) strand; PAM type: YTN; PAM sequence: CTA
ccaaccacccatgacgaacc

SEQ ID NO: 16831 - DNA, 20 bp, Artificial Sequence
  Description of Artificial Sequence: Synthetic oligonucleotide
  Target: DMPK; (-) strand; PAM type: YTN; PAM sequence: CTC
aggggactaccaaccaccca

SEQ ID NO: 16832 - DNA, 20 bp, Artificial Sequence
  Description of Artificial Sequence: Synthetic oligonucleotide
  Target: DMPK; (-) strand; PAM type: YTN; PAM sequence: TTG
tcccagccatccgtgatgga

SEQ ID NO: 16833 - DNA, 20 bp, Artificial Sequence
  Description of Artificial Sequence: Synthetic oligonucleotide
  Target: DMPK; (-) strand; PAM type: YTN; PAM sequence: CTG
ggaggggttgtcccagccat

SEQ ID NO: 16834 - DNA, 20 bp, Artificial Sequence
  Description of Artificial Sequence: Synthetic oligonucleotide
  Target: DMPK; (-) strand; PAM type: YTN; PAM sequence: CTC
tgggaggggttgtcccagcc

SEQ ID NO: 16835 - DNA, 20 bp, Artificial Sequence
  Description of Artificial Sequence: Synthetic oligonucleotide
  Target: DMPK; (-) strand; PAM type: YTN; PAM sequence: CTG
cccaaggatggggtgtctct

SEQ ID NO: 16836 - DNA, 20 bp, Artificial Sequence
  Description of Artificial Sequence: Synthetic oligonucleotide
  Target: DMPK; (-) strand; PAM type: YTN; PAM sequence: CTC
tgcccaaggatggggtgtct

SEQ ID NO: 16837 - DNA, 20 bp, Artificial Sequence
  Description of Artificial Sequence: Synthetic oligonucleotide
  Target: DMPK; (-) strand; PAM type: YTN; PAM sequence: CTG
caggtctctgcccaaggatg

SEQ ID NO: 16838 - DNA, 20 bp, Artificial Sequence
  Description of Artificial Sequence: Synthetic oligonucleotide
  Target: DMPK; (-) strand; PAM type: YTN; PAM sequence: CTG
gggctgcaggtctctgccca

SEQ ID NO: 16839 - DNA, 20 bp, Artificial Sequence
  Description of Artificial Sequence: Synthetic oligonucleotide
  Target: DMPK; (-) strand; PAM type: YTN; PAM sequence: CTG
ggctggggctgcaggtctct

SEQ ID NO: 16840 - DNA, 20 bp, Artificial Sequence
  Description of Artificial Sequence: Synthetic oligonucleotide
  Target: DMPK; (-) strand; PAM type: YTN; PAM sequence: CTC
tgggctggggctgcaggtct

SEQ ID NO: 16841 - DNA, 20 bp, Artificial Sequence
  Description of Artificial Sequence: Synthetic oligonucleotide
  Target: DMPK; (-) strand; PAM type: YTN; PAM sequence: TTA
tctctgggctggggctgcag

SEQ ID NO: 16842 - DNA, 20 bp, Artificial Sequence
  Description of Artificial Sequence: Synthetic oligonucleotide
  Target: DMPK; (-) strand; PAM type: YTN; PAM sequence: CTA
tggttatctctgggctgggg

SEQ ID NO: 16843 - DNA, 20 bp, Artificial Sequence
  Description of Artificial Sequence: Synthetic oligonucleotide
  Target: DMPK; (-) strand; PAM type: YTN; PAM sequence: CTC
tatggttatctctgggctgg

SEQ ID NO: 16844 - DNA, 20 bp, Artificial Sequence
  Description of Artificial Sequence: Synthetic oligonucleotide
  Target: DMPK; (-) strand; PAM type: YTN; PAM sequence: TTG
gcccggcagatctctatggt

SEQ ID NO: 16845 - DNA, 20 bp, Artificial Sequence
  Description of Artificial Sequence: Synthetic oligonucleotide
  Target: DMPK; (-) strand; PAM type: YTN; PAM sequence: TTT
ggcccggcagatctctatgg

SEQ ID NO: 16846 - DNA, 20 bp, Artificial Sequence
  Description of Artificial Sequence: Synthetic oligonucleotide
  Target: DMPK; (-) strand; PAM type: YTN; PAM sequence: CTG
atttggcccggcagatctct

SEQ ID NO: 16847 - DNA, 20 bp, Artificial Sequence
  Description of Artificial Sequence: Synthetic oligonucleotide
  Target: DMPK; (-) strand; PAM type: YTN; PAM sequence: CTC
tgatttggcccggcagatct

SEQ ID NO: 16848 - DNA, 20 bp, Artificial Sequence
  Description of Artificial Sequence: Synthetic oligonucleotide
  Target: DMPK; (-) strand; PAM type: YTN; PAM sequence: TTG
aggggcgggggcgggggccg

SEQ ID NO: 16849 - DNA, 20 bp, Artificial Sequence
  Description of Artificial Sequence: Synthetic oligonucleotide
  Target: DMPK; (-) strand; PAM type: YTN; PAM sequence: TTT
gaggggcgggggcgggggcc

SEQ ID NO: 16850 - DNA, 20 bp, Artificial Sequence
  Description of Artificial Sequence: Synthetic oligonucleotide
  Target: DMPK; (-) strand; PAM type: YTN; PAM sequence: TTT
tgaggggcgggggcgggggc

SEQ ID NO: 16851 - DNA, 20 bp, Artificial Sequence
  Description of Artificial Sequence: Synthetic oligonucleotide
  Target: DMPK; (-) strand; PAM type: YTN; PAM sequence: TTT
ttgaggggcgggggcggggg

SEQ ID NO: 16852 - DNA, 20 bp, Artificial Sequence
  Description of Artificial Sequence: Synthetic oligonucleotide
  Target: DMPK; (-) strand; PAM type: YTN; PAM sequence: TTT
tttgaggggcgggggcgggg

SEQ ID NO: 16853 - DNA, 20 bp, Artificial Sequence
  Description of Artificial Sequence: Synthetic oligonucleotide
  Target: DMPK; (-) strand; PAM type: YTN; PAM sequence: TTT
ttttgaggggcgggggcggg

SEQ ID NO: 16854 - DNA, 20 bp, Artificial Sequence
  Description of Artificial Sequence: Synthetic oligonucleotide
  Target: DMPK; (-) strand; PAM type: YTN; PAM sequence: TTT
tttttgaggggcgggggcgg

SEQ ID NO: 16855 - DNA, 20 bp, Artificial Sequence
  Description of Artificial Sequence: Synthetic oligonucleotide
  Target: DMPK; (-) strand; PAM type: YTN; PAM sequence: TTT
ttttttgaggggcgggggcg

SEQ ID NO: 16856 - DNA, 20 bp, Artificial Sequence
  Description of Artificial Sequence: Synthetic oligonucleotide
  Target: DMPK; (-) strand; PAM type: YTN; PAM sequence: TTG
tgtttttttttgaggggcgg

SEQ ID NO: 16857 - DNA, 20 bp, Artificial Sequence
  Description of Artificial Sequence: Synthetic oligonucleotide
  Target: DMPK; (-) strand; PAM type: YTN; PAM sequence: TTT
gtgtttttttttgaggggcg

SEQ ID NO: 16858 - DNA, 20 bp, Artificial Sequence
  Description of Artificial Sequence: Synthetic oligonucleotide
  Target: DMPK; (-) strand; PAM type: YTN; PAM sequence: TTG
tttgtgtttttttttgaggg

SEQ ID NO: 16859 - DNA, 20 bp, Artificial Sequence
  Description of Artificial Sequence: Synthetic oligonucleotide
  Target: DMPK; (-) strand; PAM type: YTN; PAM sequence: TTT
gtttgtgtttttttttgagg

SEQ ID NO: 16860 - DNA, 20 bp, Artificial Sequence
  Description of Artificial Sequence: Synthetic oligonucleotide
  Target: DMPK; (-) strand; PAM type: YTN; PAM sequence: TTT
tgtttgtgtttttttttgag

SEQ ID NO: 16861 - DNA, 20 bp, Artificial Sequence
  Description of Artificial Sequence: Synthetic oligonucleotide
  Target: DMPK; (-) strand; PAM type: YTN; PAM sequence: TTT
ttgtttgtgtttttttttga

SEQ ID NO: 16862 - DNA, 20 bp, Artificial Sequence
  Description of Artificial Sequence: Synthetic oligonucleotide
  Target: DMPK; (-) strand; PAM type: YTN; PAM sequence: TTT
tttgtttgtgtttttttttg

SEQ ID NO: 16863 - DNA, 20 bp, Artificial Sequence
  Description of Artificial Sequence: Synthetic oligonucleotide
  Target: DMPK; (-) strand; PAM type: YTN; PAM sequence: TTT
ttttgtttgtgttttttttt

SEQ ID NO: 16864 - DNA, 20 bp, Artificial Sequence
  Description of Artificial Sequence: Synthetic oligonucleotide
  Target: DMPK; (-) strand; PAM type: YTN; PAM sequence: CTG
cccagtgacatcccaggaaa

SEQ ID NO: 16865 - DNA, 20 bp, Artificial Sequence
  Description of Artificial Sequence: Synthetic oligonucleotide
  Target: DMPK; (-) strand; PAM type: YTN; PAM sequence: CTC
agggggagtgaatctgccca

SEQ ID NO: 16866 - DNA, 20 bp, Artificial Sequence
  Description of Artificial Sequence: Synthetic oligonucleotide
  Target: DMPK; (-) strand; PAM type: YTN; PAM sequence: TTC
ccagaacatctcagggggag

SEQ ID NO: 16867 - DNA, 20 bp, Artificial Sequence
  Description of Artificial Sequence: Synthetic oligonucleotide
  Target: DMPK; (-) strand; PAM type: YTN; PAM sequence: TTT
cccagaacatctcaggggga

SEQ ID NO: 16868 - DNA, 20 bp, Artificial Sequence
  Description of Artificial Sequence: Synthetic oligonucleotide
  Target: DMPK; (-) strand; PAM type: YTN; PAM sequence: CTT
tcccagaacatctcaggggg

SEQ ID NO: 16869 - DNA, 20 bp, Artificial Sequence
  Description of Artificial Sequence: Synthetic oligonucleotide
  Target: DMPK; (-) strand; PAM type: YTN; PAM sequence: CTC
tttcccagaacatctcaggg

SEQ ID NO: 16870 - DNA, 20 bp, Artificial Sequence
  Description of Artificial Sequence: Synthetic oligonucleotide
  Target: DMPK; (-) strand; PAM type: YTN; PAM sequence: TTC
tctttcccagaacatctcag

SEQ ID NO: 16871 - DNA, 20 bp, Artificial Sequence
  Description of Artificial Sequence: Synthetic oligonucleotide
  Target: DMPK; (-) strand; PAM type: YTN; PAM sequence: CTG
ggttctctttcccagaacat

SEQ ID NO: 16872 - DNA, 20 bp, Artificial Sequence
  Description of Artificial Sequence: Synthetic oligonucleotide
  Target: DMPK; (-) strand; PAM type: YTN; PAM sequence: CTC
tgggttctctttcccagaac

SEQ ID NO: 16873 - DNA, 20 bp, Artificial Sequence
  Description of Artificial Sequence: Synthetic oligonucleotide
  Target: DMPK; (-) strand; PAM type: YTN; PAM sequence: TTG
ggtggcctctgggttctctt

SEQ ID NO: 16874 - DNA, 20 bp, Artificial Sequence
  Description of Artificial Sequence: Synthetic oligonucleotide
  Target: DMPK; (-) strand; PAM type: YTN; PAM sequence: CTG
ggtgttgggtggcctctggg

SEQ ID NO: 16875 - DNA, 20 bp, Artificial Sequence
  Description of Artificial Sequence: Synthetic oligonucleotide
  Target: DMPK; (-) strand; PAM type: YTN; PAM sequence: CTC
tgggtgttgggtggcctctg

SEQ ID NO: 16876 - DNA, 20 bp, Artificial Sequence
  Description of Artificial Sequence: Synthetic oligonucleotide
  Target: DMPK; (-) strand; PAM type: YTN; PAM sequence: TTC
tctgggtgttgggtggcctc

SEQ ID NO: 16877 - DNA, 20 bp, Artificial Sequence
  Description of Artificial Sequence: Synthetic oligonucleotide
  Target: DMPK; (-) strand; PAM type: YTN; PAM sequence: CTA
ttctctgggtgttgggtggc

SEQ ID NO: 16878 - DNA, 20 bp, Artificial Sequence
  Description of Artificial Sequence: Synthetic oligonucleotide
  Target: DMPK; (-) strand; PAM type: YTN; PAM sequence: CTG
ggacctattctctgggtgtt

SEQ ID NO: 16879 - DNA, 20 bp, Artificial Sequence
  Description of Artificial Sequence: Synthetic oligonucleotide
  Target: DMPK; (-) strand; PAM type: YTN; PAM sequence: CTA
gggaaggagtgtctgggacc

SEQ ID NO: 16880 - DNA, 20 bp, Artificial Sequence
  Description of Artificial Sequence: Synthetic oligonucleotide
  Target: DMPK; (-) strand; PAM type: YTN; PAM sequence: CTG
cctagggaaggagtgtctgg

SEQ ID NO: 16881 - DNA, 20 bp, Artificial Sequence
  Description of Artificial Sequence: Synthetic oligonucleotide
  Target: DMPK; (-) strand; PAM type: YTN; PAM sequence: CTA
acggggccactgcctaggga

SEQ ID NO: 16882 - DNA, 20 bp, Artificial Sequence
  Description of Artificial Sequence: Synthetic oligonucleotide
  Target: DMPK; (-) strand; PAM type: YTN; PAM sequence: TTC
taacggggccactgcctagg

SEQ ID NO: 16883 - DNA, 20 bp, Artificial Sequence
  Description of Artificial Sequence: Synthetic oligonucleotide
  Target: DMPK; (-) strand; PAM type: YTN; PAM sequence: TTC
aggaattctaacggggccac

SEQ ID NO: 16884 - DNA, 20 bp, Artificial Sequence
  Description of Artificial Sequence: Synthetic oligonucleotide
  Target: DMPK; (-) strand; PAM type: YTN; PAM sequence: CTT
caggaattctaacggggcca

SEQ ID NO: 16885 - DNA, 20 bp, Artificial Sequence
  Description of Artificial Sequence: Synthetic oligonucleotide
  Target: DMPK; (-) strand; PAM type: YTN; PAM sequence: CTG
gaatgggataggtcttcagg

SEQ ID NO: 16886 - DNA, 20 bp, Artificial Sequence
  Description of Artificial Sequence: Synthetic oligonucleotide
  Target: DMPK; (-) strand; PAM type: YTN; PAM sequence: TTA
cctggaatgggataggtctt

SEQ ID NO: 16887 - DNA, 20 bp, Artificial Sequence
  Description of Artificial Sequence: Synthetic oligonucleotide
  Target: DMPK; (-) strand; PAM type: YTN; PAM sequence: CTT
acctggaatgggataggtct

SEQ ID NO: 16888 - DNA, 20 bp, Artificial Sequence
  Description of Artificial Sequence: Synthetic oligonucleotide
  Target: DMPK; (-) strand; PAM type: YTN; PAM sequence: CTC
ttacctggaatgggataggt

SEQ ID NO: 16889 - DNA, 20 bp, Artificial Sequence
  Description of Artificial Sequence: Synthetic oligonucleotide
  Target: DMPK; (-) strand; PAM type: YTN; PAM sequence: TTG
cggggggtctcttacctgga

SEQ ID NO: 16890 - DNA, 20 bp, Artificial Sequence
  Description of Artificial Sequence: Synthetic oligonucleotide
  Target: DMPK; (-) strand; PAM type: YTN; PAM sequence: CTG
ttgcggggggtctcttacct

SEQ ID NO: 16891 - DNA, 20 bp, Artificial Sequence
  Description of Artificial Sequence: Synthetic oligonucleotide
  Target: DMPK; (-) strand; PAM type: YTN; PAM sequence: CTC
tgttgcggggggtctcttac

SEQ ID NO: 16892 - DNA, 20 bp, Artificial Sequence
  Description of Artificial Sequence: Synthetic oligonucleotide
  Target: DMPK; (-) strand; PAM type: YTN; PAM sequence: TTA
taaagatgtctctgttgcgg

SEQ ID NO: 16893 - DNA, 20 bp, Artificial Sequence
  Description of Artificial Sequence: Synthetic oligonucleotide
  Target: DMPK; (-) strand; PAM type: YTN; PAM sequence: CTT
ataaagatgtctctgttgcg

SEQ ID NO: 16894 - DNA, 20 bp, Artificial Sequence
  Description of Artificial Sequence: Synthetic oligonucleotide
  Target: DMPK; (-) strand; PAM type: YTN; PAM sequence: CTC
ttataaagatgtctctgttg

SEQ ID NO: 16895 - DNA, 20 bp, Artificial Sequence
  Description of Artificial Sequence: Synthetic oligonucleotide
  Target: DMPK; (-) strand; PAM type: YTN; PAM sequence: CTG
ggggactcttataaagatgt

SEQ ID NO: 16896 - DNA, 20 bp, Artificial Sequence
  Description of Artificial Sequence: Synthetic oligonucleotide
  Target: DMPK; (-) strand; PAM type: YTN; PAM sequence: CTG
gggtgatctgggggactctt

SEQ ID NO: 16897 - DNA, 20 bp, Artificial Sequence
  Description of Artificial Sequence: Synthetic oligonucleotide
  Target: DMPK; (-) strand; PAM type: YTN; PAM sequence: TTC
tggggtgatctgggggactc

SEQ ID NO: 16898 - DNA, 20 bp, Artificial Sequence
  Description of Artificial Sequence: Synthetic oligonucleotide
  Target: DMPK; (-) strand; PAM type: YTN; PAM sequence: TTT
ctggggtgatctgggggact

SEQ ID NO: 16899 - DNA, 20 bp, Artificial Sequence
  Description of Artificial Sequence: Synthetic oligonucleotide
  Target: DMPK; (-) strand; PAM type: YTN; PAM sequence: CTG
cccgtttctggggtgatctg

SEQ ID NO: 16900 - DNA, 20 bp, Artificial Sequence
  Description of Artificial Sequence: Synthetic oligonucleotide
  Target: DMPK; (-) strand; PAM type: YTN; PAM sequence: TTC
actgcccgtttctggggtga

SEQ ID NO: 16901 - DNA, 20 bp, Artificial Sequence
  Description of Artificial Sequence: Synthetic oligonucleotide
  Target: DMPK; (-) strand; PAM type: YTN; PAM sequence: CTT
cactgcccgtttctggggtg

SEQ ID NO: 16902 - DNA, 20 bp, Artificial Sequence
  Description of Artificial Sequence: Synthetic oligonucleotide
  Target: DMPK; (-) strand; PAM type: YTN; PAM sequence: CTG
agacggggatggtgtccttc

SEQ ID NO: 16903 - DNA, 20 bp, Artificial Sequence
  Description of Artificial Sequence: Synthetic oligonucleotide
  Target: DMPK; (-) strand; PAM type: YTN; PAM sequence: CTA
tctgagacggggatggtgtc

SEQ ID NO: 16904 - DNA, 20 bp, Artificial Sequence
  Description of Artificial Sequence: Synthetic oligonucleotide
  Target: DMPK; (-) strand; PAM type: YTN; PAM sequence: TTC
cctatctgagacggggatgg

SEQ ID NO: 16905 - DNA, 20 bp, Artificial Sequence
  Description of Artificial Sequence: Synthetic oligonucleotide
  Target: DMPK; (-) strand; PAM type: YTN; PAM sequence: CTT
ccctatctgagacggggatg

SEQ ID NO: 16906 - DNA, 20 bp, Artificial Sequence
  Description of Artificial Sequence: Synthetic oligonucleotide
  Target: DMPK; (-) strand; PAM type: YTN; PAM sequence: CTG
tgtgcggtaagagggtgtgt

SEQ ID NO: 16907 - DNA, 20 bp, Artificial Sequence
  Description of Artificial Sequence: Synthetic oligonucleotide
  Target: DMPK; (-) strand; PAM type: YTN; PAM sequence: CTG
tgggaaagtctgtgtgcggt

SEQ ID NO: 16908 - DNA, 20 bp, Artificial Sequence
  Description of Artificial Sequence: Synthetic oligonucleotide
  Target: DMPK; (-) strand; PAM type: YTN; PAM sequence: CTG
cccggaaacgtctgtgggaa

SEQ ID NO: 16909 - DNA, 20 bp, Artificial Sequence
  Description of Artificial Sequence: Synthetic oligonucleotide
  Target: DMPK; (-) strand; PAM type: YTN; PAM sequence: TTG
ggggtgctgcccggaaacgt

SEQ ID NO: 16910 - DNA, 20 bp, Artificial Sequence
  Description of Artificial Sequence: Synthetic oligonucleotide
  Target: DMPK; (-) strand; PAM type: YTN; PAM sequence: CTA
ggattgggggtgctgcccgg

SEQ ID NO: 16911 - DNA, 20 bp, Artificial Sequence
  Description of Artificial Sequence: Synthetic oligonucleotide
  Target: DMPK; (-) strand; PAM type: YTN; PAM sequence: CTC
taggattgggggtgctgccc

SEQ ID NO: 16912 - DNA, 20 bp, Artificial Sequence
  Description of Artificial Sequence: Synthetic oligonucleotide
  Target: DMPK; (-) strand; PAM type: YTN; PAM sequence: CTG
gacgaggaggtggggagagg

SEQ ID NO: 16913 - DNA, 20 bp, Artificial Sequence
  Description of Artificial Sequence: Synthetic oligonucleotide
  Target: DMPK; (-) strand; PAM type: YTN; PAM sequence: CTG
tcactggacgaggaggtggg

SEQ ID NO: 16914 - DNA, 20 bp, Artificial Sequence
  Description of Artificial Sequence: Synthetic oligonucleotide
  Target: DMPK; (-) strand; PAM type: YTN; PAM sequence: CTA
ggaagagggacaagagcccg

SEQ ID NO: 16915 - DNA, 20 bp, Artificial Sequence
  Description of Artificial Sequence: Synthetic oligonucleotide
  Target: DMPK; (-) strand; PAM type: YTN; PAM sequence: CTC
cgggccggggtgactaggaa

SEQ ID NO: 16916 - DNA, 20 bp, Artificial Sequence
  Description of Artificial Sequence: Synthetic oligonucleotide
  Target: DMPK; (-) strand; PAM type: YTN; PAM sequence: CTG
gtgagctccgggccggggtg

SEQ ID NO: 16917 - DNA, 20 bp, Artificial Sequence
  Description of Artificial Sequence: Synthetic oligonucleotide
  Target: DMPK; (-) strand; PAM type: YTN; PAM sequence: CTA
cctggtgagctccgggccgg

SEQ ID NO: 16918 - DNA, 20 bp, Artificial Sequence
  Description of Artificial Sequence: Synthetic oligonucleotide
  Target: DMPK; (-) strand; PAM type: YTN; PAM sequence: TTC
caggatgagaactacctggt

SEQ ID NO: 16919 - DNA, 20 bp, Artificial Sequence
  Description of Artificial Sequence: Synthetic oligonucleotide
  Target: DMPK; (-) strand; PAM type: YTN; PAM sequence: CTT
ccaggatgagaactacctgg

SEQ ID NO: 16920 - DNA, 20 bp, Artificial Sequence
  Description of Artificial Sequence: Synthetic oligonucleotide
  Target: DMPK; (-) strand; PAM type: YTN; PAM sequence: TTC
gccttccaggatgagaacta

SEQ ID NO: 16921 - DNA, 20 bp, Artificial Sequence
  Description of Artificial Sequence: Synthetic oligonucleotide
  Target: DMPK; (-) strand; PAM type: YTN; PAM sequence: CTT
cgccttccaggatgagaact

SEQ ID NO: 16922 - DNA, 20 bp, Artificial Sequence
  Description of Artificial Sequence: Synthetic oligonucleotide
  Target: DMPK; (-) strand; PAM type: YTN; PAM sequence: CTG
cacttcgccttccaggatga

SEQ ID NO: 16923 - DNA, 20 bp, Artificial Sequence
  Description of Artificial Sequence: Synthetic oligonucleotide
  Target: DMPK; (-) strand; PAM type: YTN; PAM sequence: TTG
gtgaatggggaccggcggtg

SEQ ID NO: 16924 - DNA, 20 bp, Artificial Sequence
  Description of Artificial Sequence: Synthetic oligonucleotide
  Target: DMPK; (-) strand; PAM type: YTN; PAM sequence: TTC
cgtgaggagagggacgtgtt

SEQ ID NO: 16925 - DNA, 20 bp, Artificial Sequence
  Description of Artificial Sequence: Synthetic oligonucleotide
  Target: DMPK; (-) strand; PAM type: YTN; PAM sequence: CTT
ccgtgaggagagggacgtgt

SEQ ID NO: 16926 - DNA, 20 bp, Artificial Sequence
  Description of Artificial Sequence: Synthetic oligonucleotide
  Target: DMPK; (-) strand; PAM type: YTN; PAM sequence: CTG
caggtgtcgtgcttccgtga

SEQ ID NO: 16927 - DNA, 20 bp, Artificial Sequence
  Description of Artificial Sequence: Synthetic oligonucleotide
  Target: DMPK; (-) strand; PAM type: YTN; PAM sequence: CTC
cgggtgccctgcaggtgtcg

SEQ ID NO: 16928 - DNA, 20 bp, Artificial Sequence
  Description of Artificial Sequence: Synthetic oligonucleotide
  Target: DMPK; (-) strand; PAM type: YTN; PAM sequence: CTC
ctccgggtgccctgcaggtg

SEQ ID NO: 16929 - DNA, 20 bp, Artificial Sequence
  Description of Artificial Sequence: Synthetic oligonucleotide
  Target: DMPK; (-) strand; PAM type: YTN; PAM sequence: CTG
cagctcctccgggtgccctg

SEQ ID NO: 16930 - DNA, 20 bp, Artificial Sequence
  Description of Artificial Sequence: Synthetic oligonucleotide
  Target: DMPK; (-) strand; PAM type: YTN; PAM sequence: CTC
cggctgcagctcctccgggt

SEQ ID NO: 16931 - DNA, 20 bp, Artificial Sequence
  Description of Artificial Sequence: Synthetic oligonucleotide
  Target: DMPK; (-) strand; PAM type: YTN; PAM sequence: TTG
aggatccgcgccccgtctcc

SEQ ID NO: 16932 - DNA, 20 bp, Artificial Sequence
  Description of Artificial Sequence: Synthetic oligonucleotide
  Target: DMPK; (-) strand; PAM type: YTN; PAM sequence: TTT
gaggatccgcgccccgtctc

SEQ ID NO: 16933 - DNA, 20 bp, Artificial Sequence
  Description of Artificial Sequence: Synthetic oligonucleotide
  Target: DMPK; (-) strand; PAM type: YTN; PAM sequence: CTT
tgaggatccgcgccccgtct

SEQ ID NO: 16934 - DNA, 20 bp, Artificial Sequence
  Description of Artificial Sequence: Synthetic oligonucleotide
  Target: DMPK; (-) strand; PAM type: YTN; PAM sequence: CTG
ggcggacgtggggggctttg

SEQ ID NO: 16935 - DNA, 20 bp, Artificial Sequence
  Description of Artificial Sequence: Synthetic oligonucleotide
  Target: DMPK; (-) strand; PAM type: YTN; PAM sequence: CTG
aagaggggcgaggtgagggg

SEQ ID NO: 16936 - DNA, 20 bp, Artificial Sequence
  Description of Artificial Sequence: Synthetic oligonucleotide
  Target: DMPK; (-) strand; PAM type: YTN; PAM sequence: CTC
aggtagcggtagtgaagatg

SEQ ID NO: 16937 - DNA, 20 bp, Artificial Sequence
  Description of Artificial Sequence: Synthetic oligonucleotide
  Target: DMPK; (-) strand; PAM type: YTN; PAM sequence: CTC
gacctcaggtagcggtagtg

SEQ ID NO: 16938 - DNA, 20 bp, Artificial Sequence
  Description of Artificial Sequence: Synthetic oligonucleotide
  Target: DMPK; (-) strand; PAM type: YTN; PAM sequence: CTA
tctcgacctcaggtagcggt

SEQ ID NO: 16939 - DNA, 20 bp, Artificial Sequence
  Description of Artificial Sequence: Synthetic oligonucleotide
  Target: DMPK; (-) strand; PAM type: YTN; PAM sequence: CTC
actatctcgacctcaggtag

SEQ ID NO: 16940 - DNA, 20 bp, Artificial Sequence
  Description of Artificial Sequence: Synthetic oligonucleotide
  Target: DMPK; (-) strand; PAM type: YTN; PAM sequence: CTG
tctcactatctcgacctcag

SEQ ID NO: 16941 - DNA, 20 bp, Artificial Sequence
  Description of Artificial Sequence: Synthetic oligonucleotide
  Target: DMPK; (-) strand; PAM type: YTN; PAM sequence: CTC
tgtctcactatctcgacctc

SEQ ID NO: 16942 - DNA, 20 bp, Artificial Sequence
  Description of Artificial Sequence: Synthetic oligonucleotide
  Target: DMPK; (-) strand; PAM type: YTN; PAM sequence: CTC
cactctgtctcactatctcg

SEQ ID NO: 16943 - DNA, 20 bp, Artificial Sequence
  Description of Artificial Sequence: Synthetic oligonucleotide
  Target: DMPK; (-) strand; PAM type: YTN; PAM sequence: TTC
ccgccgtctccactctgtct

SEQ ID NO: 16944 - DNA, 20 bp, Artificial Sequence
  Description of Artificial Sequence: Synthetic oligonucleotide
  Target: DMPK; (-) strand; PAM type: YTN; PAM sequence: TTT
cccgccgtctccactctgtc

SEQ ID NO: 16945 - DNA, 20 bp, Artificial Sequence
  Description of Artificial Sequence: Synthetic oligonucleotide
  Target: DMPK; (-) strand; PAM type: YTN; PAM sequence: TTT
tcccgccgtctccactctgt

SEQ ID NO: 16946 - DNA, 20 bp, Artificial Sequence
  Description of Artificial Sequence: Synthetic oligonucleotide
  Target: DMPK; (-) strand; PAM type: YTN; PAM sequence: TTG
ttttcccgccgtctccactc

SEQ ID NO: 16947 - DNA, 20 bp, Artificial Sequence
  Description of Artificial Sequence: Synthetic oligonucleotide
  Target: DMPK; (-) strand; PAM type: YTN; PAM sequence: TTT
gttttcccgccgtctccact

SEQ ID NO: 16948 - DNA, 20 bp, Artificial Sequence
  Description of Artificial Sequence: Synthetic oligonucleotide
  Target: DMPK; (-) strand; PAM type: YTN; PAM sequence: TTT
tgttttcccgccgtctccac

SEQ ID NO: 16949 - DNA, 20 bp, Artificial Sequence
  Description of Artificial Sequence: Synthetic oligonucleotide
  Target: DMPK; (-) strand; PAM type: YTN; PAM sequence: CTT
ttgttttcccgccgtctcca

SEQ ID NO: 16950 - DNA, 20 bp, Artificial Sequence
  Description of Artificial Sequence: Synthetic oligonucleotide
  Target: DMPK; (-) strand; PAM type: YTN; PAM sequence: CTG
ggcgagcccttttgttttcc

SEQ ID NO: 16951 - DNA, 20 bp, Artificial Sequence
  Description of Artificial Sequence: Synthetic oligonucleotide
  Target: DMPK; (-) strand; PAM type: YTN; PAM sequence: TTG
ggtctgggcgagcccttttg

SEQ ID NO: 16952 - DNA, 20 bp, Artificial Sequence
  Description of Artificial Sequence: Synthetic oligonucleotide
  Target: DMPK; (-) strand; PAM type: YTN; PAM sequence: CTG
ggtgcagaagcgggtggagt

SEQ ID NO: 16953 - DNA, 20 bp, Artificial Sequence
  Description of Artificial Sequence: Synthetic oligonucleotide
  Target: DMPK; (-) strand; PAM type: YTN; PAM sequence: TTG
ggaccaatgggcgtggtgtg

SEQ ID NO: 16954 - DNA, 20 bp, Artificial Sequence
  Description of Artificial Sequence: Synthetic oligonucleotide
  Target: DMPK; (-) strand; PAM type: YTN; PAM sequence: CTT
gggaccaatgggcgtggtgt

SEQ ID NO: 16955 - DNA, 20 bp, Artificial Sequence
  Description of Artificial Sequence: Synthetic oligonucleotide
  Target: DMPK; (-) strand; PAM type: YTN; PAM sequence: CTG
gaggcggggcttgggaccaa

SEQ ID NO: 16956 - DNA, 20 bp, Artificial Sequence
  Description of Artificial Sequence: Synthetic oligonucleotide
  Target: DMPK; (-) strand; PAM type: YTN; PAM sequence: CTG
ggctggaggcggggcttggg

SEQ ID NO: 16957 - DNA, 20 bp, Artificial Sequence
  Description of Artificial Sequence: Synthetic oligonucleotide
  Target: DMPK; (-) strand; PAM type: YTN; PAM sequence: CTA
gggctgggctggaggcgggg

SEQ ID NO: 16958 - DNA, 20 bp, Artificial Sequence
  Description of Artificial Sequence: Synthetic oligonucleotide
  Target: DMPK; (-) strand; PAM type: YTN; PAM sequence: TTA
gaacctagggctgggctgga

SEQ ID NO: 16959 - DNA, 20 bp, Artificial Sequence
  Description of Artificial Sequence: Synthetic oligonucleotide
  Target: DMPK; (-) strand; PAM type: YTN; PAM sequence: CTT
agaacctagggctgggctgg

SEQ ID NO: 16960 - DNA, 20 bp, Artificial Sequence
  Description of Artificial Sequence: Synthetic oligonucleotide
  Target: DMPK; (-) strand; PAM type: YTN; PAM sequence: TTG
atgaatgaccgagccttaga

SEQ ID NO: 16961 - DNA, 20 bp, Artificial Sequence
  Description of Artificial Sequence: Synthetic oligonucleotide
  Target: DMPK; (-) strand; PAM type: YTN; PAM sequence: TTA
gaaattgatgaatgaccgag

SEQ ID NO: 16962 - DNA, 20 bp, Artificial Sequence
  Description of Artificial Sequence: Synthetic oligonucleotide
  Target: DMPK; (-) strand; PAM type: YTN; PAM sequence: CTT
agaaattgatgaatgaccga

SEQ ID NO: 16963 - DNA, 20 bp, Artificial Sequence
  Description of Artificial Sequence: Synthetic oligonucleotide
  Target: DMPK; (-) strand; PAM type: YTN; PAM sequence: TTG
gggcggggccttagaaattg

SEQ ID NO: 16964 - DNA, 20 bp, Artificial Sequence
  Description of Artificial Sequence: Synthetic oligonucleotide
  Target: DMPK; (-) strand; PAM type: YTN; PAM sequence: CTC
gtggtgggcggggcataggg

SEQ ID NO: 16965 - DNA, 20 bp, Artificial Sequence
  Description of Artificial Sequence: Synthetic oligonucleotide
  Target: DMPK; (-) strand; PAM type: YTN; PAM sequence: TTG
actcgtggtgggcggggcat

SEQ ID NO: 16966 - DNA, 20 bp, Artificial Sequence
  Description of Artificial Sequence: Synthetic oligonucleotide
  Target: DMPK; (-) strand; PAM type: YTN; PAM sequence: CTT
gactcgtggtgggcggggca

SEQ ID NO: 16967 - DNA, 20 bp, Artificial Sequence
  Description of Artificial Sequence: Synthetic oligonucleotide
  Target: DMPK; (-) strand; PAM type: YTN; PAM sequence: CTG
acttgactcgtggtgggcgg

SEQ ID NO: 16968 - DNA, 20 bp, Artificial Sequence
  Description of Artificial Sequence: Synthetic oligonucleotide
  Target: DMPK; (-) strand; PAM type: YTN; PAM sequence: TTC
agcgaggtaagccgaaccgg

SEQ ID NO: 16969 - DNA, 20 bp, Artificial Sequence
  Description of Artificial Sequence: Synthetic oligonucleotide
  Target: DMPK; (-) strand; PAM type: YTN; PAM sequence: CTG
aaggtgatcggacgcggggc

SEQ ID NO: 16970 - DNA, 20 bp, Artificial Sequence
  Description of Artificial Sequence: Synthetic oligonucleotide
  Target: DMPK; (-) strand; PAM type: YTN; PAM sequence: TTC
tgaaggtgatcggacgcggg

SEQ ID NO: 16971 - DNA, 20 bp, Artificial Sequence
  Description of Artificial Sequence: Synthetic oligonucleotide
  Target: DMPK; (-) strand; PAM type: YTN; PAM sequence: TTC
gagattctgaaggtgatcgg

SEQ ID NO: 16972 - DNA, 20 bp, Artificial Sequence
  Description of Artificial Sequence: Synthetic oligonucleotide
  Target: DMPK; (-) strand; PAM type: YTN; PAM sequence: CTT
cgagattctgaaggtgatcg

SEQ ID NO: 16973 - DNA, 20 bp, Artificial Sequence
  Description of Artificial Sequence: Synthetic oligonucleotide
  Target: DMPK; (-) strand; PAM type: YTN; PAM sequence: CTG
cagagggacgacttcgagat

SEQ ID NO: 16974 - DNA, 20 bp, Artificial Sequence
  Description of Artificial Sequence: Synthetic oligonucleotide
  Target: DMPK; (-) strand; PAM type: YTN; PAM sequence: TTA
aggaggtccgactgcagagg

SEQ ID NO: 16975 - DNA, 20 bp, Artificial Sequence
  Description of Artificial Sequence: Synthetic oligonucleotide
  Target: DMPK; (-) strand; PAM type: YTN; PAM sequence: CTT
aaggaggtccgactgcagag

SEQ ID NO: 16976 - DNA, 20 bp, Artificial Sequence
  Description of Artificial Sequence: Synthetic oligonucleotide
  Target: DMPK; (-) strand; PAM type: YTN; PAM sequence: TTC
ccccaccacccccccagcgg

SEQ ID NO: 16977 - DNA, 20 bp, Artificial Sequence
  Description of Artificial Sequence: Synthetic oligonucleotide
  Target: DMPK; (-) strand; PAM type: YTN; PAM sequence: TTT
cccccaccacccccccagcg

SEQ ID NO: 16978 - DNA, 20 bp, Artificial Sequence
  Description of Artificial Sequence: Synthetic oligonucleotide
  Target: DMPK; (-) strand; PAM type: YTN; PAM sequence: TTT
tcccccaccacccccccagc

SEQ ID NO: 16979 - DNA, 20 bp, Artificial Sequence
  Description of Artificial Sequence: Synthetic oligonucleotide
  Target: DMPK; (-) strand; PAM type: YTN; PAM sequence: CTT
ttcccccaccacccccccag

SEQ ID NO: 16980 - DNA, 20 bp, Artificial Sequence
  Description of Artificial Sequence: Synthetic oligonucleotide
  Target: DMPK; (-) strand; PAM type: YTN; PAM sequence: TTC
ttttcccccaccaccccccc

SEQ ID NO: 16981 - DNA, 20 bp, Artificial Sequence
  Description of Artificial Sequence: Synthetic oligonucleotide
  Target: DMPK; (-) strand; PAM type: YTN; PAM sequence: CTC
ggttcttttcccccaccacc

SEQ ID NO: 16982 - DNA, 20 bp, Artificial Sequence
  Description of Artificial Sequence: Synthetic oligonucleotide
  Target: DMPK; (-) strand; PAM type: YTN; PAM sequence: CTG
gtgaccctcggttcttttcc

SEQ ID NO: 16983 - DNA, 20 bp, Artificial Sequence
  Description of Artificial Sequence: Synthetic oligonucleotide
  Target: DMPK; (-) strand; PAM type: YTN; PAM sequence: TTC
tggtgaccctcggttctttt

SEQ ID NO: 16984 - DNA, 20 bp, Artificial Sequence
  Description of Artificial Sequence: Synthetic oligonucleotide
  Target: DMPK; (-) strand; PAM type: YTN; PAM sequence: TTT
ctggtgaccctcggttcttt

SEQ ID NO: 16985 - DNA, 20 bp, Artificial Sequence
  Description of Artificial Sequence: Synthetic oligonucleotide
  Target: DMPK; (-) strand; PAM type: YTN; PAM sequence: CTT
tctggtgaccctcggttctt

SEQ ID NO: 16986 - DNA, 20 bp, Artificial Sequence
  Description of Artificial Sequence: Synthetic oligonucleotide
  Target: DMPK; (-) strand; PAM type: YTN; PAM sequence: CTC
cagtgccctttctggtgacc

SEQ ID NO: 16987 - DNA, 20 bp, Artificial Sequence
  Description of Artificial Sequence: Synthetic oligonucleotide
  Target: DMPK; (-) strand; PAM type: YTN; PAM sequence: TTG
tctccagtgccctttctggt

SEQ ID NO: 16988 - DNA, 20 bp, Artificial Sequence
  Description of Artificial Sequence: Synthetic oligonucleotide
  Target: DMPK; (-) strand; PAM type: YTN; PAM sequence: CTT
gtctccagtgccctttctgg

SEQ ID NO: 16989 - DNA, 20 bp, Artificial Sequence
  Description of Artificial Sequence: Synthetic oligonucleotide
  Target: DMPK; (-) strand; PAM type: YTN; PAM sequence: TTC
ccccttgtctccagtgccct

SEQ ID NO: 16990 - DNA, 20 bp, Artificial Sequence
  Description of Artificial Sequence: Synthetic oligonucleotide
  Target: DMPK; (-) strand; PAM type: YTN; PAM sequence: TTT
cccccttgtctccagtgccc

SEQ ID NO: 16991 - DNA, 20 bp, Artificial Sequence
  Description of Artificial Sequence: Synthetic oligonucleotide
  Target: DMPK; (-) strand; PAM type: YTN; PAM sequence: CTT
tcccccttgtctccagtgcc

SEQ ID NO: 16992 - DNA, 20 bp, Artificial Sequence
  Description of Artificial Sequence: Synthetic oligonucleotide
  Target: DMPK; (-) strand; PAM type: YTN; PAM sequence: CTG
agaggcagagagaaggggag

SEQ ID NO: 16993 - DNA, 20 bp, Artificial Sequence
  Description of Artificial Sequence: Synthetic oligonucleotide
  Target: DMPK; (-) strand; PAM type: YTN; PAM sequence: CTA
gggtgaagctgagaggcaga

SEQ ID NO: 16994 - DNA, 20 bp, Artificial Sequence
  Description of Artificial Sequence: Synthetic oligonucleotide
  Target: DMPK; (-) strand; PAM type: YTN; PAM sequence: CTG
ggaagcagacagtcctaggg

SEQ ID NO: 16995 - DNA, 20 bp, Artificial Sequence
  Description of Artificial Sequence: Synthetic oligonucleotide
  Target: DMPK; (-) strand; PAM type: YTN; PAM sequence: TTA
tgtggggaagcccctgggaa

SEQ ID NO: 16996 - DNA, 20 bp, Artificial Sequence
  Description of Artificial Sequence: Synthetic oligonucleotide
  Target: DMPK; (-) strand; PAM type: YTN; PAM sequence: TTT
atgtggggaagcccctggga

SEQ ID NO: 16997 - DNA, 20 bp, Artificial Sequence
  Description of Artificial Sequence: Synthetic oligonucleotide
  Target: DMPK; (-) strand; PAM type: YTN; PAM sequence: TTA
cacggtgtttatgtggggaa

SEQ ID NO: 16998 - DNA, 20 bp, Artificial Sequence
  Description of Artificial Sequence: Synthetic oligonucleotide
  Target: DMPK; (-) strand; PAM type: YTN; PAM sequence: CTT
acacggtgtttatgtgggga

SEQ ID NO: 16999 - DNA, 20 bp, Artificial Sequence
  Description of Artificial Sequence: Synthetic oligonucleotide
  Target: DMPK; (-) strand; PAM type: YTN; PAM sequence: TTG
gcccccagaaccttacacgg

SEQ ID NO: 17000 - DNA, 20 bp, Artificial Sequence
  Description of Artificial Sequence: Synthetic oligonucleotide
  Target: DMPK; (-) strand; PAM type: YTN; PAM sequence: TTT
ggcccccagaaccttacacg

SEQ ID NO: 17001 - DNA, 20 bp, Artificial Sequence
  Description of Artificial Sequence: Synthetic oligonucleotide
  Target: DMPK; (-) strand; PAM type: YTN; PAM sequence: TTT
tggcccccagaaccttacac

SEQ ID NO: 17002 - DNA, 20 bp, Artificial Sequence
  Description of Artificial Sequence: Synthetic oligonucleotide
  Target: DMPK; (-) strand; PAM type: YTN; PAM sequence: TTT
ttggcccccagaaccttaca

SEQ ID NO: 17003 - DNA, 20 bp, Artificial Sequence
  Description of Artificial Sequence: Synthetic oligonucleotide
  Target: DMPK; (-) strand; PAM type: YTN; PAM sequence: CTA
tgggagggcatttttggccc

SEQ ID NO: 17004 - DNA, 20 bp, Artificial Sequence
  Description of Artificial Sequence: Synthetic oligonucleotide
  Target: DMPK; (-) strand; PAM type: YTN; PAM sequence: CTC
tatgggagggcatttttggc

SEQ ID NO: 17005 - DNA, 20 bp, Artificial Sequence
  Description of Artificial Sequence: Synthetic oligonucleotide
  Target: DMPK; (-) strand; PAM type: YTN; PAM sequence: CTC
acctctatgggagggcattt

SEQ ID NO: 17006 - DNA, 20 bp, Artificial Sequence
  Description of Artificial Sequence: Synthetic oligonucleotide
  Target: DMPK; (-) strand; PAM type: YTN; PAM sequence: CTC
aggcatctcacctctatggg

SEQ ID NO: 17007 - DNA, 20 bp, Artificial Sequence
  Description of Artificial Sequence: Synthetic oligonucleotide
  Target: DMPK; (-) strand; PAM type: YTN; PAM sequence: TTC
tcaggcatctcacctctatg

SEQ ID NO: 17008 - DNA, 20 bp, Artificial Sequence
  Description of Artificial Sequence: Synthetic oligonucleotide
  Target: DMPK; (-) strand; PAM type: YTN; PAM sequence: CTT
ctcaggcatctcacctctat

SEQ ID NO: 17009 - DNA, 20 bp, Artificial Sequence
  Description of Artificial Sequence: Synthetic oligonucleotide
  Target: DMPK; (-) strand; PAM type: YTN; PAM sequence: CTG
tcccgcaaagggcttctcag

SEQ ID NO: 17010 - DNA, 20 bp, Artificial Sequence
  Description of Artificial Sequence: Synthetic oligonucleotide
  Target: DMPK; (-) strand; PAM type: YTN; PAM sequence: CTG
ggccaatgccctgtcccgca

SEQ ID NO: 17011 - DNA, 20 bp, Artificial Sequence
  Description of Artificial Sequence: Synthetic oligonucleotide
  Target: DMPK; (-) strand; PAM type: YTN; PAM sequence: CTC
tgggccaatgccctgtcccg

SEQ ID NO: 17012 - DNA, 20 bp, Artificial Sequence
  Description of Artificial Sequence: Synthetic oligonucleotide
  Target: DMPK; (-) strand; PAM type: YTN; PAM sequence: TTG
gagccctctgggccaatgcc

SEQ ID NO: 17013 - DNA, 20 bp, Artificial Sequence
  Description of Artificial Sequence: Synthetic oligonucleotide
  Target: DMPK; (-) strand; PAM type: YTN; PAM sequence: CTT
ggagccctctgggccaatgc

SEQ ID NO: 17014 - DNA, 20 bp, Artificial Sequence
  Description of Artificial Sequence: Synthetic oligonucleotide
  Target: DMPK; (-) strand; PAM type: YTN; PAM sequence: CTG
cacacccttggagccctctg

SEQ ID NO: 17015 - DNA, 20 bp, Artificial Sequence
  Description of Artificial Sequence: Synthetic oligonucleotide
  Target: DMPK; (-) strand; PAM type: YTN; PAM sequence: CTA
accatcctgcacacccttgg

SEQ ID NO: 17016 - DNA, 20 bp, Artificial Sequence
  Description of Artificial Sequence: Synthetic oligonucleotide
  Target: DMPK; (-) strand; PAM type: YTN; PAM sequence: TTA
ccccaccctaaccatcctgc

SEQ ID NO: 17017 - DNA, 20 bp, Artificial Sequence
  Description of Artificial Sequence: Synthetic oligonucleotide
  Target: DMPK; (-) strand; PAM type: YTN; PAM sequence: CTC
cgttaccccaccctaaccat

SEQ ID NO: 17018 - DNA, 20 bp, Artificial Sequence
  Description of Artificial Sequence: Synthetic oligonucleotide
  Target: DMPK; (-) strand; PAM type: YTN; PAM sequence: CTG
cagactccgttaccccaccc

SEQ ID NO: 17019 - DNA, 20 bp, Artificial Sequence
  Description of Artificial Sequence: Synthetic oligonucleotide
  Target: DMPK; (-) strand; PAM type: YTN; PAM sequence: TTC
tgcagactccgttaccccac

SEQ ID NO: 17020 - DNA, 20 bp, Artificial Sequence
  Description of Artificial Sequence: Synthetic oligonucleotide
  Target: DMPK; (-) strand; PAM type: YTN; PAM sequence: CTT
ctgcagactccgttacccca

SEQ ID NO: 17021 - DNA, 20 bp, Artificial Sequence
  Description of Artificial Sequence: Synthetic oligonucleotide
  Target: DMPK; (-) strand; PAM type: YTN; PAM sequence: CTG
tccttctgcagactccgtta

SEQ ID NO: 17022 - DNA, 20 bp, Artificial Sequence
  Description of Artificial Sequence: Synthetic oligonucleotide
  Target: DMPK; (-) strand; PAM type: YTN; PAM sequence: TTA
gggtctgtccttctgcagac

SEQ ID NO: 17023 - DNA, 20 bp, Artificial Sequence
  Description of Artificial Sequence: Synthetic oligonucleotide
  Target: DMPK; (-) strand; PAM type: YTN; PAM sequence: TTT
agggtctgtccttctgcaga

SEQ ID NO: 17024 - DNA, 20 bp, Artificial Sequence
  Description of Artificial Sequence: Synthetic oligonucleotide
  Target: DMPK; (-) strand; PAM type: YTN; PAM sequence: CTT
tagggtctgtccttctgcag

SEQ ID NO: 17025 - DNA, 20 bp, Artificial Sequence
  Description of Artificial Sequence: Synthetic oligonucleotide
  Target: DMPK; (-) strand; PAM type: YTN; PAM sequence: TTC
tttagggtctgtccttctgc

SEQ ID NO: 17026 - DNA, 20 bp, Artificial Sequence
  Description of Artificial Sequence: Synthetic oligonucleotide
  Target: DMPK; (-) strand; PAM type: YTN; PAM sequence: TTG
ttctttagggtctgtccttc

SEQ ID NO: 17027 - DNA, 20 bp, Artificial Sequence
  Description of Artificial Sequence: Synthetic oligonucleotide
  Target: DMPK; (-) strand; PAM type: YTN; PAM sequence: CTT
gttctttagggtctgtcctt

SEQ ID NO: 17028 - DNA, 20 bp, Artificial Sequence
  Description of Artificial Sequence: Synthetic oligonucleotide
  Target: DMPK; (-) strand; PAM type: YTN; PAM sequence: CTC
cccttgttctttagggtctg

SEQ ID NO: 17029 - DNA, 20 bp, Artificial Sequence
  Description of Artificial Sequence: Synthetic oligonucleotide
  Target: DMPK; (-) strand; PAM type: YTN; PAM sequence: TTC
tccccttgttctttagggtc

SEQ ID NO: 17030 - DNA, 20 bp, Artificial Sequence
  Description of Artificial Sequence: Synthetic oligonucleotide
  Target: DMPK; (-) strand; PAM type: YTN; PAM sequence: CTT
ctccccttgttctttagggt

SEQ ID NO: 17031 - DNA, 20 bp, Artificial Sequence
  Description of Artificial Sequence: Synthetic oligonucleotide
  Target: DMPK; (-) strand; PAM type: YTN; PAM sequence: TTC
cttctccccttgttctttag

SEQ ID NO: 17032 - DNA, 20 bp, Artificial Sequence
  Description of Artificial Sequence: Synthetic oligonucleotide
  Target: DMPK; (-) strand; PAM type: YTN; PAM sequence: TTT
ccttctccccttgttcttta

SEQ ID NO: 17033 - DNA, 20 bp, Artificial Sequence
  Description of Artificial Sequence: Synthetic oligonucleotide
  Target: DMPK; (-) strand; PAM type: YTN; PAM sequence: TTA
tttccttctccccttgttct

SEQ ID NO: 17034 - DNA, 20 bp, Artificial Sequence
  Description of Artificial Sequence: Synthetic oligonucleotide
  Target: DMPK; (-) strand; PAM type: YTN; PAM sequence: CTT
atttccttctccccttgttc

SEQ ID NO: 17035 - DNA, 20 bp, Artificial Sequence
  Description of Artificial Sequence: Synthetic oligonucleotide
  Target: DMPK; (-) strand; PAM type: YTN; PAM sequence: CTG
ggtcttatttccttctcccc

SEQ ID NO: 17036 - DNA, 20 bp, Artificial Sequence
  Description of Artificial Sequence: Synthetic oligonucleotide
  Target: DMPK; (-) strand; PAM type: YTN; PAM sequence: CTG
gagtcagggtggaaggtgga

SEQ ID NO: 17037 - DNA, 20 bp, Artificial Sequence
  Description of Artificial Sequence: Synthetic oligonucleotide
  Target: DMPK; (-) strand; PAM type: YTN; PAM sequence: CTG
tcacctggagtcagggtgga

SEQ ID NO: 17038 - DNA, 20 bp, Artificial Sequence
  Description of Artificial Sequence: Synthetic oligonucleotide
  Target: DMPK; (-) strand; PAM type: YTN; PAM sequence: CTG
aactgtcacctggagtcagg

SEQ ID NO: 17039 - DNA, 20 bp, Artificial Sequence
  Description of Artificial Sequence: Synthetic oligonucleotide
  Target: DMPK; (-) strand; PAM type: YTN; PAM sequence: CTG
cacctgaactgtcacctgga

SEQ ID NO: 17040 - DNA, 20 bp, Artificial Sequence
  Description of Artificial Sequence: Synthetic oligonucleotide
  Target: DMPK; (-) strand; PAM type: YTN; PAM sequence: CTG
gctgcacctgaactgtcacc

SEQ ID NO: 17041 - DNA, 20 bp, Artificial Sequence
  Description of Artificial Sequence: Synthetic oligonucleotide
  Target: DMPK; (-) strand; PAM type: YTN; PAM sequence: CTA
catgagaacgtgggggtggg

SEQ ID NO: 17042 - DNA, 20 bp, Artificial Sequence
  Description of Artificial Sequence: Synthetic oligonucleotide
  Target: DMPK; (-) strand; PAM type: YTN; PAM sequence: TTC
tacatgagaacgtgggggtg

SEQ ID NO: 17043 - DNA, 20 bp, Artificial Sequence
  Description of Artificial Sequence: Synthetic oligonucleotide
  Target: DMPK; (-) strand; PAM type: YTN; PAM sequence: TTA
cccaggacattctacatgag

SEQ ID NO: 17044 - DNA, 20 bp, Artificial Sequence
  Description of Artificial Sequence: Synthetic oligonucleotide
  Target: DMPK; (-) strand; PAM type: YTN; PAM sequence: CTG
ggccgttacccaggacattc

SEQ ID NO: 17045 - DNA, 20 bp, Artificial Sequence
  Description of Artificial Sequence: Synthetic oligonucleotide
  Target: DMPK; (-) strand; PAM type: YTN; PAM sequence: CTG
gatacaaccccacgtctggg

SEQ ID NO: 17046 - DNA, 20 bp, Artificial Sequence
  Description of Artificial Sequence: Synthetic oligonucleotide
  Target: DMPK; (-) strand; PAM type: YTN; PAM sequence: CTA
gaggtactggatacaacccc

SEQ ID NO: 17047 - DNA, 20 bp, Artificial Sequence
  Description of Artificial Sequence: Synthetic oligonucleotide
  Target: DMPK; (-) strand; PAM type: YTN; PAM sequence: CTG
aatctagaggtactggatac

SEQ ID NO: 17048 - DNA, 20 bp, Artificial Sequence
  Description of Artificial Sequence: Synthetic oligonucleotide
  Target: DMPK; (-) strand; PAM type: YTN; PAM sequence: CTG
catctgaatctagaggtact

SEQ ID NO: 17049 - DNA, 20 bp, Artificial Sequence
  Description of Artificial Sequence: Synthetic oligonucleotide
  Target: DMPK; (-) strand; PAM type: YTN; PAM sequence: TTC
aagaaccacctgcatctgaa

SEQ ID NO: 17050 - DNA, 20 bp, Artificial Sequence
  Description of Artificial Sequence: Synthetic oligonucleotide
  Target: DMPK; (-) strand; PAM type: YTN; PAM sequence: TTC
caaagtgtggttcaagaacc

SEQ ID NO: 17051 - DNA, 20 bp, Artificial Sequence
  Description of Artificial Sequence: Synthetic oligonucleotide
  Target: DMPK; (-) strand; PAM type: YTN; PAM sequence: TTT
ccaaagtgtggttcaagaac

SEQ ID NO: 17052 - DNA, 20 bp, Artificial Sequence
  Description of Artificial Sequence: Synthetic oligonucleotide
  Target: DMPK; (-) strand; PAM type: YTN; PAM sequence: TTT
tccaaagtgtggttcaagaa

SEQ ID NO: 17053 - DNA, 20 bp, Artificial Sequence
  Description of Artificial Sequence: Synthetic oligonucleotide
  Target: DMPK; (-) strand; PAM type: YTN; PAM sequence: TTC
ccccagccccaaatccaggg

SEQ ID NO: 17054 - DNA, 20 bp, Artificial Sequence
  Description of Artificial Sequence: Synthetic oligonucleotide
  Target: DMPK; (-) strand; PAM type: YTN; PAM sequence: CTT
cccccagccccaaatccagg

SEQ ID NO: 17055 - DNA, 20 bp, Artificial Sequence
  Description of Artificial Sequence: Synthetic oligonucleotide
  Target: DMPK; (-) strand; PAM type: YTN; PAM sequence: TTC
cttcccccagccccaaatcc

SEQ ID NO: 17056 - DNA, 20 bp, Artificial Sequence
  Description of Artificial Sequence: Synthetic oligonucleotide
  Target: DMPK; (-) strand; PAM type: YTN; PAM sequence: CTG
ttccttcccccagccccaaa

SEQ ID NO: 17057 - DNA, 20 bp, Artificial Sequence
  Description of Artificial Sequence: Synthetic oligonucleotide
  Target: DMPK; (-) strand; PAM type: YTN; PAM sequence: CTG
tcctgttccttcccccagcc

SEQ ID NO: 17058 - DNA, 20 bp, Artificial Sequence
  Description of Artificial Sequence: Synthetic oligonucleotide
  Target: DMPK; (-) strand; PAM type: YTN; PAM sequence: CTC
cctgtcctgttccttccccc

SEQ ID NO: 17059 - DNA, 20 bp, Artificial Sequence
  Description of Artificial Sequence: Synthetic oligonucleotide
  Target: DMPK; (-) strand; PAM type: YTN; PAM sequence: TTG
tctccctgtcctgttccttc

SEQ ID NO: 17060 - DNA, 20 bp, Artificial Sequence
  Description of Artificial Sequence: Synthetic oligonucleotide
  Target: DMPK; (-) strand; PAM type: YTN; PAM sequence: TTT
gtctccctgtcctgttcctt

SEQ ID NO: 17061 - DNA, 20 bp, Artificial Sequence
  Description of Artificial Sequence: Synthetic oligonucleotide
  Target: DMPK; (-) strand; PAM type: YTN; PAM sequence: CTT
tgtctccctgtcctgttcct

SEQ ID NO: 17062 - DNA, 20 bp, Artificial Sequence
  Description of Artificial Sequence: Synthetic oligonucleotide
  Target: DMPK; (-) strand; PAM type: YTN; PAM sequence: CTA
cctttgtctccctgtcctgt

SEQ ID NO: 17063 - DNA, 20 bp, Artificial Sequence
  Description of Artificial Sequence: Synthetic oligonucleotide
  Target: DMPK; (-) strand; PAM type: YTN; PAM sequence: CTG
ggatatgtgaccatgctacc

SEQ ID NO: 17064 - DNA, 20 bp, Artificial Sequence
  Description of Artificial Sequence: Synthetic oligonucleotide
  Target: DMPK; (-) strand; PAM type: YTN; PAM sequence: TTG
agtctgggatatgtgaccat

SEQ ID NO: 17065 - DNA, 20 bp, Artificial Sequence
  Description of Artificial Sequence: Synthetic oligonucleotide
  Target: DMPK; (-) strand; PAM type: YTN; PAM sequence: CTT
gagtctgggatatgtgacca

SEQ ID NO: 17066 - DNA, 20 bp, Artificial Sequence
  Description of Artificial Sequence: Synthetic oligonucleotide
  Target: DMPK; (-) strand; PAM type: YTN; PAM sequence: CTG
gaccggagcacttgagtctg

SEQ ID NO: 17067 - DNA, 20 bp, Artificial Sequence
  Description of Artificial Sequence: Synthetic oligonucleotide
  Target: DMPK; (-) strand; PAM type: YTN; PAM sequence: CTG
agagatgggctggaccggag

SEQ ID NO: 17068 - DNA, 20 bp, Artificial Sequence
  Description of Artificial Sequence: Synthetic oligonucleotide
  Target: DMPK; (-) strand; PAM type: YTN; PAM sequence: CTG
gaggactgagagatgggctg

SEQ ID NO: 17069 - DNA, 20 bp, Artificial Sequence
  Description of Artificial Sequence: Synthetic oligonucleotide
  Target: DMPK; (-) strand; PAM type: YTN; PAM sequence: CTC
ctggaggactgagagatggg

SEQ ID NO: 17070 - DNA, 20 bp, Artificial Sequence
  Description of Artificial Sequence: Synthetic oligonucleotide
  Target: DMPK; (-) strand; PAM type: YTN; PAM sequence: CTC
ctcctggaggactgagagat

SEQ ID NO: 17071 - DNA, 20 bp, Artificial Sequence
  Description of Artificial Sequence: Synthetic oligonucleotide
  Target: DMPK; (-) strand; PAM type: YTN; PAM sequence: CTA
aagcactcctcctggaggac

SEQ ID NO: 17072 - DNA, 20 bp, Artificial Sequence
  Description of Artificial Sequence: Synthetic oligonucleotide
  Target: DMPK; (-) strand; PAM type: YTN; PAM sequence: CTG
taaataaggggtaggactaa

SEQ ID NO: 17073 - DNA, 20 bp, Artificial Sequence
  Description of Artificial Sequence: Synthetic oligonucleotide
  Target: DMPK; (-) strand; PAM type: YTN; PAM sequence: TTG
tcatctgtaaataaggggta

SEQ ID NO: 17074 - DNA, 20 bp, Artificial Sequence
  Description of Artificial Sequence: Synthetic oligonucleotide
  Target: DMPK; (-) strand; PAM type: YTN; PAM sequence: CTG
attgtcatctgtaaataagg

SEQ ID NO: 17075 - DNA, 20 bp, Artificial Sequence
  Description of Artificial Sequence: Synthetic oligonucleotide
  Target: DMPK; (-) strand; PAM type: YTN; PAM sequence: CTG
agaggcctgattgtcatctg

SEQ ID NO: 17076 - DNA, 20 bp, Artificial Sequence
  Description of Artificial Sequence: Synthetic oligonucleotide
  Target: DMPK; (-) strand; PAM type: YTN; PAM sequence: TTC
tgagaggcctgattgtcatc

SEQ ID NO: 17077 - DNA, 20 bp, Artificial Sequence
  Description of Artificial Sequence: Synthetic oligonucleotide
  Target: DMPK; (-) strand; PAM type: YTN; PAM sequence: CTT
ctgagaggcctgattgtcat

SEQ ID NO: 17078 - DNA, 20 bp, Artificial Sequence
  Description of Artificial Sequence: Synthetic oligonucleotide
  Target: DMPK; (-) strand; PAM type: YTN; PAM sequence: TTG
acttctgagaggcctgattg

SEQ ID NO: 17079 - DNA, 20 bp, Artificial Sequence
  Description of Artificial Sequence: Synthetic oligonucleotide
  Target: DMPK; (-) strand; PAM type: YTN; PAM sequence: CTT
gacttctgagaggcctgatt

SEQ ID NO: 17080 - DNA, 20 bp, Artificial Sequence
  Description of Artificial Sequence: Synthetic oligonucleotide
  Target: DMPK; (-) strand; PAM type: YTN; PAM sequence: CTA
gtcataggaccttgacttct

SEQ ID NO: 17081 - DNA, 20 bp, Artificial Sequence
  Description of Artificial Sequence: Synthetic oligonucleotide
  Target: DMPK; (-) strand; PAM type: YTN; PAM sequence: TTC
ctagtcataggaccttgact

SEQ ID NO: 17082 - DNA, 20 bp, Artificial Sequence
  Description of Artificial Sequence: Synthetic oligonucleotide
  Target: DMPK; (-) strand; PAM type: YTN; PAM sequence: TTA
acattcctagtcataggacc

SEQ ID NO: 17083 - DNA, 20 bp, Artificial Sequence
  Description of Artificial Sequence: Synthetic oligonucleotide
  Target: DMPK; (-) strand; PAM type: YTN; PAM sequence: TTT
aacattcctagtcataggac

SEQ ID NO: 17084 - DNA, 20 bp, Artificial Sequence
  Description of Artificial Sequence: Synthetic oligonucleotide
  Target: DMPK; (-) strand; PAM type: YTN; PAM sequence: CTG
cccagtttaacattcctagt

SEQ ID NO: 17085 - DNA, 20 bp, Artificial Sequence
  Description of Artificial Sequence: Synthetic oligonucleotide
  Target: DMPK; (-) strand; PAM type: YTN; PAM sequence: CTG
gtcccccacccaggctgccc

SEQ ID NO: 17086 - DNA, 20 bp, Artificial Sequence
  Description of Artificial Sequence: Synthetic oligonucleotide
  Target: DMPK; (-) strand; PAM type: YTN; PAM sequence: CTC
caccccagctggtcccccac

SEQ ID NO: 17087 - DNA, 20 bp, Artificial Sequence
  Description of Artificial Sequence: Synthetic oligonucleotide
  Target: DMPK; (-) strand; PAM type: YTN; PAM sequence: CTG
agccacaagcctccacccca

SEQ ID NO: 17088 - DNA, 20 bp, Artificial Sequence
  Description of Artificial Sequence: Synthetic oligonucleotide
  Target: DMPK; (-) strand; PAM type: YTN; PAM sequence: CTG
tccccacagtccctgagcca

SEQ ID NO: 17089 - DNA, 20 bp, Artificial Sequence
  Description of Artificial Sequence: Synthetic oligonucleotide
  Target: DMPK; (-) strand; PAM type: YTN; PAM sequence: CTC
cctgtccccacagtccctga

SEQ ID NO: 17090 - DNA, 20 bp, Artificial Sequence
  Description of Artificial Sequence: Synthetic oligonucleotide
  Target: DMPK; (-) strand; PAM type: YTN; PAM sequence: TTC
cacccccgggagtccaggcc

SEQ ID NO: 17091 - DNA, 20 bp, Artificial Sequence
  Description of Artificial Sequence: Synthetic oligonucleotide
  Target: DMPK; (-) strand; PAM type: YTN; PAM sequence: CTT
ccacccccgggagtccaggc

SEQ ID NO: 17092 - DNA, 20 bp, Artificial Sequence
  Description of Artificial Sequence: Synthetic oligonucleotide
  Target: DMPK; (-) strand; PAM type: YTN; PAM sequence: TTC
ttccacccccgggagtccag

SEQ ID NO: 17093 - DNA, 20 bp, Artificial Sequence
  Description of Artificial Sequence: Synthetic oligonucleotide
  Target: DMPK; (-) strand; PAM type: YTN; PAM sequence: CTT
cttccacccccgggagtcca

SEQ ID NO: 17094 - DNA, 20 bp, Artificial Sequence
  Description of Artificial Sequence: Synthetic oligonucleotide
  Target: DMPK; (-) strand; PAM type: YTN; PAM sequence: CTC
cacttcttccacccccggga

SEQ ID NO: 17095 - DNA, 20 bp, Artificial Sequence
  Description of Artificial Sequence: Synthetic oligonucleotide
  Target: DMPK; (-) strand; PAM type: YTN; PAM sequence: CTG
cctccacttcttccaccccc

SEQ ID NO: 17096 - DNA, 20 bp, Artificial Sequence
  Description of Artificial Sequence: Synthetic oligonucleotide
  Target: DMPK; (-) strand; PAM type: YTN; PAM sequence: CTC
catcctgcctccacttcttc

SEQ ID NO: 17097 - DNA, 20 bp, Artificial Sequence
  Description of Artificial Sequence: Synthetic oligonucleotide
  Target: DMPK; (-) strand; PAM type: YTN; PAM sequence: CTC
tccatcctgcctccacttct

SEQ ID NO: 17098 - DNA, 20 bp, Artificial Sequence
  Description of Artificial Sequence: Synthetic oligonucleotide
  Target: DMPK; (-) strand; PAM type: YTN; PAM sequence: CTC
tctccatcctgcctccactt

SEQ ID NO: 17099 - DNA, 20 bp, Artificial Sequence
  Description of Artificial Sequence: Synthetic oligonucleotide
  Target: DMPK; (-) strand; PAM type: YTN; PAM sequence: CTC
ccatacccatccctctctcc

SEQ ID NO: 17100 - DNA, 20 bp, Artificial Sequence
  Description of Artificial Sequence: Synthetic oligonucleotide
  Target: DMPK; (-) strand; PAM type: YTN; PAM sequence: CTC
ccctcccatacccatccctc

SEQ ID NO: 17101 - DNA, 20 bp, Artificial Sequence
  Description of Artificial Sequence: Synthetic oligonucleotide
  Target: DMPK; (-) strand; PAM type: YTN; PAM sequence: TTC
cctcccctcccatacccatc

SEQ ID NO: 17102 - DNA, 20 bp, Artificial Sequence
  Description of Artificial Sequence: Synthetic oligonucleotide
  Target: DMPK; (-) strand; PAM type: YTN; PAM sequence: CTT
ccctcccctcccatacccat

SEQ ID NO: 17103 - DNA, 20 bp, Artificial Sequence
  Description of Artificial Sequence: Synthetic oligonucleotide
  Target: DMPK; (-) strand; PAM type: YTN; PAM sequence: CTC
cttccctcccctcccatacc

SEQ ID NO: 17104 - DNA, 20 bp, Artificial Sequence
  Description of Artificial Sequence: Synthetic oligonucleotide
  Target: DMPK; (-) strand; PAM type: YTN; PAM sequence: CTC
tccttccctcccctcccata

SEQ ID NO: 17105 - DNA, 20 bp, Artificial Sequence
  Description of Artificial Sequence: Synthetic oligonucleotide
  Target: DMPK; (-) strand; PAM type: YTN; PAM sequence: CTC
ctctccttccctcccctccc

SEQ ID NO: 17106 - DNA, 20 bp, Artificial Sequence
  Description of Artificial Sequence: Synthetic oligonucleotide
  Target: DMPK; (-) strand; PAM type: YTN; PAM sequence: CTG
tctcctctccttccctcccc

SEQ ID NO: 17107 - DNA, 20 bp, Artificial Sequence
  Description of Artificial Sequence: Synthetic oligonucleotide
  Target: DMPK; (-) strand; PAM type: YTN; PAM sequence: CTC
cagaacccactgtctcctct

SEQ ID NO: 17108 - DNA, 20 bp, Artificial Sequence
  Description of Artificial Sequence: Synthetic oligonucleotide
  Target: DMPK; (-) strand; PAM type: YTN; PAM sequence: TTC
ctccagaacccactgtctcc

SEQ ID NO: 17109 - DNA, 20 bp, Artificial Sequence
  Description of Artificial Sequence: Synthetic oligonucleotide
  Target: DMPK; (-) strand; PAM type: YTN; PAM sequence: TTT
cctccagaacccactgtctc

SEQ ID NO: 17110 - DNA, 20 bp, Artificial Sequence
  Description of Artificial Sequence: Synthetic oligonucleotide
  Target: DMPK; (-) strand; PAM type: YTN; PAM sequence: CTT
tcctccagaacccactgtct

SEQ ID NO: 17111 - DNA, 20 bp, Artificial Sequence
  Description of Artificial Sequence: Synthetic oligonucleotide
  Target: DMPK; (-) strand; PAM type: YTN; PAM sequence: CTC
tttcctccagaacccactgt

SEQ ID NO: 17112 - DNA, 20 bp, Artificial Sequence
  Description of Artificial Sequence: Synthetic oligonucleotide
  Target: DMPK; (-) strand; PAM type: YTN; PAM sequence: CTC
tctttcctccagaacccact

SEQ ID NO: 17113 - DNA, 20 bp, Artificial Sequence
  Description of Artificial Sequence: Synthetic oligonucleotide
  Target: DMPK; (-) strand; PAM type: YTN; PAM sequence: CTC
ccggaaccccccggaacccc

SEQ ID NO: 17114 - DNA, 20 bp, Artificial Sequence
  Description of Artificial Sequence: Synthetic oligonucleotide
  Target: DMPK; (-) strand; PAM type: YTN; PAM sequence: CTC
tcccggaaccccccggaacc

SEQ ID NO: 17115 - DNA, 20 bp, Artificial Sequence
  Description of Artificial Sequence: Synthetic oligonucleotide
  Target: DMPK; (-) strand; PAM type: YTN; PAM sequence: CTG
gcccactctcccggaacccc

SEQ ID NO: 17116 - DNA, 20 bp, Artificial Sequence
  Description of Artificial Sequence: Synthetic oligonucleotide
  Target: DMPK; (-) strand; PAM type: YTN; PAM sequence: CTG
ctggcccactctcccggaac

SEQ ID NO: 17117 - DNA, 20 bp, Artificial Sequence
  Description of Artificial Sequence: Synthetic oligonucleotide
  Target: DMPK; (-) strand; PAM type: YTN; PAM sequence: TTC
gtccctgctggcccactctc

SEQ ID NO: 17118 - DNA, 20 bp, Artificial Sequence
  Description of Artificial Sequence: Synthetic oligonucleotide
  Target: DMPK; (-) strand; PAM type: YTN; PAM sequence: CTG
gttcgtccctgctggcccac

SEQ ID NO: 17119 - DNA, 20 bp, Artificial Sequence
  Description of Artificial Sequence: Synthetic oligonucleotide
  Target: DMPK; (-) strand; PAM type: YTN; PAM sequence: CTG
gctggttcgtccctgctggc

SEQ ID NO: 17120 - DNA, 20 bp, Artificial Sequence
  Description of Artificial Sequence: Synthetic oligonucleotide
  Target: DMPK; (-) strand; PAM type: YTN; PAM sequence: CTC
agccctggctggttcgtccc

SEQ ID NO: 17121 - DNA, 20 bp, Artificial Sequence
  Description of Artificial Sequence: Synthetic oligonucleotide
  Target: DMPK; (-) strand; PAM type: YTN; PAM sequence: CTC
ccccgtcctcagccctggct

SEQ ID NO: 17122 - DNA, 20 bp, Artificial Sequence
  Description of Artificial Sequence: Synthetic oligonucleotide
  Target: DMPK; (-) strand; PAM type: YTN; PAM sequence: CTC
cctcccccgtcctcagccct

SEQ ID NO: 17123 - DNA, 20 bp, Artificial Sequence
  Description of Artificial Sequence: Synthetic oligonucleotide
  Target: DMPK; (-) strand; PAM type: YTN; PAM sequence: CTC
ctccctcccccgtcctcagc

SEQ ID NO: 17124 - DNA, 20 bp, Artificial Sequence
  Description of Artificial Sequence: Synthetic oligonucleotide
  Target: DMPK; (-) strand; PAM type: YTN; PAM sequence: CTC
tcctccctcccccgtcctca

SEQ ID NO: 17125 - DNA, 20 bp, Artificial Sequence
  Description of Artificial Sequence: Synthetic oligonucleotide
  Target: DMPK; (-) strand; PAM type: YTN; PAM sequence: CTC
tctcctccctcccccgtcct

SEQ ID NO: 17126 - DNA, 20 bp, Artificial Sequence
  Description of Artificial Sequence: Synthetic oligonucleotide
  Target: DMPK; (-) strand; PAM type: YTN; PAM sequence: TTG
gctctctcctccctcccccg

SEQ ID NO: 17127 - DNA, 20 bp, Artificial Sequence
  Description of Artificial Sequence: Synthetic oligonucleotide
  Target: DMPK; (-) strand; PAM type: YTN; PAM sequence: CTT
ggctctctcctccctccccc

SEQ ID NO: 17128 - DNA, 20 bp, Artificial Sequence
  Description of Artificial Sequence: Synthetic oligonucleotide
  Target: DMPK; (-) strand; PAM type: YTN; PAM sequence: CTC
aatgtcttggctctctcctc

SEQ ID NO: 17129 - DNA, 20 bp, Artificial Sequence
  Description of Artificial Sequence: Synthetic oligonucleotide
  Target: DMPK; (-) strand; PAM type: YTN; PAM sequence: TTA
aaagggctcaatgtcttggc

SEQ ID NO: 17130 - DNA, 20 bp, Artificial Sequence
  Description of Artificial Sequence: Synthetic oligonucleotide
  Target: DMPK; (-) strand; PAM type: YTN; PAM sequence: CTT
aaaagggctcaatgtcttgg

SEQ ID NO: 17131 - DNA, 20 bp, Artificial Sequence
  Description of Artificial Sequence: Synthetic oligonucleotide
  Target: DMPK; (-) strand; PAM type: YTN; PAM sequence: CTG
ccttaaaagggctcaatgtc

SEQ ID NO: 17132 - DNA, 20 bp, Artificial Sequence
  Description of Artificial Sequence: Synthetic oligonucleotide
  Target: DMPK; (-) strand; PAM type: YTN; PAM sequence: CTG
ctgccttaaaagggctcaat

SEQ ID NO: 17133 - DNA, 20 bp, Artificial Sequence
  Description of Artificial Sequence: Synthetic oligonucleotide
  Target: DMPK; (-) strand; PAM type: YTN; PAM sequence: TTC
ctgctgccttaaaagggctc

SEQ ID NO: 17134 - DNA, 20 bp, Artificial Sequence
  Description of Artificial Sequence: Synthetic oligonucleotide
  Target: DMPK; (-) strand; PAM type: YTN; PAM sequence: CTG
gggcgggggagggggccagg

SEQ ID NO: 17135 - DNA, 20 bp, Artificial Sequence
  Description of Artificial Sequence: Synthetic oligonucleotide
  Target: DMPK; (-) strand; PAM type: YTN; PAM sequence: CTG
ccaggcctggggcgggggag

SEQ ID NO: 17136 - DNA, 20 bp, Artificial Sequence
  Description of Artificial Sequence: Synthetic oligonucleotide
  Target: DMPK; (-) strand; PAM type: YTN; PAM sequence: CTC
ccctgccaggcctggggcgg

SEQ ID NO: 17137 - DNA, 20 bp, Artificial Sequence
  Description of Artificial Sequence: Synthetic oligonucleotide
  Target: DMPK; (-) strand; PAM type: YTN; PAM sequence: CTC
gcggcccctcccctgccagg

SEQ ID NO: 17138 - DNA, 20 bp, Artificial Sequence
  Description of Artificial Sequence: Synthetic oligonucleotide
  Target: DMPK; (-) strand; PAM type: YTN; PAM sequence: CTG
catctcgcggcccctcccct

SEQ ID NO: 17139 - DNA, 20 bp, Artificial Sequence
  Description of Artificial Sequence: Synthetic oligonucleotide
  Target: DMPK; (-) strand; PAM type: YTN; PAM sequence: TTG
tggcccgagctgcatctcgc

SEQ ID NO: 17140 - DNA, 20 bp, Artificial Sequence
  Description of Artificial Sequence: Synthetic oligonucleotide
  Target: DMPK; (-) strand; PAM type: YTN; PAM sequence: TTT
gtggcccgagctgcatctcg

SEQ ID NO: 17141 - DNA, 20 bp, Artificial Sequence
  Description of Artificial Sequence: Synthetic oligonucleotide
  Target: DMPK; (-) strand; PAM type: YTN; PAM sequence: TTT
tgtggcccgagctgcatctc

SEQ ID NO: 17142 - DNA, 20 bp, Artificial Sequence
  Description of Artificial Sequence: Synthetic oligonucleotide
  Target: DMPK; (-) strand; PAM type: YTN; PAM sequence: CTT
ttgtggcccgagctgcatct

SEQ ID NO: 17143 - DNA, 20 bp, Artificial Sequence
  Description of Artificial Sequence: Synthetic oligonucleotide
  Target: DMPK; (-) strand; PAM type: YTN; PAM sequence: CTC
cttttgtggcccgagctgca

SEQ ID NO: 17144 - DNA, 20 bp, Artificial Sequence
  Description of Artificial Sequence: Synthetic oligonucleotide
  Target: DMPK; (-) strand; PAM type: YTN; PAM sequence: CTC
ccgggaggagcactcctttt

SEQ ID NO: 17145 - DNA, 20 bp, Artificial Sequence
  Description of Artificial Sequence: Synthetic oligonucleotide
  Target: DMPK; (-) strand; PAM type: YTN; PAM sequence: CTG
gcgctcccgggaggagcact

SEQ ID NO: 17146 - DNA, 20 bp, Artificial Sequence
  Description of Artificial Sequence: Synthetic oligonucleotide
  Target: DMPK; (-) strand; PAM type: YTN; PAM sequence: CTG
agaccgggtggggtaggggt

SEQ ID NO: 17147 - DNA, 20 bp, Artificial Sequence
  Description of Artificial Sequence: Synthetic oligonucleotide
  Target: DMPK; (-) strand; PAM type: YTN; PAM sequence: TTG
gcagggtaaactgagaccgg

SEQ ID NO: 17148 - DNA, 20 bp, Artificial Sequence
  Description of Artificial Sequence: Synthetic oligonucleotide
  Target: DMPK; (-) strand; PAM type: YTN; PAM sequence: TTG
ggttggcagggtaaactgag

SEQ ID NO: 17149 - DNA, 20 bp, Artificial Sequence
  Description of Artificial Sequence: Synthetic oligonucleotide
  Target: DMPK; (-) strand; PAM type: YTN; PAM sequence: TTA
gtagaggatgaagttgggtt

SEQ ID NO: 17150 - DNA, 20 bp, Artificial Sequence
  Description of Artificial Sequence: Synthetic oligonucleotide
  Target: DMPK; (-) strand; PAM type: YTN; PAM sequence: TTT
agtagaggatgaagttgggt

SEQ ID NO: 17151 - DNA, 20 bp, Artificial Sequence
  Description of Artificial Sequence: Synthetic oligonucleotide
  Target: DMPK; (-) strand; PAM type: YTN; PAM sequence: CTT
tagtagaggatgaagttggg

SEQ ID NO: 17152 - DNA, 20 bp, Artificial Sequence
  Description of Artificial Sequence: Synthetic oligonucleotide
  Target: DMPK; (-) strand; PAM type: YTN; PAM sequence: CTC
cctttagtagaggatgaagt

SEQ ID NO: 17153 - DNA, 20 bp, Artificial Sequence
  Description of Artificial Sequence: Synthetic oligonucleotide
  Target: DMPK; (-) strand; PAM type: YTN; PAM sequence: CTG
gcctccctttagtagaggat

SEQ ID NO: 17154 - DNA, 20 bp, Artificial Sequence
  Description of Artificial Sequence: Synthetic oligonucleotide
  Target: DMPK; (-) strand; PAM type: YTN; PAM sequence: CTC
ctggcctccctttagtagag

SEQ ID NO: 17155 - DNA, 20 bp, Artificial Sequence
  Description of Artificial Sequence: Synthetic oligonucleotide
  Target: DMPK; (-) strand; PAM type: YTN; PAM sequence: CTC
tcctggcctccctttagtag

SEQ ID NO: 17156 - DNA, 20 bp, Artificial Sequence
  Description of Artificial Sequence: Synthetic oligonucleotide
  Target: DMPK; (-) strand; PAM type: YTN; PAM sequence: CTA
atgactctcctggcctccct

SEQ ID NO: 17157 - DNA, 20 bp, Artificial Sequence
  Description of Artificial Sequence: Synthetic oligonucleotide
  Target: DMPK; (-) strand; PAM type: YTN; PAM sequence: CTC
ccacagcccctaatgactct

SEQ ID NO: 17158 - DNA, 20 bp, Artificial Sequence
  Description of Artificial Sequence: Synthetic oligonucleotide
  Target: DMPK; (-) strand; PAM type: YTN; PAM sequence: CTC
ccaacctcccacagccccta

SEQ ID NO: 17159 - DNA, 20 bp, Artificial Sequence
  Description of Artificial Sequence: Synthetic oligonucleotide
  Target: DMPK; (-) strand; PAM type: YTN; PAM sequence: TTC
tcccaacctcccacagcccc

SEQ ID NO: 17160 - DNA, 20 bp, Artificial Sequence
  Description of Artificial Sequence: Synthetic oligonucleotide
  Target: DMPK; (-) strand; PAM type: YTN; PAM sequence: CTT
ctcccaacctcccacagccc

SEQ ID NO: 17161 - DNA, 20 bp, Artificial Sequence
  Description of Artificial Sequence: Synthetic oligonucleotide
  Target: DMPK; (-) strand; PAM type: YTN; PAM sequence: CTG
gaaaaaccttctcccaacct

SEQ ID NO: 17162 - DNA, 20 bp, Artificial Sequence
  Description of Artificial Sequence: Synthetic oligonucleotide
  Target: DMPK; (-) strand; PAM type: YTN; PAM sequence: CTC
tggaaaaaccttctcccaac

SEQ ID NO: 17163 - DNA, 20 bp, Artificial Sequence
  Description of Artificial Sequence: Synthetic oligonucleotide
  Target: DMPK; (-) strand; PAM type: YTN; PAM sequence: TTC
agcctctggaaaaaccttct

SEQ ID NO: 17164 - DNA, 20 bp, Artificial Sequence
  Description of Artificial Sequence: Synthetic oligonucleotide
  Target: DMPK; (-) strand; PAM type: YTN; PAM sequence: TTC
acagatgggaaggtggaggc

SEQ ID NO: 17165 - DNA, 20 bp, Artificial Sequence
  Description of Artificial Sequence: Synthetic oligonucleotide
  Target: DMPK; (-) strand; PAM type: YTN; PAM sequence: TTT
cacagatgggaaggtggagg

SEQ ID NO: 17166 - DNA, 20 bp, Artificial Sequence
  Description of Artificial Sequence: Synthetic oligonucleotide
  Target: DMPK; (-) strand; PAM type: YTN; PAM sequence: CTC
ccatttcacagatgggaagg

SEQ ID NO: 17167 - DNA, 20 bp, Artificial Sequence
  Description of Artificial Sequence: Synthetic oligonucleotide
  Target: DMPK; (-) strand; PAM type: YTN; PAM sequence: CTC
ctcccatttcacagatggga

SEQ ID NO: 17168 - DNA, 20 bp, Artificial Sequence
  Description of Artificial Sequence: Synthetic oligonucleotide
  Target: DMPK; (-) strand; PAM type: YTN; PAM sequence: CTC
ctcctcccatttcacagatg

SEQ ID NO: 17169 - DNA, 20 bp, Artificial Sequence
  Description of Artificial Sequence: Synthetic oligonucleotide
  Target: DMPK; (-) strand; PAM type: YTN; PAM sequence: TTC
cctcctcctcccatttcaca

SEQ ID NO: 17170 - DNA, 20 bp, Artificial Sequence
  Description of Artificial Sequence: Synthetic oligonucleotide
  Target: DMPK; (-) strand; PAM type: YTN; PAM sequence: TTT
ccctcctcctcccatttcac

SEQ ID NO: 17171 - DNA, 20 bp, Artificial Sequence
  Description of Artificial Sequence: Synthetic oligonucleotide
  Target: DMPK; (-) strand; PAM type: YTN; PAM sequence: CTT
tccctcctcctcccatttca

SEQ ID NO: 17172 - DNA, 20 bp, Artificial Sequence
  Description of Artificial Sequence: Synthetic oligonucleotide
  Target: DMPK; (-) strand; PAM type: YTN; PAM sequence: TTC
ctttccctcctcctcccatt

SEQ ID NO: 17173 - DNA, 20 bp, Artificial Sequence
  Description of Artificial Sequence: Synthetic oligonucleotide
  Target: DMPK; (-) strand; PAM type: YTN; PAM sequence: CTG
gttcctttccctcctcctcc

SEQ ID NO: 17174 - DNA, 20 bp, Artificial Sequence
  Description of Artificial Sequence: Synthetic oligonucleotide
  Target: DMPK; (-) strand; PAM type: YTN; PAM sequence: CTG
acccaggcctggttcctttc

SEQ ID NO: 17175 - DNA, 20 bp, Artificial Sequence
  Description of Artificial Sequence: Synthetic oligonucleotide
  Target: DMPK; (-) strand; PAM type: YTN; PAM sequence: TTC
tgacccaggcctggttcctt

SEQ ID NO: 17176 - DNA, 20 bp, Artificial Sequence
  Description of Artificial Sequence: Synthetic oligonucleotide
  Target: DMPK; (-) strand; PAM type: YTN; PAM sequence: TTT
ctgacccaggcctggttcct

SEQ ID NO: 17177 - DNA, 20 bp, Artificial Sequence
  Description of Artificial Sequence: Synthetic oligonucleotide
  Target: DMPK; (-) strand; PAM type: YTN; PAM sequence: CTT
tctgacccaggcctggttcc

SEQ ID NO: 17178 - DNA, 20 bp, Artificial Sequence
  Description of Artificial Sequence: Synthetic oligonucleotide
  Target: DMPK; (-) strand; PAM type: YTN; PAM sequence: CTC
tttctgacccaggcctggtt

SEQ ID NO: 17179 - DNA, 20 bp, Artificial Sequence
  Description of Artificial Sequence: Synthetic oligonucleotide
  Target: DMPK; (-) strand; PAM type: YTN; PAM sequence: TTG
tgtccatctctttctgaccc

SEQ ID NO: 17180 - DNA, 20 bp, Artificial Sequence
  Description of Artificial Sequence: Synthetic oligonucleotide
  Target: DMPK; (-) strand; PAM type: YTN; PAM sequence: CTT
gtgtccatctctttctgacc

SEQ ID NO: 17181 - DNA, 20 bp, Artificial Sequence
  Description of Artificial Sequence: Synthetic oligonucleotide
  Target: DMPK; (-) strand; PAM type: YTN; PAM sequence: CTC
ttgtgtccatctctttctga

SEQ ID NO: 17182 - DNA, 20 bp, Artificial Sequence
  Description of Artificial Sequence: Synthetic oligonucleotide
  Target: DMPK; (-) strand; PAM type: YTN; PAM sequence: TTC
ctcttgtgtccatctctttc

SEQ ID NO: 17183 - DNA, 20 bp, Artificial Sequence
  Description of Artificial Sequence: Synthetic oligonucleotide
  Target: DMPK; (-) strand; PAM type: YTN; PAM sequence: CTT
cctcttgtgtccatctcttt

SEQ ID NO: 17184 - DNA, 20 bp, Artificial Sequence
  Description of Artificial Sequence: Synthetic oligonucleotide
  Target: DMPK; (-) strand; PAM type: YTN; PAM sequence: CTG
cttcctcttgtgtccatctc

SEQ ID NO: 17185 - DNA, 20 bp, Artificial Sequence
  Description of Artificial Sequence: Synthetic oligonucleotide
  Target: DMPK; (-) strand; PAM type: YTN; PAM sequence: TTC
ccctgcttcctcttgtgtcc

SEQ ID NO: 17186 - DNA, 20 bp, Artificial Sequence
  Description of Artificial Sequence: Synthetic oligonucleotide
  Target: DMPK; (-) strand; PAM type: YTN; PAM sequence: CTT
cccctgcttcctcttgtgtc

SEQ ID NO: 17187 - DNA, 20 bp, Artificial Sequence
  Description of Artificial Sequence: Synthetic oligonucleotide
  Target: DMPK; (-) strand; PAM type: YTN; PAM sequence: CTC
cgccttcccctgcttcctct

SEQ ID NO: 17188 - DNA, 20 bp, Artificial Sequence
  Description of Artificial Sequence: Synthetic oligonucleotide
  Target: DMPK; (-) strand; PAM type: YTN; PAM sequence: TTC
tccgccttcccctgcttcct

SEQ ID NO: 17189 - DNA, 20 bp, Artificial Sequence
  Description of Artificial Sequence: Synthetic oligonucleotide
  Target: DMPK; (-) strand; PAM type: YTN; PAM sequence: TTT
ctccgccttcccctgcttcc

SEQ ID NO: 17190 - DNA, 20 bp, Artificial Sequence
  Description of Artificial Sequence: Synthetic oligonucleotide
  Target: DMPK; (-) strand; PAM type: YTN; PAM sequence: CTG
tttctccgccttcccctgct

SEQ ID NO: 17191 - DNA, 20 bp, Artificial Sequence
  Description of Artificial Sequence: Synthetic oligonucleotide
  Target: DMPK; (-) strand; PAM type: YTN; PAM sequence: TTC
ctgtttctccgccttcccct

SEQ ID NO: 17192 - DNA, 20 bp, Artificial Sequence
  Description of Artificial Sequence: Synthetic oligonucleotide
  Target: DMPK; (-) strand; PAM type: YTN; PAM sequence: TTT
cctgtttctccgccttcccc

SEQ ID NO: 17193 - DNA, 20 bp, Artificial Sequence
  Description of Artificial Sequence: Synthetic oligonucleotide
  Target: DMPK; (-) strand; PAM type: YTN; PAM sequence: TTG
tttcctgtttctccgccttc

SEQ ID NO: 17194 - DNA, 20 bp, Artificial Sequence
  Description of Artificial Sequence: Synthetic oligonucleotide
  Target: DMPK; (-) strand; PAM type: YTN; PAM sequence: CTT
gtttcctgtttctccgcctt

SEQ ID NO: 17195 - DNA, 20 bp, Artificial Sequence
  Description of Artificial Sequence: Synthetic oligonucleotide
  Target: DMPK; (-) strand; PAM type: YTN; PAM sequence: CTG
tgtgtgacacttgtttcctg

SEQ ID NO: 17196 - DNA, 20 bp, Artificial Sequence
  Description of Artificial Sequence: Synthetic oligonucleotide
  Target: DMPK; (-) strand; PAM type: YTN; PAM sequence: CTG
tgtgtaacaaactgtgtgtg

SEQ ID NO: 17197 - DNA, 20 bp, Artificial Sequence
  Description of Artificial Sequence: Synthetic oligonucleotide
  Target: DMPK; (-) strand; PAM type: YTN; PAM sequence: TTG
gcctgtgtgtaacaaactgt

SEQ ID NO: 17198 - DNA, 20 bp, Artificial Sequence
  Description of Artificial Sequence: Synthetic oligonucleotide
  Target: DMPK; (-) strand; PAM type: YTN; PAM sequence: TTT
ggcctgtgtgtaacaaactg

SEQ ID NO: 17199 - DNA, 20 bp, Artificial Sequence
  Description of Artificial Sequence: Synthetic oligonucleotide
  Target: DMPK; (-) strand; PAM type: YTN; PAM sequence: TTT
tggcctgtgtgtaacaaact

SEQ ID NO: 17200 - DNA, 20 bp, Artificial Sequence
  Description of Artificial Sequence: Synthetic oligonucleotide
  Target: DMPK; (-) strand; PAM type: YTN; PAM sequence: TTT
ttggcctgtgtgtaacaaac

SEQ ID NO: 17201 - DNA, 20 bp, Artificial Sequence
  Description of Artificial Sequence: Synthetic oligonucleotide
  Target: DMPK; (-) strand; PAM type: YTN; PAM sequence: TTG
gtttttggcctgtgtgtaac

SEQ ID NO: 17202 - DNA, 20 bp, Artificial Sequence
  Description of Artificial Sequence: Synthetic oligonucleotide
  Target: DMPK; (-) strand; PAM type: YTN; PAM sequence: TTT
ggtttttggcctgtgtgtaa

SEQ ID NO: 17203 - DNA, 20 bp, Artificial Sequence
  Description of Artificial Sequence: Synthetic oligonucleotide
  Target: DMPK; (-) strand; PAM type: YTN; PAM sequence: CTG
gtgtttggtttttggcctgt

SEQ ID NO: 17204 - DNA, 20 bp, Artificial Sequence
  Description of Artificial Sequence: Synthetic oligonucleotide
  Target: DMPK; (-) strand; PAM type: YTN; PAM sequence: CTC
agtgactggtgtttggtttt

SEQ ID NO: 17205 - DNA, 20 bp, Artificial Sequence
  Description of Artificial Sequence: Synthetic oligonucleotide
  Target: DMPK; (-) strand; PAM type: YTN; PAM sequence: CTG
gccctcagtgactggtgttt

SEQ ID NO: 17206 - DNA, 20 bp, Artificial Sequence
  Description of Artificial Sequence: Synthetic oligonucleotide
  Target: DMPK; (-) strand; PAM type: YTN; PAM sequence: CTC
atatgtctggccctcagtga

SEQ ID NO: 17207 - DNA, 20 bp, Artificial Sequence
  Description of Artificial Sequence: Synthetic oligonucleotide
  Target: DMPK; (-) strand; PAM type: YTN; PAM sequence: CTG
gccctcatatgtctggccct

SEQ ID NO: 17208 - DNA, 20 bp, Artificial Sequence
  Description of Artificial Sequence: Synthetic oligonucleotide
  Target: DMPK; (-) strand; PAM type: YTN; PAM sequence: CTC
tggccctcatatgtctggcc

SEQ ID NO: 17209 - DNA, 20 bp, Artificial Sequence
  Description of Artificial Sequence: Synthetic oligonucleotide
  Target: DMPK; (-) strand; PAM type: YTN; PAM sequence: CTG
cccctctggccctcatatgt

SEQ ID NO: 17210 - DNA, 20 bp, Artificial Sequence
  Description of Artificial Sequence: Synthetic oligonucleotide
  Target: DMPK; (-) strand; PAM type: YTN; PAM sequence: TTC
ccagcaccctgcccctctgg

SEQ ID NO: 17211 - DNA, 20 bp, Artificial Sequence
  Description of Artificial Sequence: Synthetic oligonucleotide
  Target: DMPK; (-) strand; PAM type: YTN; PAM sequence: TTC
attcccagcaccctgcccct

SEQ ID NO: 17212 - DNA, 20 bp, Artificial Sequence
  Description of Artificial Sequence: Synthetic oligonucleotide
  Target: DMPK; (-) strand; PAM type: YTN; PAM sequence: TTT
cattcccagcaccctgcccc

SEQ ID NO: 17213 - DNA, 20 bp, Artificial Sequence
  Description of Artificial Sequence: Synthetic oligonucleotide
  Target: DMPK; (-) strand; PAM type: YTN; PAM sequence: CTT
tcattcccagcaccctgccc

SEQ ID NO: 17214 - DNA, 20 bp, Artificial Sequence
  Description of Artificial Sequence: Synthetic oligonucleotide
  Target: DMPK; (-) strand; PAM type: YTN; PAM sequence: TTC
tttcattcccagcaccctgc

SEQ ID NO: 17215 - DNA, 20 bp, Artificial Sequence
  Description of Artificial Sequence: Synthetic oligonucleotide
  Target: DMPK; (-) strand; PAM type: YTN; PAM sequence: TTT
ctttcattcccagcaccctg

SEQ ID NO: 17216 - DNA, 20 bp, Artificial Sequence
  Description of Artificial Sequence: Synthetic oligonucleotide
  Target: DMPK; (-) strand; PAM type: YTN; PAM sequence: CTG
gtttctttcattcccagcac

SEQ ID NO: 17217 - DNA, 20 bp, Artificial Sequence
  Description of Artificial Sequence: Synthetic oligonucleotide
  Target: DMPK; (-) strand; PAM type: YTN; PAM sequence: CTG
gtcactggtttctttcattc

SEQ ID NO: 17218 - DNA, 20 bp, Artificial Sequence
  Description of Artificial Sequence: Synthetic oligonucleotide
  Target: DMPK; (-) strand; PAM type: YTN; PAM sequence: CTC
actggtcactggtttctttc

SEQ ID NO: 17219 - DNA, 20 bp, Artificial Sequence
  Description of Artificial Sequence: Synthetic oligonucleotide
  Target: DMPK; (-) strand; PAM type: YTN; PAM sequence: CTC
gggctcactggtcactggtt

SEQ ID NO: 17220 - DNA, 20 bp, Artificial Sequence
  Description of Artificial Sequence: Synthetic oligonucleotide
  Target: DMPK; (-) strand; PAM type: YTN; PAM sequence: CTC
cccaagcccaggactcgggc

SEQ ID NO: 17221 - DNA, 20 bp, Artificial Sequence
  Description of Artificial Sequence: Synthetic oligonucleotide
  Target: DMPK; (-) strand; PAM type: YTN; PAM sequence: CTC
ctccccaagcccaggactcg

SEQ ID NO: 17222 - DNA, 20 bp, Artificial Sequence
  Description of Artificial Sequence: Synthetic oligonucleotide
  Target: DMPK; (-) strand; PAM type: YTN; PAM sequence: CTG
cccacctcctccccaagccc

SEQ ID NO: 17223 - DNA, 20 bp, Artificial Sequence
  Description of Artificial Sequence: Synthetic oligonucleotide
  Target: DMPK; (-) strand; PAM type: YTN; PAM sequence: TTG
tctgcccacctcctccccaa

SEQ ID NO: 17224 - DNA, 20 bp, Artificial Sequence
  Description of Artificial Sequence: Synthetic oligonucleotide
  Target: DMPK; (-) strand; PAM type: YTN; PAM sequence: CTT
gtctgcccacctcctcccca

SEQ ID NO: 17225 - DNA, 20 bp, Artificial Sequence
  Description of Artificial Sequence: Synthetic oligonucleotide
  Target: DMPK; (-) strand; PAM type: YTN; PAM sequence: CTG
ccttgtctgcccacctcctc

SEQ ID NO: 17226 - DNA, 20 bp, Artificial Sequence
  Description of Artificial Sequence: Synthetic oligonucleotide
  Target: DMPK; (-) strand; PAM type: YTN; PAM sequence: CTG
ccagctgccttgtctgccca

SEQ ID NO: 17227 - DNA, 20 bp, Artificial Sequence
  Description of Artificial Sequence: Synthetic oligonucleotide
  Target: DMPK; (-) strand; PAM type: YTN; PAM sequence: TTC
tgccagctgccttgtctgcc

SEQ ID NO: 17228 - DNA, 20 bp, Artificial Sequence
  Description of Artificial Sequence: Synthetic oligonucleotide
  Target: DMPK; (-) strand; PAM type: YTN; PAM sequence: CTT
ctgccagctgccttgtctgc

SEQ ID NO: 17229 - DNA, 20 bp, Artificial Sequence
  Description of Artificial Sequence: Synthetic oligonucleotide
  Target: DMPK; (-) strand; PAM type: YTN; PAM sequence: TTC
cgcttctgccagctgccttg

SEQ ID NO: 17230 - DNA, 20 bp, Artificial Sequence
  Description of Artificial Sequence: Synthetic oligonucleotide
  Target: DMPK; (-) strand; PAM type: YTN; PAM sequence: CTT
ccgcttctgccagctgcctt

SEQ ID NO: 17231 - DNA, 20 bp, Artificial Sequence
  Description of Artificial Sequence: Synthetic oligonucleotide
  Target: DMPK; (-) strand; PAM type: YTN; PAM sequence: CTG
gaaggaggatgcttccgctt

SEQ ID NO: 17232 - DNA, 20 bp, Artificial Sequence
  Description of Artificial Sequence: Synthetic oligonucleotide
  Target: DMPK; (-) strand; PAM type: YTN; PAM sequence: CTG
gggccagggctggaaggagg

SEQ ID NO: 17233 - DNA, 20 bp, Artificial Sequence
  Description of Artificial Sequence: Synthetic oligonucleotide
  Target: DMPK; (-) strand; PAM type: YTN; PAM sequence: TTC
cagggcctggggccagggct

SEQ ID NO: 17234 - DNA, 20 bp, Artificial Sequence
  Description of Artificial Sequence: Synthetic oligonucleotide
  Target: DMPK; (-) strand; PAM type: YTN; PAM sequence: TTT
ccagggcctggggccagggc

SEQ ID NO: 17235 - DNA, 20 bp, Artificial Sequence
  Description of Artificial Sequence: Synthetic oligonucleotide
  Target: DMPK; (-) strand; PAM type: YTN; PAM sequence: CTT
tccagggcctggggccaggg

SEQ ID NO: 17236 - DNA, 20 bp, Artificial Sequence
  Description of Artificial Sequence: Synthetic oligonucleotide
  Target: DMPK; (-) strand; PAM type: YTN; PAM sequence: TTG
caagggctttccagggcctg

SEQ ID NO: 17237 - DNA, 20 bp, Artificial Sequence
  Description of Artificial Sequence: Synthetic oligonucleotide
  Target: DMPK; (-) strand; PAM type: YTN; PAM sequence: CTT
gcaagggctttccagggcct

SEQ ID NO: 17238 - DNA, 20 bp, Artificial Sequence
  Description of Artificial Sequence: Synthetic oligonucleotide
  Target: DMPK; (-) strand; PAM type: YTN; PAM sequence: TTC
ttgcaagggctttccagggc

SEQ ID NO: 17239 - DNA, 20 bp, Artificial Sequence
  Description of Artificial Sequence: Synthetic oligonucleotide
  Target: DMPK; (-) strand; PAM type: YTN; PAM sequence: CTT
cttgcaagggctttccaggg

SEQ ID NO: 17240 - DNA, 20 bp, Artificial Sequence
  Description of Artificial Sequence: Synthetic oligonucleotide
  Target: DMPK; (-) strand; PAM type: YTN; PAM sequence: CTG
tcccacaaaaccccttcttg

SEQ ID NO: 17241 - DNA, 20 bp, Artificial Sequence
  Description of Artificial Sequence: Synthetic oligonucleotide
  Target: DMPK; (-) strand; PAM type: YTN; PAM sequence: TTC
cagctgtcccacaaaacccc

SEQ ID NO: 17242 - DNA, 20 bp, Artificial Sequence
  Description of Artificial Sequence: Synthetic oligonucleotide
  Target: DMPK; (-) strand; PAM type: YTN; PAM sequence: CTT
ccagctgtcccacaaaaccc

SEQ ID NO: 17243 - DNA, 20 bp, Artificial Sequence
  Description of Artificial Sequence: Synthetic oligonucleotide
  Target: DMPK; (-) strand; PAM type: YTN; PAM sequence: CTC
caaccttccagctgtcccac

SEQ ID NO: 17244 - DNA, 20 bp, Artificial Sequence
  Description of Artificial Sequence: Synthetic oligonucleotide
  Target: DMPK; (-) strand; PAM type: YTN; PAM sequence: CTG
gcccagggcctccaaccttc

SEQ ID NO: 17245 - DNA, 20 bp, Artificial Sequence
  Description of Artificial Sequence: Synthetic oligonucleotide
  Target: DMPK; (-) strand; PAM type: YTN; PAM sequence: CTC
ctggcccagggcctccaacc

SEQ ID NO: 17246 - DNA, 20 bp, Artificial Sequence
  Description of Artificial Sequence: Synthetic oligonucleotide
  Target: DMPK; (-) strand; PAM type: YTN; PAM sequence: TTC
tcctggcccagggcctccaa

SEQ ID NO: 17247 - DNA, 20 bp, Artificial Sequence
  Description of Artificial Sequence: Synthetic oligonucleotide
  Target: DMPK; (-) strand; PAM type: YTN; PAM sequence: TTA
gttctcctggcccagggcct

SEQ ID NO: 17248 - DNA, 20 bp, Artificial Sequence
  Description of Artificial Sequence: Synthetic oligonucleotide
  Target: DMPK; (-) strand; PAM type: YTN; PAM sequence: TTT
agttctcctggcccagggcc

SEQ ID NO: 17249 - DNA, 20 bp, Artificial Sequence
  Description of Artificial Sequence: Synthetic oligonucleotide
  Target: DMPK; (-) strand; PAM type: YTN; PAM sequence: CTT
tagttctcctggcccagggc

SEQ ID NO: 17250 - DNA, 20 bp, Artificial Sequence
  Description of Artificial Sequence: Synthetic oligonucleotide
  Target: DMPK; (-) strand; PAM type: YTN; PAM sequence: CTG
cgtcctttagttctcctggc

SEQ ID NO: 17251 - DNA, 20 bp, Artificial Sequence
  Description of Artificial Sequence: Synthetic oligonucleotide
  Target: DMPK; (-) strand; PAM type: YTN; PAM sequence: TTC
ccgccaccccgggtccctgc

SEQ ID NO: 17252 - DNA, 20 bp, Artificial Sequence
  Description of Artificial Sequence: Synthetic oligonucleotide
  Target: DMPK; (-) strand; PAM type: YTN; PAM sequence: CTA
tgagccgtgtgggtcagcca

SEQ ID NO: 17253 - DNA, 20 bp, Artificial Sequence
  Description of Artificial Sequence: Synthetic oligonucleotide
  Target: DMPK; (-) strand; PAM type: YTN; PAM sequence: TTC
ctatgagccgtgtgggtcag

SEQ ID NO: 17254 - DNA, 20 bp, Artificial Sequence
  Description of Artificial Sequence: Synthetic oligonucleotide
  Target: DMPK; (-) strand; PAM type: YTN; PAM sequence: CTC
ggttcctatgagccgtgtgg

SEQ ID NO: 17255 - DNA, 20 bp, Artificial Sequence
  Description of Artificial Sequence: Synthetic oligonucleotide
  Target: DMPK; (-) strand; PAM type: YTN; PAM sequence: CTG
cacccacccccacccccagc

SEQ ID NO: 17256 - DNA, 20 bp, Artificial Sequence
  Description of Artificial Sequence: Synthetic oligonucleotide
  Target: DMPK; (-) strand; PAM type: YTN; PAM sequence: TTC
tgcacccacccccaccccca

SEQ ID NO: 17257 - DNA, 20 bp, Artificial Sequence
  Description of Artificial Sequence: Synthetic oligonucleotide
  Target: DMPK; (-) strand; PAM type: YTN; PAM sequence: TTG
taggttctgcacccaccccc

SEQ ID NO: 17258 - DNA, 20 bp, Artificial Sequence
  Description of Artificial Sequence: Synthetic oligonucleotide
  Target: DMPK; (-) strand; PAM type: YTN; PAM sequence: TTT
gtaggttctgcacccacccc

SEQ ID NO: 17259 - DNA, 20 bp, Artificial Sequence
  Description of Artificial Sequence: Synthetic oligonucleotide
  Target: DMPK; (-) strand; PAM type: YTN; PAM sequence: TTT
tgtaggttctgcacccaccc

SEQ ID NO: 17260 - DNA, 20 bp, Artificial Sequence
  Description of Artificial Sequence: Synthetic oligonucleotide
  Target: DMPK; (-) strand; PAM type: YTN; PAM sequence: CTT
ttgtaggttctgcacccacc

SEQ ID NO: 17261 - DNA, 20 bp, Artificial Sequence
  Description of Artificial Sequence: Synthetic oligonucleotide
  Target: DMPK; (-) strand; PAM type: YTN; PAM sequence: TTC
ttttgtaggttctgcaccca

SEQ ID NO: 17262 - DNA, 20 bp, Artificial Sequence
  Description of Artificial Sequence: Synthetic oligonucleotide
  Target: DMPK; (-) strand; PAM type: YTN; PAM sequence: CTT
cttttgtaggttctgcaccc

SEQ ID NO: 17263 - DNA, 20 bp, Artificial Sequence
  Description of Artificial Sequence: Synthetic oligonucleotide
  Target: DMPK; (-) strand; PAM type: YTN; PAM sequence: CTC
cttcttttgtaggttctgca

SEQ ID NO: 17264 - DNA, 20 bp, Artificial Sequence
  Description of Artificial Sequence: Synthetic oligonucleotide
  Target: DMPK; (-) strand; PAM type: YTN; PAM sequence: CTG
ggtgtgtctccttcttttgt

SEQ ID NO: 17265 - DNA, 20 bp, Artificial Sequence
  Description of Artificial Sequence: Synthetic oligonucleotide
  Target: DMPK; (-) strand; PAM type: YTN; PAM sequence: TTC
tgggtgtgtctccttctttt

SEQ ID NO: 17266 - DNA, 20 bp, Artificial Sequence
  Description of Artificial Sequence: Synthetic oligonucleotide
  Target: DMPK; (-) strand; PAM type: YTN; PAM sequence: CTT
ctgggtgtgtctccttcttt

SEQ ID NO: 17267 - DNA, 20 bp, Artificial Sequence
  Description of Artificial Sequence: Synthetic oligonucleotide
  Target: DMPK; (-) strand; PAM type: YTN; PAM sequence: TTC
ttctgggtgtgtctccttct

SEQ ID NO: 17268 - DNA, 20 bp, Artificial Sequence
  Description of Artificial Sequence: Synthetic oligonucleotide
  Target: DMPK; (-) strand; PAM type: YTN; PAM sequence: TTG
ggttcttctgggtgtgtctc

SEQ ID NO: 17269 - DNA, 20 bp, Artificial Sequence
  Description of Artificial Sequence: Synthetic oligonucleotide
  Target: DMPK; (-) strand; PAM type: YTN; PAM sequence: TTT
gggttcttctgggtgtgtct

SEQ ID NO: 17270 - DNA, 20 bp, Artificial Sequence
  Description of Artificial Sequence: Synthetic oligonucleotide
  Target: DMPK; (-) strand; PAM type: YTN; PAM sequence: CTT
tgggttcttctgggtgtgtc

SEQ ID NO: 17271 - DNA, 20 bp, Artificial Sequence
  Description of Artificial Sequence: Synthetic oligonucleotide
  Target: DMPK; (-) strand; PAM type: YTN; PAM sequence: CTG
cgatccaggagggacaactt

SEQ ID NO: 17272 - DNA, 20 bp, Artificial Sequence
  Description of Artificial Sequence: Synthetic oligonucleotide
  Target: DMPK; (-) strand; PAM type: YTN; PAM sequence: CTC
tgcgatccaggagggacaac

SEQ ID NO: 17273 - DNA, 20 bp, Artificial Sequence
  Description of Artificial Sequence: Synthetic oligonucleotide
  Target: DMPK; (-) strand; PAM type: YTN; PAM sequence: CTC
ctctgcgatccaggagggac

SEQ ID NO: 17274 - DNA, 20 bp, Artificial Sequence
  Description of Artificial Sequence: Synthetic oligonucleotide
  Target: DMPK; (-) strand; PAM type: YTN; PAM sequence: TTG
cagacaggcgccaccagtgc

SEQ ID NO: 17275 - DNA, 20 bp, Artificial Sequence
  Description of Artificial Sequence: Synthetic oligonucleotide
  Target: DMPK; (-) strand; PAM type: YTN; PAM sequence: TTT
gcagacaggcgccaccagtg

SEQ ID NO: 17276 - DNA, 20 bp, Artificial Sequence
  Description of Artificial Sequence: Synthetic oligonucleotide
  Target: DMPK; (-) strand; PAM type: YTN; PAM sequence: CTT
tgcagacaggcgccaccagt

SEQ ID NO: 17277 - DNA, 20 bp, Artificial Sequence
  Description of Artificial Sequence: Synthetic oligonucleotide
  Target: DMPK; (-) strand; PAM type: YTN; PAM sequence: CTG
tgggagaaccagctttgcag

SEQ ID NO: 17278 - DNA, 20 bp, Artificial Sequence
  Description of Artificial Sequence: Synthetic oligonucleotide
  Target: DMPK; (-) strand; PAM type: YTN; PAM sequence: CTC
acgcgggccctgtgggagaa

SEQ ID NO: 17279 - DNA, 20 bp, Artificial Sequence
  Description of Artificial Sequence: Synthetic oligonucleotide
  Target: DMPK; (-) strand; PAM type: YTN; PAM sequence: CTG
ggagggcggtgactcacgcg

SEQ ID NO: 17280 - DNA, 20 bp, Artificial Sequence
  Description of Artificial Sequence: Synthetic oligonucleotide
  Target: DMPK; (-) strand; PAM type: YTN; PAM sequence: CTG
ccccaacaggtgcccaggca

SEQ ID NO: 17281 - DNA, 20 bp, Artificial Sequence
  Description of Artificial Sequence: Synthetic oligonucleotide
  Target: DMPK; (-) strand; PAM type: YTN; PAM sequence: CTC
cagctgccccaacaggtgcc

SEQ ID NO: 17282 - DNA, 20 bp, Artificial Sequence
  Description of Artificial Sequence: Synthetic oligonucleotide
  Target: DMPK; (-) strand; PAM type: YTN; PAM sequence: CTC
tccagctgccccaacaggtg

SEQ ID NO: 17283 - DNA, 20 bp, Artificial Sequence
  Description of Artificial Sequence: Synthetic oligonucleotide
  Target: DMPK; (-) strand; PAM type: YTN; PAM sequence: TTC
ggcgccagcctctccagctg

SEQ ID NO: 17284 - DNA, 20 bp, Artificial Sequence
  Description of Artificial Sequence: Synthetic oligonucleotide
  Target: DMPK; (-) strand; PAM type: YTN; PAM sequence: CTG
ccaggggcgcagccgacagg

SEQ ID NO: 17285 - DNA, 20 bp, Artificial Sequence
  Description of Artificial Sequence: Synthetic oligonucleotide
  Target: DMPK; (-) strand; PAM type: YTN; PAM sequence: CTG
gggcaagccaggagggccag

SEQ ID NO: 17286 - DNA, 20 bp, Artificial Sequence
  Description of Artificial Sequence: Synthetic oligonucleotide
  Target: DMPK; (-) strand; PAM type: YTN; PAM sequence: CTG
tggcctggggcaagccagga

SEQ ID NO: 17287 - DNA, 20 bp, Artificial Sequence
  Description of Artificial Sequence: Synthetic oligonucleotide
  Target: DMPK; (-) strand; PAM type: YTN; PAM sequence: TTC
ctgtggcctggggcaagcca

SEQ ID NO: 17288 - DNA, 20 bp, Artificial Sequence
  Description of Artificial Sequence: Synthetic oligonucleotide
  Target: DMPK; (-) strand; PAM type: YTN; PAM sequence: TTT
cctgtggcctggggcaagcc

SEQ ID NO: 17289 - DNA, 20 bp, Artificial Sequence
  Description of Artificial Sequence: Synthetic oligonucleotide
  Target: DMPK; (-) strand; PAM type: YTN; PAM sequence: CTG
gtttcctgtggcctggggca

SEQ ID NO: 17290 - DNA, 20 bp, Artificial Sequence
  Description of Artificial Sequence: Synthetic oligonucleotide
  Target: DMPK; (-) strand; PAM type: YTN; PAM sequence: CTC
ccctggtttcctgtggcctg

SEQ ID NO: 17291 - DNA, 20 bp, Artificial Sequence
  Description of Artificial Sequence: Synthetic oligonucleotide
  Target: DMPK; (-) strand; PAM type: YTN; PAM sequence: CTC
tcccctggtttcctgtggcc

SEQ ID NO: 17292 - DNA, 20 bp, Artificial Sequence
  Description of Artificial Sequence: Synthetic oligonucleotide
  Target: DMPK; (-) strand; PAM type: YTN; PAM sequence: CTA
tggccctctcccctggtttc

SEQ ID NO: 17293 - DNA, 20 bp, Artificial Sequence
  Description of Artificial Sequence: Synthetic oligonucleotide
  Target: DMPK; (-) strand; PAM type: YTN; PAM sequence: CTC
tatggccctctcccctggtt

SEQ ID NO: 17294 - DNA, 20 bp, Artificial Sequence
  Description of Artificial Sequence: Synthetic oligonucleotide
  Target: DMPK; (-) strand; PAM type: YTN; PAM sequence: CTC
cccccaaaagtgggctctat

SEQ ID NO: 17295 - DNA, 20 bp, Artificial Sequence
  Description of Artificial Sequence: Synthetic oligonucleotide
  Target: DMPK; (-) strand; PAM type: YTN; PAM sequence: CTA
ggaccctccccccaaaagtg

SEQ ID NO: 17296 - DNA, 20 bp, Artificial Sequence
  Description of Artificial Sequence: Synthetic oligonucleotide
  Target: DMPK; (-) strand; PAM type: YTN; PAM sequence: CTC
ctaggaccctccccccaaaa

SEQ ID NO: 17297 - DNA, 20 bp, Artificial Sequence
  Description of Artificial Sequence: Synthetic oligonucleotide
  Target: DMPK; (-) strand; PAM type: YTN; PAM sequence: CTC
tcctaggaccctccccccaa

SEQ ID NO: 17298 - DNA, 20 bp, Artificial Sequence
  Description of Artificial Sequence: Synthetic oligonucleotide
  Target: DMPK; (-) strand; PAM type: YTN; PAM sequence: CTC
cctctcctaggaccctcccc

SEQ ID NO: 17299 - DNA, 20 bp, Artificial Sequence
  Description of Artificial Sequence: Synthetic oligonucleotide
  Target: DMPK; (-) strand; PAM type: YTN; PAM sequence: CTG
ggagctccctctcctaggac

SEQ ID NO: 17300 - DNA, 20 bp, Artificial Sequence
  Description of Artificial Sequence: Synthetic oligonucleotide
  Target: DMPK; (-) strand; PAM type: YTN; PAM sequence: CTC
agggtcagggtcagggtcat

SEQ ID NO: 17301 - DNA, 20 bp, Artificial Sequence
  Description of Artificial Sequence: Synthetic oligonucleotide
  Target: DMPK; (-) strand; PAM type: YTN; PAM sequence: CTG
caccccgcctcagggtcagg

SEQ ID NO: 17302 - DNA, 20 bp, Artificial Sequence
  Description of Artificial Sequence: Synthetic oligonucleotide
  Target: DMPK; (-) strand; PAM type: YTN; PAM sequence: CTC
tgcaccccgcctcagggtca

SEQ ID NO: 17303 - DNA, 20 bp, Artificial Sequence
  Description of Artificial Sequence: Synthetic oligonucleotide
  Target: DMPK; (-) strand; PAM type: YTN; PAM sequence: CTC
tctgcaccccgcctcagggt

SEQ ID NO: 17304 - DNA, 20 bp, Artificial Sequence
  Description of Artificial Sequence: Synthetic oligonucleotide
  Target: DMPK; (-) strand; PAM type: YTN; PAM sequence: CTC
ccatggcctctctgcacccc

SEQ ID NO: 17305 - DNA, 20 bp, Artificial Sequence
  Description of Artificial Sequence: Synthetic oligonucleotide
  Target: DMPK; (-) strand; PAM type: YTN; PAM sequence: CTG
ccaacagcctcccatggcct

SEQ ID NO: 17306 - DNA, 20 bp, Artificial Sequence
  Description of Artificial Sequence: Synthetic oligonucleotide
  Target: DMPK; (-) strand; PAM type: YTN; PAM sequence: CTA
ggctgccaacagcctcccat

SEQ ID NO: 17307 - DNA, 20 bp, Artificial Sequence
  Description of Artificial Sequence: Synthetic oligonucleotide
  Target: DMPK; (-) strand; PAM type: YTN; PAM sequence: TTA
ggagtcacagcaggctaggc

SEQ ID NO: 17308 - DNA, 20 bp, Artificial Sequence
  Description of Artificial Sequence: Synthetic oligonucleotide
  Target: DMPK; (-) strand; PAM type: YTN; PAM sequence: CTT
aggagtcacagcaggctagg

SEQ ID NO: 17309 - DNA, 20 bp, Artificial Sequence
  Description of Artificial Sequence: Synthetic oligonucleotide
  Target: DMPK; (-) strand; PAM type: YTN; PAM sequence: CTC
agagccatggcttaggagtc

SEQ ID NO: 17310 - DNA, 20 bp, Artificial Sequence
  Description of Artificial Sequence: Synthetic oligonucleotide
  Target: DMPK; (-) strand; PAM type: YTN; PAM sequence: CTG
tgactcagagccatggctta

SEQ ID NO: 17311 - DNA, 20 bp, Artificial Sequence
  Description of Artificial Sequence: Synthetic oligonucleotide
  Target: DMPK; (-) strand; PAM type: YTN; PAM sequence: CTA
gggtggctgtgactcagagc

SEQ ID NO: 17312 - DNA, 20 bp, Artificial Sequence
  Description of Artificial Sequence: Synthetic oligonucleotide
  Target: DMPK; (-) strand; PAM type: YTN; PAM sequence: CTG
gaggggcagagtaaggtcag

SEQ ID NO: 17313 - DNA, 20 bp, Artificial Sequence
  Description of Artificial Sequence: Synthetic oligonucleotide
  Target: DMPK; (-) strand; PAM type: YTN; PAM sequence: CTC
tggaggggcagagtaaggtc

SEQ ID NO: 17314 - DNA, 20 bp, Artificial Sequence
  Description of Artificial Sequence: Synthetic oligonucleotide
  Target: DMPK; (-) strand; PAM type: YTN; PAM sequence: CTA
tgccaccactctggaggggc

SEQ ID NO: 17315 - DNA, 20 bp, Artificial Sequence
  Description of Artificial Sequence: Synthetic oligonucleotide
  Target: DMPK; (-) strand; PAM type: YTN; PAM sequence: CTG
tcctatgccaccactctgga

SEQ ID NO: 17316 - DNA, 20 bp, Artificial Sequence
  Description of Artificial Sequence: Synthetic oligonucleotide
  Target: DMPK; (-) strand; PAM type: YTN; PAM sequence: CTC
tgtcctatgccaccactctg

SEQ ID NO: 17317 - DNA, 20 bp, Artificial Sequence
  Description of Artificial Sequence: Synthetic oligonucleotide
  Target: DMPK; (-) strand; PAM type: YTN; PAM sequence: TTC
tctgtcctatgccaccactc

SEQ ID NO: 17318 - DNA, 20 bp, Artificial Sequence
  Description of Artificial Sequence: Synthetic oligonucleotide
  Target: DMPK; (-) strand; PAM type: YTN; PAM sequence: TTT
ctctgtcctatgccaccact

SEQ ID NO: 17319 - DNA, 20 bp, Artificial Sequence
  Description of Artificial Sequence: Synthetic oligonucleotide
  Target: DMPK; (-) strand; PAM type: YTN; PAM sequence: CTG
gggcaacatttctctgtcct

SEQ ID NO: 17320 - DNA, 20 bp, Artificial Sequence
  Description of Artificial Sequence: Synthetic oligonucleotide
  Target: DMPK; (-) strand; PAM type: YTN; PAM sequence: CTG
ggccctggggcaacatttct

SEQ ID NO: 17321 - DNA, 20 bp, Artificial Sequence
  Description of Artificial Sequence: Synthetic oligonucleotide
  Target: DMPK; (-) strand; PAM type: YTN; PAM sequence: CTC
agagtgtggacctgggccct

SEQ ID NO: 17322 - DNA, 20 bp, Artificial Sequence
  Description of Artificial Sequence: Synthetic oligonucleotide
  Target: DMPK; (-) strand; PAM type: YTN; PAM sequence: CTG
gggctcagagtgtggacctg

SEQ ID NO: 17323 - DNA, 20 bp, Artificial Sequence
  Description of Artificial Sequence: Synthetic oligonucleotide
  Target: DMPK; (-) strand; PAM type: YTN; PAM sequence: CTC
ccatcctggggctcagagtg

SEQ ID NO: 17324 - DNA, 20 bp, Artificial Sequence
  Description of Artificial Sequence: Synthetic oligonucleotide
  Target: DMPK; (-) strand; PAM type: YTN; PAM sequence: TTG
ggggggcaggatggcaggat

SEQ ID NO: 17325 - DNA, 20 bp, Artificial Sequence
  Description of Artificial Sequence: Synthetic oligonucleotide
  Target: DMPK; (-) strand; PAM type: YTN; PAM sequence: CTG
ttgggggggcaggatggcag

SEQ ID NO: 17326 - DNA, 20 bp, Artificial Sequence
  Description of Artificial Sequence: Synthetic oligonucleotide
  Target: DMPK; (-) strand; PAM type: YTN; PAM sequence: CTG
gctgttgggggggcaggatg

SEQ ID NO: 17327 - DNA, 20 bp, Artificial Sequence
  Description of Artificial Sequence: Synthetic oligonucleotide
  Target: DMPK; (-) strand; PAM type: YTN; PAM sequence: CTG
ggcacagaggcctggctgtt

SEQ ID NO: 17328 - DNA, 20 bp, Artificial Sequence
  Description of Artificial Sequence: Synthetic oligonucleotide
  Target: DMPK; (-) strand; PAM type: YTN; PAM sequence: CTG
cagatggggtgggggtgggg

SEQ ID NO: 17329 - DNA, 20 bp, Artificial Sequence
  Description of Artificial Sequence: Synthetic oligonucleotide
  Target: DMPK; (-) strand; PAM type: YTN; PAM sequence: CTC
ctgcagatggggtgggggtg

SEQ ID NO: 17330 - DNA, 20 bp, Artificial Sequence
  Description of Artificial Sequence: Synthetic oligonucleotide
  Target: DMPK; (-) strand; PAM type: YTN; PAM sequence: CTC
ggggctcctgcagatggggt

SEQ ID NO: 17331 - DNA, 20 bp, Artificial Sequence
  Description of Artificial Sequence: Synthetic oligonucleotide
  Target: DMPK; (-) strand; PAM type: YTN; PAM sequence: CTA
ccctcggggctcctgcagat

SEQ ID NO: 17332 - DNA, 20 bp, Artificial Sequence
  Description of Artificial Sequence: Synthetic oligonucleotide
  Target: DMPK; (-) strand; PAM type: YTN; PAM sequence: TTG
cagtggggtgagtgcctacc

SEQ ID NO: 17333 - DNA, 20 bp, Artificial Sequence
  Description of Artificial Sequence: Synthetic oligonucleotide
  Target: DMPK; (-) strand; PAM type: YTN; PAM sequence: CTT
gcagtggggtgagtgcctac

SEQ ID NO: 17334 - DNA, 20 bp, Artificial Sequence
  Description of Artificial Sequence: Synthetic oligonucleotide
  Target: DMPK; (-) strand; PAM type: YTN; PAM sequence: TTC
ttgcagtggggtgagtgcct

SEQ ID NO: 17335 - DNA, 20 bp, Artificial Sequence
  Description of Artificial Sequence: Synthetic oligonucleotide
  Target: DMPK; (-) strand; PAM type: YTN; PAM sequence: CTT
cttgcagtggggtgagtgcc

SEQ ID NO: 17336 - DNA, 20 bp, Artificial Sequence
  Description of Artificial Sequence: Synthetic oligonucleotide
  Target: DMPK; (-) strand; PAM type: YTN; PAM sequence: CTG
gcccaggacaagtacgtggc

SEQ ID NO: 17337 - DNA, 20 bp, Artificial Sequence
  Description of Artificial Sequence: Synthetic oligonucleotide
  Target: DMPK; (-) strand; PAM type: YTN; PAM sequence: CTC
cgaactggcccaggacaagt

SEQ ID NO: 17338 - DNA, 20 bp, Artificial Sequence
  Description of Artificial Sequence: Synthetic oligonucleotide
  Target: DMPK; (-) strand; PAM type: YTN; PAM sequence: CTG
ggcgcctccgaactggccca

SEQ ID NO: 17339 - DNA, 20 bp, Artificial Sequence
  Description of Artificial Sequence: Synthetic oligonucleotide
  Target: DMPK; (-) strand; PAM type: YTN; PAM sequence: CTG
ggcgtccaccaggagctggg

SEQ ID NO: 17340 - DNA, 20 bp, Artificial Sequence
  Description of Artificial Sequence: Synthetic oligonucleotide
  Target: DMPK; (-) strand; PAM type: YTN; PAM sequence: CTC
ctgggcgtccaccaggagct

SEQ ID NO: 17341 - DNA, 20 bp, Artificial Sequence
  Description of Artificial Sequence: Synthetic oligonucleotide
  Target: DMPK; (-) strand; PAM type: YTN; PAM sequence: TTC
tcctgggcgtccaccaggag

SEQ ID NO: 17342 - DNA, 20 bp, Artificial Sequence
  Description of Artificial Sequence: Synthetic oligonucleotide
  Target: DMPK; (-) strand; PAM type: YTN; PAM sequence: CTT
ctcctgggcgtccaccagga

SEQ ID NO: 17343 - DNA, 20 bp, Artificial Sequence
  Description of Artificial Sequence: Synthetic oligonucleotide
  Target: DMPK; (-) strand; PAM type: YTN; PAM sequence: CTC
gaccttctcctgggcgtcca

SEQ ID NO: 17344 - DNA, 20 bp, Artificial Sequence
  Description of Artificial Sequence: Synthetic oligonucleotide
  Target: DMPK; (-) strand; PAM type: YTN; PAM sequence: CTG
ctcgaccttctcctgggcgt

SEQ ID NO: 17345 - DNA, 20 bp, Artificial Sequence
  Description of Artificial Sequence: Synthetic oligonucleotide
  Target: DMPK; (-) strand; PAM type: YTN; PAM sequence: CTG
gagcccctgctcgaccttct

SEQ ID NO: 17346 - DNA, 20 bp, Artificial Sequence
  Description of Artificial Sequence: Synthetic oligonucleotide
  Target: DMPK; (-) strand; PAM type: YTN; PAM sequence: CTG
gggctggagcccctgctcga

SEQ ID NO: 17347 - DNA, 20 bp, Artificial Sequence
  Description of Artificial Sequence: Synthetic oligonucleotide
  Target: DMPK; (-) strand; PAM type: YTN; PAM sequence: TTC
ctggggctggagcccctgct

SEQ ID NO: 17348 - DNA, 20 bp, Artificial Sequence
  Description of Artificial Sequence: Synthetic oligonucleotide
  Target: DMPK; (-) strand; PAM type: YTN; PAM sequence: CTT
cctggggctggagcccctgc

SEQ ID NO: 17349 - DNA, 20 bp, Artificial Sequence
  Description of Artificial Sequence: Synthetic oligonucleotide
  Target: DMPK; (-) strand; PAM type: YTN; PAM sequence: TTG
gacccgggcttcctggggct

SEQ ID NO: 17350 - DNA, 20 bp, Artificial Sequence
  Description of Artificial Sequence: Synthetic oligonucleotide
  Target: DMPK; (-) strand; PAM type: YTN; PAM sequence: CTG
gtgttggacccgggcttcct

SEQ ID NO: 17351 - DNA, 20 bp, Artificial Sequence
  Description of Artificial Sequence: Synthetic oligonucleotide
  Target: DMPK; (-) strand; PAM type: YTN; PAM sequence: CTC
cagcagctggtgttggaccc

SEQ ID NO: 17352 - DNA, 20 bp, Artificial Sequence
  Description of Artificial Sequence: Synthetic oligonucleotide
  Target: DMPK; (-) strand; PAM type: YTN; PAM sequence: CTG
aggcggctccagcagctggt

SEQ ID NO: 17353 - DNA, 20 bp, Artificial Sequence
  Description of Artificial Sequence: Synthetic oligonucleotide
  Target: DMPK; (-) strand; PAM type: YTN; PAM sequence: CTG
tccaacatgtcagccgaggt

SEQ ID NO: 17354 - DNA, 20 bp, Artificial Sequence
  Description of Artificial Sequence: Synthetic oligonucleotide
  Target: DMPK; (-) strand; PAM type: YTN; PAM sequence: CTG
cctgtccaacatgtcagccg

SEQ ID NO: 17355 - DNA, 20 bp, Artificial Sequence
  Description of Artificial Sequence: Synthetic oligonucleotide
  Target: DMPK; (-) strand; PAM type: YTN; PAM sequence: CTG
tgacaggaggaccccgagcc

SEQ ID NO: 17356 - DNA, 20 bp, Artificial Sequence
  Description of Artificial Sequence: Synthetic oligonucleotide
  Target: DMPK; (-) strand; PAM type: YTN; PAM sequence: CTG
ccaggccctgtgacaggagg

SEQ ID NO: 17357 - DNA, 20 bp, Artificial Sequence
  Description of Artificial Sequence: Synthetic oligonucleotide
  Target: DMPK; (-) strand; PAM type: YTN; PAM sequence: CTG
gacaggggctgccaggccct

SEQ ID NO: 17358 - DNA, 20 bp, Artificial Sequence
  Description of Artificial Sequence: Synthetic oligonucleotide
  Target: DMPK; (-) strand; PAM type: YTN; PAM sequence: CTC
cagggcctggacaggggctg

SEQ ID NO: 17359 - DNA, 20 bp, Artificial Sequence
  Description of Artificial Sequence: Synthetic oligonucleotide
  Target: DMPK; (-) strand; PAM type: YTN; PAM sequence: CTC
ggccggccgcagagagaagt

SEQ ID NO: 17360 - DNA, 20 bp, Artificial Sequence
  Description of Artificial Sequence: Synthetic oligonucleotide
  Target: DMPK; (-) strand; PAM type: YTN; PAM sequence: CTG
gaccaaggggtggggagaag

SEQ ID NO: 17361 - DNA, 20 bp, Artificial Sequence
  Description of Artificial Sequence: Synthetic oligonucleotide
  Target: DMPK; (-) strand; PAM type: YTN; PAM sequence: CTG
ggaggcgggaggggggctgg

SEQ ID NO: 17362 - DNA, 20 bp, Artificial Sequence
  Description of Artificial Sequence: Synthetic oligonucleotide
  Target: DMPK; (-) strand; PAM type: YTN; PAM sequence: TTA
aggctgggaggcgggagggg

SEQ ID NO: 17363 - DNA, 20 bp, Artificial Sequence
  Description of Artificial Sequence: Synthetic oligonucleotide
  Target: DMPK; (-) strand; PAM type: YTN; PAM sequence: TTG
tgaggggttaaggctgggag

SEQ ID NO: 17364 - DNA, 20 bp, Artificial Sequence
  Description of Artificial Sequence: Synthetic oligonucleotide
  Target: DMPK; (-) strand; PAM type: YTN; PAM sequence: CTT
gtgaggggttaaggctggga

SEQ ID NO: 17365 - DNA, 20 bp, Artificial Sequence
  Description of Artificial Sequence: Synthetic oligonucleotide
  Target: DMPK; (-) strand; PAM type: YTN; PAM sequence: CTG
gcttgtgaggggttaaggct

SEQ ID NO: 17366 - DNA, 20 bp, Artificial Sequence
  Description of Artificial Sequence: Synthetic oligonucleotide
  Target: DMPK; (-) strand; PAM type: YTN; PAM sequence: TTG
gggggctggcttgtgagggg

SEQ ID NO: 17367 - DNA, 20 bp, Artificial Sequence
  Description of Artificial Sequence: Synthetic oligonucleotide
  Target: DMPK; (-) strand; PAM type: YTN; PAM sequence: CTT
ggggggctggcttgtgaggg

SEQ ID NO: 17368 - DNA, 20 bp, Artificial Sequence
  Description of Artificial Sequence: Synthetic oligonucleotide
  Target: DMPK; (-) strand; PAM type: YTN; PAM sequence: CTG
gaaggagggagcttgggggg

SEQ ID NO: 17369 - DNA, 20 bp, Artificial Sequence
  Description of Artificial Sequence: Synthetic oligonucleotide
  Target: DMPK; (-) strand; PAM type: YTN; PAM sequence: CTG
aagggccctggaaggaggga

SEQ ID NO: 17370 - DNA, 20 bp, Artificial Sequence
  Description of Artificial Sequence: Synthetic oligonucleotide
  Target: DMPK; (-) strand; PAM type: YTN; PAM sequence: TTC
tgaagggccctggaaggagg

SEQ ID NO: 17371 - DNA, 20 bp, Artificial Sequence
  Description of Artificial Sequence: Synthetic oligonucleotide
  Target: DMPK; (-) strand; PAM type: YTN; PAM sequence: CTG
aagggttctgaagggccctg

SEQ ID NO: 17372 - DNA, 20 bp, Artificial Sequence
  Description of Artificial Sequence: Synthetic oligonucleotide
  Target: DMPK; (-) strand; PAM type: YTN; PAM sequence: CTA
gcactgaagggttctgaagg

SEQ ID NO: 17373 - DNA, 20 bp, Artificial Sequence
  Description of Artificial Sequence: Synthetic oligonucleotide
  Target: DMPK; (-) strand; PAM type: YTN; PAM sequence: CTC
tagcactgaagggttctgaa

SEQ ID NO: 17374 - DNA, 20 bp, Artificial Sequence
  Description of Artificial Sequence: Synthetic oligonucleotide
  Target: DMPK; (-) strand; PAM type: YTN; PAM sequence: CTA
ctctagcactgaagggttct

SEQ ID NO: 17375 - DNA, 20 bp, Artificial Sequence
  Description of Artificial Sequence: Synthetic oligonucleotide
  Target: DMPK; (-) strand; PAM type: YTN; PAM sequence: TTC
cccctactctagcactgaag

SEQ ID NO: 17376 - DNA, 20 bp, Artificial Sequence
  Description of Artificial Sequence: Synthetic oligonucleotide
  Target: DMPK; (-) strand; PAM type: YTN; PAM sequence: CTC
catgcattccccctactcta

SEQ ID NO: 17377 - DNA, 20 bp, Artificial Sequence
  Description of Artificial Sequence: Synthetic oligonucleotide
  Target: DMPK; (-) strand; PAM type: YTN; PAM sequence: TTC
tccatgcattccccctactc

SEQ ID NO: 17378 - DNA, 20 bp, Artificial Sequence
  Description of Artificial Sequence: Synthetic oligonucleotide
  Target: DMPK; (-) strand; PAM type: YTN; PAM sequence: CTG
agattctccatgcattcccc

SEQ ID NO: 17379 - DNA, 20 bp, Artificial Sequence
  Description of Artificial Sequence: Synthetic oligonucleotide
  Target: DMPK; (-) strand; PAM type: YTN; PAM sequence: TTG
gggtgacagtgtgacagctg

SEQ ID NO: 17380 - DNA, 20 bp, Artificial Sequence
  Description of Artificial Sequence: Synthetic oligonucleotide
  Target: DMPK; (-) strand; PAM type: YTN; PAM sequence: TTA
ttggggtgacagtgtgacag

SEQ ID NO: 17381 - DNA, 20 bp, Artificial Sequence
  Description of Artificial Sequence: Synthetic oligonucleotide
  Target: DMPK; (-) strand; PAM type: YTN; PAM sequence: TTT
attggggtgacagtgtgaca

SEQ ID NO: 17382 - DNA, 20 bp, Artificial Sequence
  Description of Artificial Sequence: Synthetic oligonucleotide
  Target: DMPK; (-) strand; PAM type: YTN; PAM sequence: TTT
tattggggtgacagtgtgac

SEQ ID NO: 17383 - DNA, 20 bp, Artificial Sequence
  Description of Artificial Sequence: Synthetic oligonucleotide
  Target: DMPK; (-) strand; PAM type: YTN; PAM sequence: TTT
ttattggggtgacagtgtga

SEQ ID NO: 17384 - DNA, 20 bp, Artificial Sequence
  Description of Artificial Sequence: Synthetic oligonucleotide
  Target: DMPK; (-) strand; PAM type: YTN; PAM sequence: CTT
tttattggggtgacagtgtg

SEQ ID NO: 17385 - DNA, 20 bp, Artificial Sequence
  Description of Artificial Sequence: Synthetic oligonucleotide
  Target: DMPK; (-) strand; PAM type: YTN; PAM sequence: CTA
cctttttattggggtgacag

SEQ ID NO: 17386 - DNA, 20 bp, Artificial Sequence
  Description of Artificial Sequence: Synthetic oligonucleotide
  Target: DMPK; (-) strand; PAM type: YTN; PAM sequence: CTC
tacctttttattggggtgac

SEQ ID NO: 17387 - DNA, 20 bp, Artificial Sequence
  Description of Artificial Sequence: Synthetic oligonucleotide
  Target: DMPK; (-) strand; PAM type: YTN; PAM sequence: CTG
tgctctacctttttattggg

SEQ ID NO: 17388 - DNA, 20 bp, Artificial Sequence
  Description of Artificial Sequence: Synthetic oligonucleotide
  Target: DMPK; (-) strand; PAM type: YTN; PAM sequence: CTC
tgtgctctacctttttattg

SEQ ID NO: 17389 - DNA, 20 bp, Artificial Sequence
  Description of Artificial Sequence: Synthetic oligonucleotide
  Target: DMPK; (-) strand; PAM type: YTN; PAM sequence: TTC
ctctgtgctctaccttttta

SEQ ID NO: 17390 - DNA, 20 bp, Artificial Sequence
  Description of Artificial Sequence: Synthetic oligonucleotide
  Target: DMPK; (-) strand; PAM type: YTN; PAM sequence: CTT
cctctgtgctctaccttttt

SEQ ID NO: 17391 - DNA, 20 bp, Artificial Sequence
  Description of Artificial Sequence: Synthetic oligonucleotide
  Target: DMPK; (-) strand; PAM type: YTN; PAM sequence: CTG
tggcttcctctgtgctctac

SEQ ID NO: 17392 - DNA, 20 bp, Artificial Sequence
  Description of Artificial Sequence: Synthetic oligonucleotide
  Target: DMPK; (-) strand; PAM type: YTN; PAM sequence: TTC
atcacacctgtggcttcctc

SEQ ID NO: 17393 - DNA, 20 bp, Artificial Sequence
  Description of Artificial Sequence: Synthetic oligonucleotide
  Target: DMPK; (-) strand; PAM type: YTN; PAM sequence: TTG
aaattcatcacacctgtggc

SEQ ID NO: 17394 - DNA, 20 bp, Artificial Sequence
  Description of Artificial Sequence: Synthetic oligonucleotide
  Target: DMPK; (-) strand; PAM type: YTN; PAM sequence: CTT
gaaattcatcacacctgtgg

SEQ ID NO: 17395 - DNA, 20 bp, Artificial Sequence
  Description of Artificial Sequence: Synthetic oligonucleotide
  Target: DMPK; (-) strand; PAM type: YTN; PAM sequence: TTC
ttgaaattcatcacacctgt

SEQ ID NO: 17396 - DNA, 20 bp, Artificial Sequence
  Description of Artificial Sequence: Synthetic oligonucleotide
  Target: DMPK; (-) strand; PAM type: YTN; PAM sequence: CTT
cttgaaattcatcacacctg

SEQ ID NO: 17397 - DNA, 20 bp, Artificial Sequence
  Description of Artificial Sequence: Synthetic oligonucleotide
  Target: DMPK; (-) strand; PAM type: YTN; PAM sequence: TTC
ttcttgaaattcatcacacc

SEQ ID NO: 17398 - DNA, 20 bp, Artificial Sequence
  Description of Artificial Sequence: Synthetic oligonucleotide
  Target: DMPK; (-) strand; PAM type: YTN; PAM sequence: TTC
agcaatgggcaggttcttct

SEQ ID NO: 17399 - DNA, 20 bp, Artificial Sequence
  Description of Artificial Sequence: Synthetic oligonucleotide
  Target: DMPK; (-) strand; PAM type: YTN; PAM sequence: TTT
cagcaatgggcaggttcttc

SEQ ID NO: 17400 - DNA, 20 bp, Artificial Sequence
  Description of Artificial Sequence: Synthetic oligonucleotide
  Target: DMPK; (-) strand; PAM type: YTN; PAM sequence: CTG
tttcagcaatgggcaggttc

SEQ ID NO: 17401 - DNA, 20 bp, Artificial Sequence
  Description of Artificial Sequence: Synthetic oligonucleotide
  Target: DMPK; (-) strand; PAM type: YTN; PAM sequence: TTG
gccctgtttcagcaatgggc

SEQ ID NO: 17402 - DNA, 20 bp, Artificial Sequence
  Description of Artificial Sequence: Synthetic oligonucleotide
  Target: DMPK; (-) strand; PAM type: YTN; PAM sequence: CTC
aattggccctgtttcagcaa

SEQ ID NO: 17403 - DNA, 20 bp, Artificial Sequence
  Description of Artificial Sequence: Synthetic oligonucleotide
  Target: DMPK; (-) strand; PAM type: YTN; PAM sequence: CTC
agcctcaattggccctgttt

SEQ ID NO: 17404 - DNA, 20 bp, Artificial Sequence
  Description of Artificial Sequence: Synthetic oligonucleotide
  Target: DMPK; (-) strand; PAM type: YTN; PAM sequence: CTG
ggtcactcagcctcaattgg

SEQ ID NO: 17405 - DNA, 20 bp, Artificial Sequence
  Description of Artificial Sequence: Synthetic oligonucleotide
  Target: DMPK; (-) strand; PAM type: YTN; PAM sequence: CTA
ctgggtcactcagcctcaat

SEQ ID NO: 17406 - DNA, 20 bp, Artificial Sequence
  Description of Artificial Sequence: Synthetic oligonucleotide
  Target: DMPK; (-) strand; PAM type: YTN; PAM sequence: TTG
ctactgggtcactcagcctc

SEQ ID NO: 17407 - DNA, 20 bp, Artificial Sequence
  Description of Artificial Sequence: Synthetic oligonucleotide
  Target: DMPK; (-) strand; PAM type: YTN; PAM sequence: TTG
tcgggagcaagggggtggtt

SEQ ID NO: 17408 - DNA, 20 bp, Artificial Sequence
  Description of Artificial Sequence: Synthetic oligonucleotide
  Target: DMPK; (-) strand; PAM type: YTN; PAM sequence: CTT
gtcgggagcaagggggtggt

SEQ ID NO: 17409 - DNA, 20 bp, Artificial Sequence
  Description of Artificial Sequence: Synthetic oligonucleotide
  Target: DMPK; (-) strand; PAM type: YTN; PAM sequence: CTG
gagcttgtcgggagcaaggg

SEQ ID NO: 17410 - DNA, 20 bp, Artificial Sequence
  Description of Artificial Sequence: Synthetic oligonucleotide
  Target: DMPK; (-) strand; PAM type: YTN; PAM sequence: TTC
tggagcttgtcgggagcaag

SEQ ID NO: 17411 - DNA, 20 bp, Artificial Sequence
  Description of Artificial Sequence: Synthetic oligonucleotide
  Target: DMPK; (-) strand; PAM type: YTN; PAM sequence: CTA
gcccccagttctggagcttg

SEQ ID NO: 17412 - DNA, 20 bp, Artificial Sequence
  Description of Artificial Sequence: Synthetic oligonucleotide
  Target: DMPK; (-) strand; PAM type: YTN; PAM sequence: CTC
accccctagcccccagttct

SEQ ID NO: 17413 - DNA, 20 bp, Artificial Sequence
  Description of Artificial Sequence: Synthetic oligonucleotide
  Target: DMPK; (-) strand; PAM type: YTN; PAM sequence: CTC
ccacccagccccaaccccca

SEQ ID NO: 17414 - DNA, 20 bp, Artificial Sequence
  Description of Artificial Sequence: Synthetic oligonucleotide
  Target: DMPK; (-) strand; PAM type: YTN; PAM sequence: TTC
tcccacccagccccaacccc

SEQ ID NO: 17415 - DNA, 20 bp, Artificial Sequence
  Description of Artificial Sequence: Synthetic oligonucleotide
  Target: DMPK; (-) strand; PAM type: YTN; PAM sequence: TTT
ctcccacccagccccaaccc

SEQ ID NO: 17416 - DNA, 20 bp, Artificial Sequence
  Description of Artificial Sequence: Synthetic oligonucleotide
  Target: DMPK; (-) strand; PAM type: YTN; PAM sequence: CTT
tctcccacccagccccaacc

SEQ ID NO: 17417 - DNA, 20 bp, Artificial Sequence
  Description of Artificial Sequence: Synthetic oligonucleotide
  Target: DMPK; (-) strand; PAM type: YTN; PAM sequence: CTC
aacccctttctcccacccag

SEQ ID NO: 17418 - DNA, 20 bp, Artificial Sequence
  Description of Artificial Sequence: Synthetic oligonucleotide
  Target: DMPK; (-) strand; PAM type: YTN; PAM sequence: TTC
ccaggcctcaacccctttct

SEQ ID NO: 17419 - DNA, 20 bp, Artificial Sequence
  Description of Artificial Sequence: Synthetic oligonucleotide
  Target: DMPK; (-) strand; PAM type: YTN; PAM sequence: CTT
cccaggcctcaacccctttc

SEQ ID NO: 17420 - DNA, 20 bp, Artificial Sequence
  Description of Artificial Sequence: Synthetic oligonucleotide
  Target: DMPK; (-) strand; PAM type: YTN; PAM sequence: CTC
ccgtccccttcccaggcctc

SEQ ID NO: 17421 - DNA, 20 bp, Artificial Sequence
  Description of Artificial Sequence: Synthetic oligonucleotide
  Target: DMPK; (-) strand; PAM type: YTN; PAM sequence: CTG
gcctcccgtccccttcccag

SEQ ID NO: 17422 - DNA, 20 bp, Artificial Sequence
  Description of Artificial Sequence: Synthetic oligonucleotide
  Target: DMPK; (-) strand; PAM type: YTN; PAM sequence: CTG
ccctggcctcccgtcccctt

SEQ ID NO: 17423 - DNA, 20 bp, Artificial Sequence
  Description of Artificial Sequence: Synthetic oligonucleotide
  Target: DMPK; (-) strand; PAM type: YTN; PAM sequence: CTG
agtcacccaagaagctgccc

SEQ ID NO: 17424 - DNA, 20 bp, Artificial Sequence
  Description of Artificial Sequence: Synthetic oligonucleotide
  Target: DMPK; (-) strand; PAM type: YTN; PAM sequence: CTC
tgagtcacccaagaagctgc

SEQ ID NO: 17425 - DNA, 20 bp, Artificial Sequence
  Description of Artificial Sequence: Synthetic oligonucleotide
  Target: DMPK; (-) strand; PAM type: YTN; PAM sequence: CTG
tccgagtcggaatccatctc

SEQ ID NO: 17426 - DNA, 20 bp, Artificial Sequence
  Description of Artificial Sequence: Synthetic oligonucleotide
  Target: DMPK; (-) strand; PAM type: YTN; PAM sequence: TTA
actgtccgagtcggaatcca

SEQ ID NO: 17427 - DNA, 20 bp, Artificial Sequence
  Description of Artificial Sequence: Synthetic oligonucleotide
  Target: DMPK; (-) strand; PAM type: YTN; PAM sequence: TTT
aactgtccgagtcggaatcc

SEQ ID NO: 17428 - DNA, 20 bp, Artificial Sequence
  Description of Artificial Sequence: Synthetic oligonucleotide
  Target: DMPK; (-) strand; PAM type: YTN; PAM sequence: CTA
aatttaactgtccgagtcgg

SEQ ID NO: 17429 - DNA, 20 bp, Artificial Sequence
  Description of Artificial Sequence: Synthetic oligonucleotide
  Target: DMPK; (-) strand; PAM type: YTN; PAM sequence: CTG
agggctaaatttaactgtcc

SEQ ID NO: 17430 - DNA, 20 bp, Artificial Sequence
  Description of Artificial Sequence: Synthetic oligonucleotide
  Target: DMPK; (-) strand; PAM type: YTN; PAM sequence: CTG
gtataaagcagagagcctga

SEQ ID NO: 17431 - DNA, 20 bp, Artificial Sequence
  Description of Artificial Sequence: Synthetic oligonucleotide
  Target: DMPK; (-) strand; PAM type: YTN; PAM sequence: CTG
ggaaaaaaaaaaaaaaaaaa

SEQ ID NO: 17432 - DNA, 20 bp, Artificial Sequence
  Description of Artificial Sequence: Synthetic oligonucleotide
  Target: DMPK; (-) strand; PAM type: YTN; PAM sequence: CTC
ctgggaaaaaaaaaaaaaaa

SEQ ID NO: 17433 - DNA, 20 bp, Artificial Sequence
  Description of Artificial Sequence: Synthetic oligonucleotide
  Target: DMPK; (-) strand; PAM type: YTN; PAM sequence: TTC
cccacctcctgggaaaaaaa

SEQ ID NO: 17434 - DNA, 20 bp, Artificial Sequence
  Description of Artificial Sequence: Synthetic oligonucleotide
  Target: DMPK; (-) strand; PAM type: YTN; PAM sequence: CTT
ccccacctcctgggaaaaaa

SEQ ID NO: 17435 - DNA, 20 bp, Artificial Sequence
  Description of Artificial Sequence: Synthetic oligonucleotide
  Target: DMPK; (-) strand; PAM type: YTN; PAM sequence: CTC
accaccccttccccacctcc

SEQ ID NO: 17436 - DNA, 20 bp, Artificial Sequence
  Description of Artificial Sequence: Synthetic oligonucleotide
  Target: DMPK; (-) strand; PAM type: YTN; PAM sequence: CTG
tcctcaccaccccttcccca

SEQ ID NO: 17437 - DNA, 20 bp, Artificial Sequence
  Description of Artificial Sequence: Synthetic oligonucleotide
  Target: DMPK; (-) strand; PAM type: YTN; PAM sequence: CTG
gtcctgtcctcaccacccct

SEQ ID NO: 17438 - DNA, 20 bp, Artificial Sequence
  Description of Artificial Sequence: Synthetic oligonucleotide
  Target: DMPK; (-) strand; PAM type: YTN; PAM sequence: CTC
ctggtcctgtcctcaccacc

SEQ ID NO: 17439 - DNA, 20 bp, Artificial Sequence
  Description of Artificial Sequence: Synthetic oligonucleotide
  Target: DMPK; (-) strand; PAM type: YTN; PAM sequence: CTG
agggtgccccctcctggtcc

SEQ ID NO: 17440 - DNA, 20 bp, Artificial Sequence
  Description of Artificial Sequence: Synthetic oligonucleotide
  Target: DMPK; (-) strand; PAM type: YTN; PAM sequence: CTC
tgagggtgccccctcctggt

SEQ ID NO: 17441 - DNA, 20 bp, Artificial Sequence
  Description of Artificial Sequence: Synthetic oligonucleotide
  Target: DMPK; (-) strand; PAM type: YTN; PAM sequence: TTC
aggctctgagggtgccccct

SEQ ID NO: 17442 - DNA, 20 bp, Artificial Sequence
  Description of Artificial Sequence: Synthetic oligonucleotide
  Target: DMPK; (-) strand; PAM type: YTN; PAM sequence: CTG
ttcaggctctgagggtgccc

SEQ ID NO: 17443 - DNA, 20 bp, Artificial Sequence
  Description of Artificial Sequence: Synthetic oligonucleotide
  Target: DMPK; (-) strand; PAM type: YTN; PAM sequence: TTG
ggcagcaggtcacccctgtt

SEQ ID NO: 17444 - DNA, 20 bp, Artificial Sequence
  Description of Artificial Sequence: Synthetic oligonucleotide
  Target: DMPK; (-) strand; PAM type: YTN; PAM sequence: TTT
gggcagcaggtcacccctgt

SEQ ID NO: 17445 - DNA, 20 bp, Artificial Sequence
  Description of Artificial Sequence: Synthetic oligonucleotide
  Target: DMPK; (-) strand; PAM type: YTN; PAM sequence: CTT
tgggcagcaggtcacccctg

SEQ ID NO: 17446 - DNA, 20 bp, Artificial Sequence
  Description of Artificial Sequence: Synthetic oligonucleotide
  Target: DMPK; (-) strand; PAM type: YTN; PAM sequence: CTC
ccccagcctttgggcagcag

SEQ ID NO: 17447 - DNA, 20 bp, Artificial Sequence
  Description of Artificial Sequence: Synthetic oligonucleotide
  Target: DMPK; (-) strand; PAM type: YTN; PAM sequence: TTC
ctcccccagcctttgggcag

SEQ ID NO: 17448 - DNA, 20 bp, Artificial Sequence
  Description of Artificial Sequence: Synthetic oligonucleotide
  Target: DMPK; (-) strand; PAM type: YTN; PAM sequence: TTT
cctcccccagcctttgggca

SEQ ID NO: 17449 - DNA, 20 bp, Artificial Sequence
  Description of Artificial Sequence: Synthetic oligonucleotide
  Target: DMPK; (-) strand; PAM type: YTN; PAM sequence: CTT
tcctcccccagcctttgggc

SEQ ID NO: 17450 - DNA, 20 bp, Artificial Sequence
  Description of Artificial Sequence: Synthetic oligonucleotide
  Target: DMPK; (-) strand; PAM type: YTN; PAM sequence: CTC
caccactttcctcccccagc

SEQ ID NO: 17451 - DNA, 20 bp, Artificial Sequence
  Description of Artificial Sequence: Synthetic oligonucleotide
  Target: DMPK; (-) strand; PAM type: YTN; PAM sequence: TTG
gctccaccactttcctcccc

SEQ ID NO: 17452 - DNA, 20 bp, Artificial Sequence
  Description of Artificial Sequence: Synthetic oligonucleotide
  Target: DMPK; (-) strand; PAM type: YTN; PAM sequence: CTT
ggctccaccactttcctccc

SEQ ID NO: 17453 - DNA, 20 bp, Artificial Sequence
  Description of Artificial Sequence: Synthetic oligonucleotide
  Target: DMPK; (-) strand; PAM type: YTN; PAM sequence: TTG
cccagggagggcttggctcc

SEQ ID NO: 17454 - DNA, 20 bp, Artificial Sequence
  Description of Artificial Sequence: Synthetic oligonucleotide
  Target: DMPK; (-) strand; PAM type: YTN; PAM sequence: TTT
gcccagggagggcttggctc

SEQ ID NO: 17455 - DNA, 20 bp, Artificial Sequence
  Description of Artificial Sequence: Synthetic oligonucleotide
  Target: DMPK; (-) strand; PAM type: YTN; PAM sequence: CTC
gtttgcccagggagggcttg

SEQ ID NO: 17456 - DNA, 20 bp, Artificial Sequence
  Description of Artificial Sequence: Synthetic oligonucleotide
  Target: DMPK; (-) strand; PAM type: YTN; PAM sequence: TTG
gggtctcgtttgcccaggga

SEQ ID NO: 17457 - DNA, 20 bp, Artificial Sequence
  Description of Artificial Sequence: Synthetic oligonucleotide
  Target: DMPK; (-) strand; PAM type: YTN; PAM sequence: TTT
ggggtctcgtttgcccaggg

SEQ ID NO: 17458 - DNA, 20 bp, Artificial Sequence
  Description of Artificial Sequence: Synthetic oligonucleotide
  Target: DMPK; (-) strand; PAM type: YTN; PAM sequence: TTT
tggggtctcgtttgcccagg

SEQ ID NO: 17459 - DNA, 20 bp, Artificial Sequence
  Description of Artificial Sequence: Synthetic oligonucleotide
  Target: DMPK; (-) strand; PAM type: YTN; PAM sequence: CTA
ttttggggtctcgtttgccc

SEQ ID NO: 17460 - DNA, 20 bp, Artificial Sequence
  Description of Artificial Sequence: Synthetic oligonucleotide
  Target: DMPK; (-) strand; PAM type: YTN; PAM sequence: CTC
cccggccaggggccaaggag

SEQ ID NO: 17461 - DNA, 20 bp, Artificial Sequence
  Description of Artificial Sequence: Synthetic oligonucleotide
  Target: DMPK; (-) strand; PAM type: YTN; PAM sequence: CTG
ggcaggaatgtggctccccg

SEQ ID NO: 17462 - DNA, 20 bp, Artificial Sequence
  Description of Artificial Sequence: Synthetic oligonucleotide
  Target: DMPK; (-) strand; PAM type: YTN; PAM sequence: CTA
atcccagcctgggcaggaat

SEQ ID NO: 17463 - DNA, 20 bp, Artificial Sequence
  Description of Artificial Sequence: Synthetic oligonucleotide
  Target: DMPK; (-) strand; PAM type: YTN; PAM sequence: TTC
taatcccagcctgggcagga

SEQ ID NO: 17464 - DNA, 20 bp, Artificial Sequence
  Description of Artificial Sequence: Synthetic oligonucleotide
  Target: DMPK; (-) strand; PAM type: YTN; PAM sequence: TTT
ctaatcccagcctgggcagg

SEQ ID NO: 17465 - DNA, 20 bp, Artificial Sequence
  Description of Artificial Sequence: Synthetic oligonucleotide
  Target: DMPK; (-) strand; PAM type: YTN; PAM sequence: CTG
tttctaatcccagcctgggc

SEQ ID NO: 17466 - DNA, 20 bp, Artificial Sequence
  Description of Artificial Sequence: Synthetic oligonucleotide
  Target: DMPK; (-) strand; PAM type: YTN; PAM sequence: TTC
tgtttctaatcccagcctgg

SEQ ID NO: 17467 - DNA, 20 bp, Artificial Sequence
  Description of Artificial Sequence: Synthetic oligonucleotide
  Target: DMPK; (-) strand; PAM type: YTN; PAM sequence: TTT
ctgtttctaatcccagcctg

SEQ ID NO: 17468 - DNA, 20 bp, Artificial Sequence
  Description of Artificial Sequence: Synthetic oligonucleotide
  Target: DMPK; (-) strand; PAM type: YTN; PAM sequence: CTC
caccccccgaaatgtttctg

SEQ ID NO: 17469 - DNA, 20 bp, Artificial Sequence
  Description of Artificial Sequence: Synthetic oligonucleotide
  Target: DMPK; (-) strand; PAM type: YTN; PAM sequence: TTC
ccgcgccaccctccaccccc

SEQ ID NO: 17470 - DNA, 20 bp, Artificial Sequence
  Description of Artificial Sequence: Synthetic oligonucleotide
  Target: DMPK; (-) strand; PAM type: YTN; PAM sequence: CTT
cccgcgccaccctccacccc

SEQ ID NO: 17471 - DNA, 20 bp, Artificial Sequence
  Description of Artificial Sequence: Synthetic oligonucleotide
  Target: DMPK; (-) strand; PAM type: YTN; PAM sequence: CTC
ggagccgcagggagtgtgtc

SEQ ID NO: 17472 - DNA, 20 bp, Artificial Sequence
  Description of Artificial Sequence: Synthetic oligonucleotide
  Target: DMPK; (-) strand; PAM type: YTN; PAM sequence: CTC
tcggagccgcagggagtgtg

SEQ ID NO: 17473 - DNA, 20 bp, Artificial Sequence
  Description of Artificial Sequence: Synthetic oligonucleotide
  Target: DMPK; (-) strand; PAM type: YTN; PAM sequence: TTG
gctctcggagccgcagggag

SEQ ID NO: 17474 - DNA, 20 bp, Artificial Sequence
  Description of Artificial Sequence: Synthetic oligonucleotide
  Target: DMPK; (-) strand; PAM type: YTN; PAM sequence: CTT
ggctctcggagccgcaggga

SEQ ID NO: 17475 - DNA, 20 bp, Artificial Sequence
  Description of Artificial Sequence: Synthetic oligonucleotide
  Target: DMPK; (-) strand; PAM type: YTN; PAM sequence: CTC
ttggctctcggagccgcagg

SEQ ID NO: 17476 - DNA, 20 bp, Artificial Sequence
  Description of Artificial Sequence: Synthetic oligonucleotide
  Target: DMPK; (-) strand; PAM type: YTN; PAM sequence: TTC
ctcttggctctcggagccgc

SEQ ID NO: 17477 - DNA, 20 bp, Artificial Sequence
  Description of Artificial Sequence: Synthetic oligonucleotide
  Target: DMPK; (-) strand; PAM type: YTN; PAM sequence: CTC
agattcctcttggctctcgg

SEQ ID NO: 17478 - DNA, 20 bp, Artificial Sequence
  Description of Artificial Sequence: Synthetic oligonucleotide
  Target: DMPK; (-) strand; PAM type: YTN; PAM sequence: CTG
gaaagaagagctcagattcc

SEQ ID NO: 17479 - DNA, 20 bp, Artificial Sequence
  Description of Artificial Sequence: Synthetic oligonucleotide
  Target: DMPK; (-) strand; PAM type: YTN; PAM sequence: CTG
gagaaccgtccaccctggaa

SEQ ID NO: 17480 - DNA, 20 bp, Artificial Sequence
  Description of Artificial Sequence: Synthetic oligonucleotide
  Target: DMPK; (-) strand; PAM type: YTN; PAM sequence: CTC
tggagaaccgtccaccctgg

SEQ ID NO: 17481 - DNA, 20 bp, Artificial Sequence
  Description of Artificial Sequence: Synthetic oligonucleotide
  Target: DMPK; (-) strand; PAM type: YTN; PAM sequence: TTC
cactctggagaaccgtccac

SEQ ID NO: 17482 - DNA, 20 bp, Artificial Sequence
  Description of Artificial Sequence: Synthetic oligonucleotide
  Target: DMPK; (-) strand; PAM type: YTN; PAM sequence: CTT
ccactctggagaaccgtcca

SEQ ID NO: 17483 - DNA, 20 bp, Artificial Sequence
  Description of Artificial Sequence: Synthetic oligonucleotide
  Target: DMPK; (-) strand; PAM type: YTN; PAM sequence: TTG
gaggccccgacttccactct

SEQ ID NO: 17484 - DNA, 20 bp, Artificial Sequence
  Description of Artificial Sequence: Synthetic oligonucleotide
  Target: DMPK; (-) strand; PAM type: YTN; PAM sequence: CTC
aaggcccaggcaccccaggc

SEQ ID NO: 17485 - DNA, 20 bp, Artificial Sequence
  Description of Artificial Sequence: Synthetic oligonucleotide
  Target: DMPK; (-) strand; PAM type: YTN; PAM sequence: CTC
tcaaggcccaggcaccccag

SEQ ID NO: 17486 - DNA, 20 bp, Artificial Sequence
  Description of Artificial Sequence: Synthetic oligonucleotide
  Target: DMPK; (-) strand; PAM type: YTN; PAM sequence: CTG
gccctctcaaggcccaggca

SEQ ID NO: 17487 - DNA, 20 bp, Artificial Sequence
  Description of Artificial Sequence: Synthetic oligonucleotide
  Target: DMPK; (-) strand; PAM type: YTN; PAM sequence: CTC
aggcctggccctctcaaggc

SEQ ID NO: 17488 - DNA, 20 bp, Artificial Sequence
  Description of Artificial Sequence: Synthetic oligonucleotide
  Target: DMPK; (-) strand; PAM type: YTN; PAM sequence: TTC
tcaggcctggccctctcaag

SEQ ID NO: 17489 - DNA, 20 bp, Artificial Sequence
  Description of Artificial Sequence: Synthetic oligonucleotide
  Target: DMPK; (-) strand; PAM type: YTN; PAM sequence: TTT
ctcaggcctggccctctcaa

SEQ ID NO: 17490 - DNA, 20 bp, Artificial Sequence
  Description of Artificial Sequence: Synthetic oligonucleotide
  Target: DMPK; (-) strand; PAM type: YTN; PAM sequence: CTA
gtttctcaggcctggccctc

SEQ ID NO: 17491 - DNA, 20 bp, Artificial Sequence
  Description of Artificial Sequence: Synthetic oligonucleotide
  Target: DMPK; (-) strand; PAM type: YTN; PAM sequence: CTC
ctagtttctcaggcctggcc

SEQ ID NO: 17492 - DNA, 20 bp, Artificial Sequence
  Description of Artificial Sequence: Synthetic oligonucleotide
  Target: DMPK; (-) strand; PAM type: YTN; PAM sequence: TTG
cctcctagtttctcaggcct

SEQ ID NO: 17493 - DNA, 20 bp, Artificial Sequence
  Description of Artificial Sequence: Synthetic oligonucleotide
  Target: DMPK; (-) strand; PAM type: YTN; PAM sequence: CTT
gcctcctagtttctcaggcc

SEQ ID NO: 17494 - DNA, 20 bp, Artificial Sequence
  Description of Artificial Sequence: Synthetic oligonucleotide
  Target: DMPK; (-) strand; PAM type: YTN; PAM sequence: CTC
ggtccttgcctcctagtttc

SEQ ID NO: 17495 - DNA, 20 bp, Artificial Sequence
  Description of Artificial Sequence: Synthetic oligonucleotide
  Target: DMPK; (-) strand; PAM type: YTN; PAM sequence: CTC
ctcggtccttgcctcctagt

SEQ ID NO: 17496 - DNA, 20 bp, Artificial Sequence
  Description of Artificial Sequence: Synthetic oligonucleotide
  Target: DMPK; (-) strand; PAM type: YTN; PAM sequence: CTG
ggactcctcggtccttgcct

SEQ ID NO: 17497 - DNA, 20 bp, Artificial Sequence
  Description of Artificial Sequence: Synthetic oligonucleotide
  Target: DMPK; (-) strand; PAM type: YTN; PAM sequence: CTG
cccagctgggactcctcggt

SEQ ID NO: 17498 - DNA, 20 bp, Artificial Sequence
  Description of Artificial Sequence: Synthetic oligonucleotide
  Target: DMPK; (-) strand; PAM type: YTN; PAM sequence: TTC
ccaggccctgcccagctggg

SEQ ID NO: 17499 - DNA, 20 bp, Artificial Sequence
  Description of Artificial Sequence: Synthetic oligonucleotide
  Target: DMPK; (-) strand; PAM type: YTN; PAM sequence: TTT
cccaggccctgcccagctgg

SEQ ID NO: 17500 - DNA, 20 bp, Artificial Sequence
  Description of Artificial Sequence: Synthetic oligonucleotide
  Target: DMPK; (-) strand; PAM type: YTN; PAM sequence: CTG
cccaggaccacgtttcccag

SEQ ID NO: 17501 - DNA, 20 bp, Artificial Sequence
  Description of Artificial Sequence: Synthetic oligonucleotide
  Target: DMPK; (-) strand; PAM type: YTN; PAM sequence: TTA
tcagaactgcccaggaccac

SEQ ID NO: 17502 - DNA, 20 bp, Artificial Sequence
  Description of Artificial Sequence: Synthetic oligonucleotide
  Target: DMPK; (-) strand; PAM type: YTN; PAM sequence: TTA
aattatcagaactgcccagg

SEQ ID NO: 17503 - DNA, 20 bp, Artificial Sequence
  Description of Artificial Sequence: Synthetic oligonucleotide
  Target: DMPK; (-) strand; PAM type: YTN; PAM sequence: TTT
aaattatcagaactgcccag

SEQ ID NO: 17504 - DNA, 20 bp, Artificial Sequence
  Description of Artificial Sequence: Synthetic oligonucleotide
  Target: DMPK; (-) strand; PAM type: YTN; PAM sequence: TTT
taaattatcagaactgccca

SEQ ID NO: 17505 - DNA, 20 bp, Artificial Sequence
  Description of Artificial Sequence: Synthetic oligonucleotide
  Target: DMPK; (-) strand; PAM type: YTN; PAM sequence: TTT
ttaaattatcagaactgccc

SEQ ID NO: 17506 - DNA, 20 bp, Artificial Sequence
  Description of Artificial Sequence: Synthetic oligonucleotide
  Target: DMPK; (-) strand; PAM type: YTN; PAM sequence: TTT
tttaaattatcagaactgcc

SEQ ID NO: 17507 - DNA, 20 bp, Artificial Sequence
  Description of Artificial Sequence: Synthetic oligonucleotide
  Target: DMPK; (-) strand; PAM type: YTN; PAM sequence: CTC
ggtgttttttaaattatcag

SEQ ID NO: 17508 - DNA, 20 bp, Artificial Sequence
  Description of Artificial Sequence: Synthetic oligonucleotide
  Target: DMPK; (-) strand; PAM type: YTN; PAM sequence: CTC
atcaaagtcctcggtgtttt

SEQ ID NO: 17509 - DNA, 20 bp, Artificial Sequence
  Description of Artificial Sequence: Synthetic oligonucleotide
  Target: DMPK; (-) strand; PAM type: YTN; PAM sequence: CTG
cccgcagccagggcccctca

SEQ ID NO: 17510 - DNA, 20 bp, Artificial Sequence
  Description of Artificial Sequence: Synthetic oligonucleotide
  Target: DMPK; (-) strand; PAM type: YTN; PAM sequence: TTG
gggagaagagcatcctgccc

SEQ ID NO: 17511 - DNA, 20 bp, Artificial Sequence
  Description of Artificial Sequence: Synthetic oligonucleotide
  Target: DMPK; (-) strand; PAM type: YTN; PAM sequence: CTT
ggggagaagagcatcctgcc

SEQ ID NO: 17512 - DNA, 20 bp, Artificial Sequence
  Description of Artificial Sequence: Synthetic oligonucleotide
  Target: DMPK; (-) strand; PAM type: YTN; PAM sequence: CTC
ttggggagaagagcatcctg

SEQ ID NO: 17513 - DNA, 20 bp, Artificial Sequence
  Description of Artificial Sequence: Synthetic oligonucleotide
  Target: DMPK; (-) strand; PAM type: YTN; PAM sequence: CTG
gagcaggaccctcttgggga

SEQ ID NO: 17514 - DNA, 20 bp, Artificial Sequence
  Description of Artificial Sequence: Synthetic oligonucleotide
  Target: DMPK; (-) strand; PAM type: YTN; PAM sequence: CTG
gtgacccacaccagcggctg

SEQ ID NO: 17515 - DNA, 20 bp, Artificial Sequence
  Description of Artificial Sequence: Synthetic oligonucleotide
  Target: DMPK; (-) strand; PAM type: YTN; PAM sequence: CTG
cgagtcacacaactggtgac

SEQ ID NO: 17516 - DNA, 20 bp, Artificial Sequence
  Description of Artificial Sequence: Synthetic oligonucleotide
  Target: DMPK; (-) strand; PAM type: YTN; PAM sequence: TTC
atagcaggaaaagccggagc

SEQ ID NO: 17517 - DNA, 20 bp, Artificial Sequence
  Description of Artificial Sequence: Synthetic oligonucleotide
  Target: DMPK; (-) strand; PAM type: YTN; PAM sequence: TTT
catagcaggaaaagccggag

SEQ ID NO: 17518 - DNA, 20 bp, Artificial Sequence
  Description of Artificial Sequence: Synthetic oligonucleotide
  Target: DMPK; (-) strand; PAM type: YTN; PAM sequence: TTT
tcatagcaggaaaagccgga

SEQ ID NO: 17519 - DNA, 20 bp, Artificial Sequence
  Description of Artificial Sequence: Synthetic oligonucleotide
  Target: DMPK; (-) strand; PAM type: YTN; PAM sequence: CTT
ttcatagcaggaaaagccgg

SEQ ID NO: 17520 - DNA, 20 bp, Artificial Sequence
  Description of Artificial Sequence: Synthetic oligonucleotide
  Target: DMPK; (-) strand; PAM type: YTN; PAM sequence: CTC
ccaccccttttcatagcagg

SEQ ID NO: 17521 - DNA, 20 bp, Artificial Sequence
  Description of Artificial Sequence: Synthetic oligonucleotide
  Target: DMPK; (-) strand; PAM type: YTN; PAM sequence: CTC
ccagcccagcgcctcccacc

SEQ ID NO: 17522 - DNA, 20 bp, Artificial Sequence
  Description of Artificial Sequence: Synthetic oligonucleotide
  Target: DMPK; (-) strand; PAM type: YTN; PAM sequence: CTG
ctcccagcccagcgcctccc

SEQ ID NO: 17523 - DNA, 20 bp, Artificial Sequence
  Description of Artificial Sequence: Synthetic oligonucleotide
  Target: DMPK; (-) strand; PAM type: YTN; PAM sequence: TTC
cccagaggaggagtgcaggc

SEQ ID NO: 17524 - DNA, 20 bp, Artificial Sequence
  Description of Artificial Sequence: Synthetic oligonucleotide
  Target: DMPK; (-) strand; PAM type: YTN; PAM sequence: TTT
ccccagaggaggagtgcagg

SEQ ID NO: 17525 - DNA, 20 bp, Artificial Sequence
  Description of Artificial Sequence: Synthetic oligonucleotide
  Target: DMPK; (-) strand; PAM type: YTN; PAM sequence: CTT
tccccagaggaggagtgcag

SEQ ID NO: 17526 - DNA, 20 bp, Artificial Sequence
  Description of Artificial Sequence: Synthetic oligonucleotide
  Target: DMPK; (-) strand; PAM type: YTN; PAM sequence: CTA
ggcagtccgctttccccaga

SEQ ID NO: 17527 - DNA, 20 bp, Artificial Sequence
  Description of Artificial Sequence: Synthetic oligonucleotide
  Target: DMPK; (-) strand; PAM type: YTN; PAM sequence: TTC
taggcagtccgctttcccca

SEQ ID NO: 17528 - DNA, 20 bp, Artificial Sequence
  Description of Artificial Sequence: Synthetic oligonucleotide
  Target: DMPK; (-) strand; PAM type: YTN; PAM sequence: CTG
tggttctaggcagtccgctt

SEQ ID NO: 17529 - DNA, 20 bp, Artificial Sequence
  Description of Artificial Sequence: Synthetic oligonucleotide
  Target: DMPK; (-) strand; PAM type: YTN; PAM sequence: CTC
tgtggttctaggcagtccgc

SEQ ID NO: 17530 - DNA, 20 bp, Artificial Sequence
  Description of Artificial Sequence: Synthetic oligonucleotide
  Target: DMPK; (-) strand; PAM type: YTN; PAM sequence: CTG
tgtgtgtactctgtggttct

SEQ ID NO: 17531 - DNA, 20 bp, Artificial Sequence
  Description of Artificial Sequence: Synthetic oligonucleotide
  Target: DMPK; (-) strand; PAM type: YTN; PAM sequence: TTC
ggaggagatgatgtagagga

SEQ ID NO: 17532 - DNA, 20 bp, Artificial Sequence
  Description of Artificial Sequence: Synthetic oligonucleotide
  Target: DMPK; (-) strand; PAM type: YTN; PAM sequence: CTT
cggaggagatgatgtagagg

SEQ ID NO: 17533 - DNA, 20 bp, Artificial Sequence
  Description of Artificial Sequence: Synthetic oligonucleotide
  Target: DMPK; (-) strand; PAM type: YTN; PAM sequence: CTG
tccccttcggaggagatgat

SEQ ID NO: 17534 - DNA, 20 bp, Artificial Sequence
  Description of Artificial Sequence: Synthetic oligonucleotide
  Target: DMPK; (-) strand; PAM type: YTN; PAM sequence: CTC
agcgggtctgtccccttcgg

SEQ ID NO: 17535 - DNA, 20 bp, Artificial Sequence
  Description of Artificial Sequence: Synthetic oligonucleotide
  Target: DMPK; (-) strand; PAM type: YTN; PAM sequence: TTC
tcagcgggtctgtccccttc

SEQ ID NO: 17536 - DNA, 20 bp, Artificial Sequence
  Description of Artificial Sequence: Synthetic oligonucleotide
  Target: DMPK; (-) strand; PAM type: YTN; PAM sequence: TTT
ctcagcgggtctgtcccctt

SEQ ID NO: 17537 - DNA, 20 bp, Artificial Sequence
  Description of Artificial Sequence: Synthetic oligonucleotide
  Target: DMPK; (-) strand; PAM type: YTN; PAM sequence: TTT
tctcagcgggtctgtcccct

SEQ ID NO: 17538 - DNA, 20 bp, Artificial Sequence
  Description of Artificial Sequence: Synthetic oligonucleotide
  Target: DMPK; (-) strand; PAM type: YTN; PAM sequence: CTG
ttttctcagcgggtctgtcc

SEQ ID NO: 17539 - DNA, 20 bp, Artificial Sequence
  Description of Artificial Sequence: Synthetic oligonucleotide
  Target: DMPK; (-) strand; PAM type: YTN; PAM sequence: TTC
cctgttttctcagcgggtct

SEQ ID NO: 17540 - DNA, 20 bp, Artificial Sequence
  Description of Artificial Sequence: Synthetic oligonucleotide
  Target: DMPK; (-) strand; PAM type: YTN; PAM sequence: CTA
aagttccctgttttctcagc

SEQ ID NO: 17541 - DNA, 20 bp, Artificial Sequence
  Description of Artificial Sequence: Synthetic oligonucleotide
  Target: DMPK; (-) strand; PAM type: YTN; PAM sequence: TTA
tactaaagttccctgttttc

SEQ ID NO: 17542 - DNA, 20 bp, Artificial Sequence
  Description of Artificial Sequence: Synthetic oligonucleotide
  Target: DMPK; (-) strand; PAM type: YTN; PAM sequence: TTT
atactaaagttccctgtttt

SEQ ID NO: 17543 - DNA, 20 bp, Artificial Sequence
  Description of Artificial Sequence: Synthetic oligonucleotide
  Target: DMPK; (-) strand; PAM type: YTN; PAM sequence: TTA
tttatactaaagttccctgt

SEQ ID NO: 17544 - DNA, 20 bp, Artificial Sequence
  Description of Artificial Sequence: Synthetic oligonucleotide
  Target: DMPK; (-) strand; PAM type: YTN; PAM sequence: CTT
atttatactaaagttccctg

SEQ ID NO: 17545 - DNA, 20 bp, Artificial Sequence
  Description of Artificial Sequence: Synthetic oligonucleotide
  Target: DMPK; (-) strand; PAM type: YTN; PAM sequence: CTC
ttatttatactaaagttccc

SEQ ID NO: 17546 - DNA, 20 bp, Artificial Sequence
  Description of Artificial Sequence: Synthetic oligonucleotide
  Target: DMPK; (-) strand; PAM type: YTN; PAM sequence: CTG
tcccgcaggacctcttattt

SEQ ID NO: 17547 - DNA, 20 bp, Artificial Sequence
  Description of Artificial Sequence: Synthetic oligonucleotide
  Target: DMPK; (-) strand; PAM type: YTN; PAM sequence: CTC
cctgtcccgcaggacctctt

SEQ ID NO: 17548 - DNA, 20 bp, Artificial Sequence
  Description of Artificial Sequence: Synthetic oligonucleotide
  Target: DMPK; (-) strand; PAM type: YTN; PAM sequence: TTC
ctccctgtcccgcaggacct

SEQ ID NO: 17549 - DNA, 20 bp, Artificial Sequence
  Description of Artificial Sequence: Synthetic oligonucleotide
  Target: DMPK; (-) strand; PAM type: YTN; PAM sequence: CTC
aggttcctccctgtcccgca

SEQ ID NO: 17550 - DNA, 20 bp, Artificial Sequence
  Description of Artificial Sequence: Synthetic oligonucleotide
  Target: DMPK; (-) strand; PAM type: YTN; PAM sequence: TTA
tggaagcccctcaggttcct

SEQ ID NO: 17551 - DNA, 20 bp, Artificial Sequence
  Description of Artificial Sequence: Synthetic oligonucleotide
  Target: DMPK; (-) strand; PAM type: YTN; PAM sequence: TTA
aattatggaagcccctcagg

SEQ ID NO: 17552 - DNA, 20 bp, Artificial Sequence
  Description of Artificial Sequence: Synthetic oligonucleotide
  Target: DMPK; (-) strand; PAM type: YTN; PAM sequence: TTG
aagagtgttaaattatggaa

SEQ ID NO: 17553 - DNA, 20 bp, Artificial Sequence
  Description of Artificial Sequence: Synthetic oligonucleotide
  Target: DMPK; (-) strand; PAM type: YTN; PAM sequence: TTT
gaagagtgttaaattatgga

SEQ ID NO: 17554 - DNA, 20 bp, Artificial Sequence
  Description of Artificial Sequence: Synthetic oligonucleotide
  Target: DMPK; (-) strand; PAM type: YTN; PAM sequence: TTT
tgaagagtgttaaattatgg

SEQ ID NO: 17555 - DNA, 20 bp, Artificial Sequence
  Description of Artificial Sequence: Synthetic oligonucleotide
  Target: DMPK; (-) strand; PAM type: YTN; PAM sequence: CTT
ttgaagagtgttaaattatg

SEQ ID NO: 17556 - DNA, 20 bp, Artificial Sequence
  Description of Artificial Sequence: Synthetic oligonucleotide
  Target: DMPK; (-) strand; PAM type: YTN; PAM sequence: CTG
tgcttttgaagagtgttaaa

SEQ ID NO: 17557 - DNA, 20 bp, Artificial Sequence
  Description of Artificial Sequence: Synthetic oligonucleotide
  Target: DMPK; (-) strand; PAM type: YTN; PAM sequence: TTG
tctgtgcttttgaagagtgt

SEQ ID NO: 17558 - DNA, 20 bp, Artificial Sequence
  Description of Artificial Sequence: Synthetic oligonucleotide
  Target: DMPK; (-) strand; PAM type: YTN; PAM sequence: CTA
ttgtctgtgcttttgaagag

SEQ ID NO: 17559 - DNA, 20 bp, Artificial Sequence
  Description of Artificial Sequence: Synthetic oligonucleotide
  Target: DMPK; (-) strand; PAM type: YTN; PAM sequence: TTG
ctattgtctgtgcttttgaa

SEQ ID NO: 17560 - DNA, 20 bp, Artificial Sequence
  Description of Artificial Sequence: Synthetic oligonucleotide
  Target: DMPK; (-) strand; PAM type: YTN; PAM sequence: CTT
gctattgtctgtgcttttga

SEQ ID NO: 17561 - DNA, 20 bp, Artificial Sequence
  Description of Artificial Sequence: Synthetic oligonucleotide
  Target: DMPK; (-) strand; PAM type: YTN; PAM sequence: CTG
cccttgctattgtctgtgct

SEQ ID NO: 17562 - DNA, 20 bp, Artificial Sequence
  Description of Artificial Sequence: Synthetic oligonucleotide
  Target: DMPK; (-) strand; PAM type: YTN; PAM sequence: CTC
gcccggcccccaccccagct

SEQ ID NO: 17563 - DNA, 20 bp, Artificial Sequence
  Description of Artificial Sequence: Synthetic oligonucleotide
  Target: DMPK; (-) strand; PAM type: YTN; PAM sequence: TTG
agtgggcagggccgggggtg

SEQ ID NO: 17564 - DNA, 20 bp, Artificial Sequence
  Description of Artificial Sequence: Synthetic oligonucleotide
  Target: DMPK; (-) strand; PAM type: YTN; PAM sequence: CTC
agttgagtgggcagggccgg

SEQ ID NO: 17565 - DNA, 20 bp, Artificial Sequence
  Description of Artificial Sequence: Synthetic oligonucleotide
  Target: DMPK; (-) strand; PAM type: YTN; PAM sequence: CTG
cagtgtgcccctcagttgag

SEQ ID NO: 17566 - DNA, 20 bp, Artificial Sequence
  Description of Artificial Sequence: Synthetic oligonucleotide
  Target: DMPK; (-) strand; PAM type: YTN; PAM sequence: CTG
ccacaagagccccaggtctg

SEQ ID NO: 17567 - DNA, 20 bp, Artificial Sequence
  Description of Artificial Sequence: Synthetic oligonucleotide
  Target: DMPK; (-) strand; PAM type: YTN; PAM sequence: CTC
cccgcccctgccacaagagc

SEQ ID NO: 17568 - DNA, 20 bp, Artificial Sequence
  Description of Artificial Sequence: Synthetic oligonucleotide
  Target: DMPK; (-) strand; PAM type: YTN; PAM sequence: CTG
gggagagactccccgcccct

SEQ ID NO: 17569 - DNA, 20 bp, Artificial Sequence
  Description of Artificial Sequence: Synthetic oligonucleotide
  Target: DMPK; (-) strand; PAM type: YTN; PAM sequence: CTC
ctggggagagactccccgcc

SEQ ID NO: 17570 - DNA, 20 bp, Artificial Sequence
  Description of Artificial Sequence: Synthetic oligonucleotide
  Target: DMPK; (-) strand; PAM type: YTN; PAM sequence: CTG
gtcactcctggggagagact

SEQ ID NO: 17571 - DNA, 20 bp, Artificial Sequence
  Description of Artificial Sequence: Synthetic oligonucleotide
  Target: DMPK; (-) strand; PAM type: YTN; PAM sequence: CTG
tccccagcatgtgactggtc

SEQ ID NO: 17572 - DNA, 20 bp, Artificial Sequence
  Description of Artificial Sequence: Synthetic oligonucleotide
  Target: DMPK; (-) strand; PAM type: YTN; PAM sequence: CTC
atccctgtccccagcatgtg

SEQ ID NO: 17573 - DNA, 20 bp, Artificial Sequence
  Description of Artificial Sequence: Synthetic oligonucleotide
  Target: DMPK; (-) strand; PAM type: YTN; PAM sequence: TTA
ccctcatccctgtccccagc

SEQ ID NO: 17574 - DNA, 20 bp, Artificial Sequence
  Description of Artificial Sequence: Synthetic oligonucleotide
  Target: DMPK; (-) strand; PAM type: YTN; PAM sequence: CTG
aaacatcagtgttaccctca

SEQ ID NO: 17575 - DNA, 20 bp, Artificial Sequence
  Description of Artificial Sequence: Synthetic oligonucleotide
  Target: DMPK; (-) strand; PAM type: YTN; PAM sequence: CTC
tgaaacatcagtgttaccct

SEQ ID NO: 17576 - DNA, 20 bp, Artificial Sequence
  Description of Artificial Sequence: Synthetic oligonucleotide
  Target: DMPK; (-) strand; PAM type: YTN; PAM sequence: TTC
ctctgaaacatcagtgttac

SEQ ID NO: 17577 - DNA, 20 bp, Artificial Sequence
  Description of Artificial Sequence: Synthetic oligonucleotide
  Target: DMPK; (-) strand; PAM type: YTN; PAM sequence: CTT
cctctgaaacatcagtgtta

SEQ ID NO: 17578 - DNA, 20 bp, Artificial Sequence
  Description of Artificial Sequence: Synthetic oligonucleotide
  Target: DMPK; (-) strand; PAM type: YTN; PAM sequence: CTC
ttcctctgaaacatcagtgt

SEQ ID NO: 17579 - DNA, 20 bp, Artificial Sequence
  Description of Artificial Sequence: Synthetic oligonucleotide
  Target: DMPK; (-) strand; PAM type: YTN; PAM sequence: CTG
ccaagtacaatgacctcttc

SEQ ID NO: 17580 - DNA, 20 bp, Artificial Sequence
  Description of Artificial Sequence: Synthetic oligonucleotide
  Target: DMPK; (-) strand; PAM type: YTN; PAM sequence: TTG
tcccccacccactgccaagt

SEQ ID NO: 17581 - DNA, 20 bp, Artificial Sequence
  Description of Artificial Sequence: Synthetic oligonucleotide
  Target: DMPK; (-) strand; PAM type: YTN; PAM sequence: CTT
gtcccccacccactgccaag

SEQ ID NO: 17582 - DNA, 20 bp, Artificial Sequence
  Description of Artificial Sequence: Synthetic oligonucleotide
  Target: DMPK; (-) strand; PAM type: YTN; PAM sequence: CTC
agccttgtcccccacccact

SEQ ID NO: 17583 - DNA, 20 bp, Artificial Sequence
  Description of Artificial Sequence: Synthetic oligonucleotide
  Target: DMPK; (-) strand; PAM type: YTN; PAM sequence: TTG
tggcctcagccttgtccccc

SEQ ID NO: 17584 - DNA, 20 bp, Artificial Sequence
  Description of Artificial Sequence: Synthetic oligonucleotide
  Target: DMPK; (-) strand; PAM type: YTN; PAM sequence: CTT
gtggcctcagccttgtcccc

SEQ ID NO: 17585 - DNA, 20 bp, Artificial Sequence
  Description of Artificial Sequence: Synthetic oligonucleotide
  Target: DMPK; (-) strand; PAM type: YTN; PAM sequence: CTG
gcccggacacgggcgatgta

SEQ ID NO: 17586 - DNA, 20 bp, Artificial Sequence
  Description of Artificial Sequence: Synthetic oligonucleotide
  Target: DMPK; (-) strand; PAM type: YTN; PAM sequence: TTG
ggggccccccagactggccc

SEQ ID NO: 17587 - DNA, 20 bp, Artificial Sequence
  Description of Artificial Sequence: Synthetic oligonucleotide
  Target: DMPK; (-) strand; PAM type: YTN; PAM sequence: TTT
gggggccccccagactggcc

SEQ ID NO: 17588 - DNA, 20 bp, Artificial Sequence
  Description of Artificial Sequence: Synthetic oligonucleotide
  Target: DMPK; (-) strand; PAM type: YTN; PAM sequence: CTG
cacaaaatttgggggccccc

SEQ ID NO: 17589 - DNA, 20 bp, Artificial Sequence
  Description of Artificial Sequence: Synthetic oligonucleotide
  Target: DMPK; (-) strand; PAM type: YTN; PAM sequence: CTC
cagtccccccacctgcacaa

SEQ ID NO: 17590 - DNA, 20 bp, Artificial Sequence
  Description of Artificial Sequence: Synthetic oligonucleotide
  Target: DMPK; (-) strand; PAM type: YTN; PAM sequence: CTG
ctccagtccccccacctgca

SEQ ID NO: 17591 - DNA, 20 bp, Artificial Sequence
  Description of Artificial Sequence: Synthetic oligonucleotide
  Target: DMPK; (-) strand; PAM type: YTN; PAM sequence: CTA
accatgatggatggactgct

SEQ ID NO: 17592 - DNA, 20 bp, Artificial Sequence
  Description of Artificial Sequence: Synthetic oligonucleotide
  Target: DMPK; (-) strand; PAM type: YTN; PAM sequence: TTA
acaagactaaccatgatgga

SEQ ID NO: 17593 - DNA, 20 bp, Artificial Sequence
  Description of Artificial Sequence: Synthetic oligonucleotide
  Target: DMPK; (-) strand; PAM type: YTN; PAM sequence: CTC
acagatcaacgtattaacaa

SEQ ID NO: 17594 - DNA, 20 bp, Artificial Sequence
  Description of Artificial Sequence: Synthetic oligonucleotide
  Target: DMPK; (-) strand; PAM type: YTN; PAM sequence: CTG
acctcacagatcaacgtatt

SEQ ID NO: 17595 - DNA, 20 bp, Artificial Sequence
  Description of Artificial Sequence: Synthetic oligonucleotide
  Target: DMPK; (-) strand; PAM type: YTN; PAM sequence: CTG
ctgacctcacagatcaacgt

SEQ ID NO: 17596 - DNA, 20 bp, Artificial Sequence
  Description of Artificial Sequence: Synthetic oligonucleotide
  Target: DMPK; (-) strand; PAM type: YTN; PAM sequence: CTC
cctgctgacctcacagatca

SEQ ID NO: 17597 - DNA, 20 bp, Artificial Sequence
  Description of Artificial Sequence: Synthetic oligonucleotide
  Target: DMPK; (-) strand; PAM type: YTN; PAM sequence: CTA
gccataaccctccctgctga

SEQ ID NO: 17598 - DNA, 20 bp, Artificial Sequence
  Description of Artificial Sequence: Synthetic oligonucleotide
  Target: DMPK; (-) strand; PAM type: YTN; PAM sequence: CTC
ctagccataaccctccctgc

SEQ ID NO: 17599 - DNA, 20 bp, Artificial Sequence
  Description of Artificial Sequence: Synthetic oligonucleotide
  Target: DMPK; (-) strand; PAM type: YTN; PAM sequence: CTC
cccgagtggcacagtggtgt

SEQ ID NO: 17600 - DNA, 20 bp, Artificial Sequence
  Description of Artificial Sequence: Synthetic oligonucleotide
  Target: DMPK; (-) strand; PAM type: YTN; PAM sequence: CTC
ccaaccaggcaactccccga

SEQ ID NO: 17601 - DNA, 20 bp, Artificial Sequence
  Description of Artificial Sequence: Synthetic oligonucleotide
  Target: DMPK; (-) strand; PAM type: YTN; PAM sequence: CTC
ctcccaaccaggcaactccc

SEQ ID NO: 17602 - DNA, 20 bp, Artificial Sequence
  Description of Artificial Sequence: Synthetic oligonucleotide
  Target: DMPK; (-) strand; PAM type: YTN; PAM sequence: TTC
cccagggcatctcctcccaa

SEQ ID NO: 17603 - DNA, 20 bp, Artificial Sequence
  Description of Artificial Sequence: Synthetic oligonucleotide
  Target: DMPK; (-) strand; PAM type: YTN; PAM sequence: CTT
ccccagggcatctcctccca

SEQ ID NO: 17604 - DNA, 20 bp, Artificial Sequence
  Description of Artificial Sequence: Synthetic oligonucleotide
  Target: DMPK; (-) strand; PAM type: YTN; PAM sequence: CTC
atcttccccagggcatctcc

SEQ ID NO: 17605 - DNA, 20 bp, Artificial Sequence
  Description of Artificial Sequence: Synthetic oligonucleotide
  Target: DMPK; (-) strand; PAM type: YTN; PAM sequence: CTC
tcatcttccccagggcatct

SEQ ID NO: 17606 - DNA, 20 bp, Artificial Sequence
  Description of Artificial Sequence: Synthetic oligonucleotide
  Target: DMPK; (-) strand; PAM type: YTN; PAM sequence: CTC
cctctcatcttccccagggc

SEQ ID NO: 17607 - DNA, 20 bp, Artificial Sequence
  Description of Artificial Sequence: Synthetic oligonucleotide
  Target: DMPK; (-) strand; PAM type: YTN; PAM sequence: CTC
tccctctcatcttccccagg

SEQ ID NO: 17608 - DNA, 20 bp, Artificial Sequence
  Description of Artificial Sequence: Synthetic oligonucleotide
  Target: DMPK; (-) strand; PAM type: YTN; PAM sequence: CTC
ccatctctccctctcatctt

SEQ ID NO: 17609 - DNA, 20 bp, Artificial Sequence
  Description of Artificial Sequence: Synthetic oligonucleotide
  Target: DMPK; (-) strand; PAM type: YTN; PAM sequence: CTA
acccctcccatctctccctc

SEQ ID NO: 17610 - DNA, 20 bp, Artificial Sequence
  Description of Artificial Sequence: Synthetic oligonucleotide
  Target: DMPK; (-) strand; PAM type: YTN; PAM sequence: CTC
taacccctcccatctctccc

SEQ ID NO: 17611 - DNA, 20 bp, Artificial Sequence
  Description of Artificial Sequence: Synthetic oligonucleotide
  Target: DMPK; (-) strand; PAM type: YTN; PAM sequence: CTG
aagcccaggtggtctctaac

SEQ ID NO: 17612 - DNA, 20 bp, Artificial Sequence
  Description of Artificial Sequence: Synthetic oligonucleotide
  Target: DMPK; (-) strand; PAM type: YTN; PAM sequence: CTG
gctgaagcccaggtggtctc

SEQ ID NO: 17613 - DNA, 20 bp, Artificial Sequence
  Description of Artificial Sequence: Synthetic oligonucleotide
  Target: DMPK; (-) strand; PAM type: YTN; PAM sequence: TTG
acactggctgaagcccaggt

SEQ ID NO: 17614 - DNA, 20 bp, Artificial Sequence
  Description of Artificial Sequence: Synthetic oligonucleotide
  Target: DMPK; (-) strand; PAM type: YTN; PAM sequence: CTT
gacactggctgaagcccagg

SEQ ID NO: 17615 - DNA, 20 bp, Artificial Sequence
  Description of Artificial Sequence: Synthetic oligonucleotide
  Target: DMPK; (-) strand; PAM type: YTN; PAM sequence: CTC
cccttgacactggctgaagc

SEQ ID NO: 17616 - DNA, 20 bp, Artificial Sequence
  Description of Artificial Sequence: Synthetic oligonucleotide
  Target: DMPK; (-) strand; PAM type: YTN; PAM sequence: CTC
cctccccttgacactggctg

SEQ ID NO: 17617 - DNA, 20 bp, Artificial Sequence
  Description of Artificial Sequence: Synthetic oligonucleotide
  Target: DMPK; (-) strand; PAM type: YTN; PAM sequence: CTG
gctccctccccttgacactg

SEQ ID NO: 17618 - DNA, 20 bp, Artificial Sequence
  Description of Artificial Sequence: Synthetic oligonucleotide
  Target: DMPK; (-) strand; PAM type: YTN; PAM sequence: CTG
ggctggctccctccccttga

SEQ ID NO: 17619 - DNA, 20 bp, Artificial Sequence
  Description of Artificial Sequence: Synthetic oligonucleotide
  Target: DMPK; (-) strand; PAM type: YTN; PAM sequence: CTC
tgggctggctccctcccctt

SEQ ID NO: 17620 - DNA, 20 bp, Artificial Sequence
  Description of Artificial Sequence: Synthetic oligonucleotide
  Target: DMPK; (-) strand; PAM type: YTN; PAM sequence: TTG
gggactctgggctggctccc

SEQ ID NO: 17621 - DNA, 20 bp, Artificial Sequence
  Description of Artificial Sequence: Synthetic oligonucleotide
  Target: DMPK; (-) strand; PAM type: YTN; PAM sequence: TTT
ggggactctgggctggctcc

SEQ ID NO: 17622 - DNA, 20 bp, Artificial Sequence
  Description of Artificial Sequence: Synthetic oligonucleotide
  Target: DMPK; (-) strand; PAM type: YTN; PAM sequence: CTT
tggggactctgggctggctc

SEQ ID NO: 17623 - DNA, 20 bp, Artificial Sequence
  Description of Artificial Sequence: Synthetic oligonucleotide
  Target: DMPK; (-) strand; PAM type: YTN; PAM sequence: CTA
gggcggacccaagggcaagg

SEQ ID NO: 17624 - DNA, 20 bp, Artificial Sequence
  Description of Artificial Sequence: Synthetic oligonucleotide
  Target: DMPK; (-) strand; PAM type: YTN; PAM sequence: CTG
gggggtctagggcggaccca

SEQ ID NO: 17625 - DNA, 20 bp, Artificial Sequence
  Description of Artificial Sequence: Synthetic oligonucleotide
  Target: DMPK; (-) strand; PAM type: YTN; PAM sequence: CTC
tggggggtctagggcggacc

SEQ ID NO: 17626 - DNA, 20 bp, Artificial Sequence
  Description of Artificial Sequence: Synthetic oligonucleotide
  Target: DMPK; (-) strand; PAM type: YTN; PAM sequence: CTA
gagcagtggcctctgggggg

SEQ ID NO: 17627 - DNA, 20 bp, Artificial Sequence
  Description of Artificial Sequence: Synthetic oligonucleotide
  Target: DMPK; (-) strand; PAM type: YTN; PAM sequence: TTC
ccagcctagagcagtggcct

SEQ ID NO: 17628 - DNA, 20 bp, Artificial Sequence
  Description of Artificial Sequence: Synthetic oligonucleotide
  Target: DMPK; (-) strand; PAM type: YTN; PAM sequence: CTA
agatgcaagttcccagccta

SEQ ID NO: 17629 - DNA, 20 bp, Artificial Sequence
  Description of Artificial Sequence: Synthetic oligonucleotide
  Target: DMPK; (-) strand; PAM type: YTN; PAM sequence: CTA
gctaagatgcaagttcccag

SEQ ID NO: 17630 - DNA, 20 bp, Artificial Sequence
  Description of Artificial Sequence: Synthetic oligonucleotide
  Target: DMPK; (-) strand; PAM type: YTN; PAM sequence: CTG
ccaggacaggaagctagcta

SEQ ID NO: 17631 - DNA, 20 bp, Artificial Sequence
  Description of Artificial Sequence: Synthetic oligonucleotide
  Target: DMPK; (-) strand; PAM type: YTN; PAM sequence: CTG
actgccaggacaggaagcta

SEQ ID NO: 17632 - DNA, 20 bp, Artificial Sequence
  Description of Artificial Sequence: Synthetic oligonucleotide
  Target: DMPK; (-) strand; PAM type: YTN; PAM sequence: TTG
cgtgaaagtgctgactgcca

SEQ ID NO: 17633 - DNA, 20 bp, Artificial Sequence
  Description of Artificial Sequence: Synthetic oligonucleotide
  Target: DMPK; (-) strand; PAM type: YTN; PAM sequence: TTA
ttgcgtgaaagtgctgactg

SEQ ID NO: 17634 - DNA, 20 bp, Artificial Sequence
  Description of Artificial Sequence: Synthetic oligonucleotide
  Target: DMPK; (-) strand; PAM type: YTN; PAM sequence: TTG
attattgcgtgaaagtgctg

SEQ ID NO: 17635 - DNA, 20 bp, Artificial Sequence
  Description of Artificial Sequence: Synthetic oligonucleotide
  Target: DMPK; (-) strand; PAM type: YTN; PAM sequence: TTT
gattattgcgtgaaagtgct

SEQ ID NO: 17636 - DNA, 20 bp, Artificial Sequence
  Description of Artificial Sequence: Synthetic oligonucleotide
  Target: DMPK; (-) strand; PAM type: YTN; PAM sequence: CTT
tgattattgcgtgaaagtgc

SEQ ID NO: 17637 - DNA, 20 bp, Artificial Sequence
  Description of Artificial Sequence: Synthetic oligonucleotide
  Target: DMPK; (-) strand; PAM type: YTN; PAM sequence: CTC
aggatccgccaaggactttg

SEQ ID NO: 17638 - DNA, 20 bp, Artificial Sequence
  Description of Artificial Sequence: Synthetic oligonucleotide
  Target: DMPK; (-) strand; PAM type: YTN; PAM sequence: CTC
actcaggatccgccaaggac

SEQ ID NO: 17639 - DNA, 20 bp, Artificial Sequence
  Description of Artificial Sequence: Synthetic oligonucleotide
  Target: DMPK; (-) strand; PAM type: YTN; PAM sequence: TTA
ccccatggtctcactcagga

SEQ ID NO: 17640 - DNA, 20 bp, Artificial Sequence
  Description of Artificial Sequence: Synthetic oligonucleotide
  Target: DMPK; (-) strand; PAM type: YTN; PAM sequence: CTT
accccatggtctcactcagg

SEQ ID NO: 17641 - DNA, 20 bp, Artificial Sequence
  Description of Artificial Sequence: Synthetic oligonucleotide
  Target: DMPK; (-) strand; PAM type: YTN; PAM sequence: TTA
cccttaccccatggtctcac

SEQ ID NO: 17642 - DNA, 20 bp, Artificial Sequence
  Description of Artificial Sequence: Synthetic oligonucleotide
  Target: DMPK; (-) strand; PAM type: YTN; PAM sequence: CTT
acccttaccccatggtctca

SEQ ID NO: 17643 - DNA, 20 bp, Artificial Sequence
  Description of Artificial Sequence: Synthetic oligonucleotide
  Target: DMPK; (-) strand; PAM type: YTN; PAM sequence: CTC
ccacccttacccttacccca

SEQ ID NO: 17644 - DNA, 20 bp, Artificial Sequence
  Description of Artificial Sequence: Synthetic oligonucleotide
  Target: DMPK; (-) strand; PAM type: YTN; PAM sequence: CTC
ccctcccacccttaccctta

SEQ ID NO: 17645 - DNA, 20 bp, Artificial Sequence
  Description of Artificial Sequence: Synthetic oligonucleotide
  Target: DMPK; (-) strand; PAM type: YTN; PAM sequence: TTC
cccctcccctcccaccctta

SEQ ID NO: 17646 - DNA, 20 bp, Artificial Sequence
  Description of Artificial Sequence: Synthetic oligonucleotide
  Target: DMPK; (-) strand; PAM type: YTN; PAM sequence: TTT
ccccctcccctcccaccctt

SEQ ID NO: 17647 - DNA, 20 bp, Artificial Sequence
  Description of Artificial Sequence: Synthetic oligonucleotide
  Target: DMPK; (-) strand; PAM type: YTN; PAM sequence: CTC
cagtttccccctcccctccc

SEQ ID NO: 17648 - DNA, 20 bp, Artificial Sequence
  Description of Artificial Sequence: Synthetic oligonucleotide
  Target: DMPK; (-) strand; PAM type: YTN; PAM sequence: TTA
gaagggagctccagtttccc

SEQ ID NO: 17649 - DNA, 20 bp, Artificial Sequence
  Description of Artificial Sequence: Synthetic oligonucleotide
  Target: DMPK; (-) strand; PAM type: YTN; PAM sequence: CTC
ccaagttagaagggagctcc

SEQ ID NO: 17650 - DNA, 20 bp, Artificial Sequence
  Description of Artificial Sequence: Synthetic oligonucleotide
  Target: DMPK; (-) strand; PAM type: YTN; PAM sequence: CTC
agggtccctcccaagttaga

SEQ ID NO: 17651 - DNA, 20 bp, Artificial Sequence
  Description of Artificial Sequence: Synthetic oligonucleotide
  Target: DMPK; (-) strand; PAM type: YTN; PAM sequence: TTC
cccagcacctcagggtccct

SEQ ID NO: 17652 - DNA, 20 bp, Artificial Sequence
  Description of Artificial Sequence: Synthetic oligonucleotide
  Target: DMPK; (-) strand; PAM type: YTN; PAM sequence: TTT
ccccagcacctcagggtccc

SEQ ID NO: 17653 - DNA, 20 bp, Artificial Sequence
  Description of Artificial Sequence: Synthetic oligonucleotide
  Target: DMPK; (-) strand; PAM type: YTN; PAM sequence: CTT
tccccagcacctcagggtcc

SEQ ID NO: 17654 - DNA, 20 bp, Artificial Sequence
  Description of Artificial Sequence: Synthetic oligonucleotide
  Target: DMPK; (-) strand; PAM type: YTN; PAM sequence: TTC
tttccccagcacctcagggt

SEQ ID NO: 17655 - DNA, 20 bp, Artificial Sequence
  Description of Artificial Sequence: Synthetic oligonucleotide
  Target: DMPK; (-) strand; PAM type: YTN; PAM sequence: CTG
agttctttccccagcacctc

SEQ ID NO: 17656 - DNA, 20 bp, Artificial Sequence
  Description of Artificial Sequence: Synthetic oligonucleotide
  Target: DMPK; (-) strand; PAM type: YTN; PAM sequence: CTG
tccctgagttctttccccag

SEQ ID NO: 17657 - DNA, 20 bp, Artificial Sequence
  Description of Artificial Sequence: Synthetic oligonucleotide
  Target: DMPK; (-) strand; PAM type: YTN; PAM sequence: TTG
gcccaggtcacccagcaagt

SEQ ID NO: 17658 - DNA, 20 bp, Artificial Sequence
  Description of Artificial Sequence: Synthetic oligonucleotide
  Target: DMPK; (-) strand; PAM type: YTN; PAM sequence: TTC
acagacgaggagaccgaggc

SEQ ID NO: 17659 - DNA, 20 bp, Artificial Sequence
  Description of Artificial Sequence: Synthetic oligonucleotide
  Target: DMPK; (-) strand; PAM type: YTN; PAM sequence: CTC
cgtagttcacagacgaggag

SEQ ID NO: 17660 - DNA, 20 bp, Artificial Sequence
  Description of Artificial Sequence: Synthetic oligonucleotide
  Target: DMPK; (-) strand; PAM type: YTN; PAM sequence: CTG
tctccgtagttcacagacga

SEQ ID NO: 17661 - DNA, 20 bp, Artificial Sequence
  Description of Artificial Sequence: Synthetic oligonucleotide
  Target: DMPK; (-) strand; PAM type: YTN; PAM sequence: CTC
tgtctccgtagttcacagac

SEQ ID NO: 17662 - DNA, 20 bp, Artificial Sequence
  Description of Artificial Sequence: Synthetic oligonucleotide
  Target: DMPK; (-) strand; PAM type: YTN; PAM sequence: CTA
aaagagacccctctgtctcc

SEQ ID NO: 17663 - DNA, 20 bp, Artificial Sequence
  Description of Artificial Sequence: Synthetic oligonucleotide
  Target: DMPK; (-) strand; PAM type: YTN; PAM sequence: TTG
agtcctaaaagagacccctc

SEQ ID NO: 17664 - DNA, 20 bp, Artificial Sequence
  Description of Artificial Sequence: Synthetic oligonucleotide
  Target: DMPK; (-) strand; PAM type: YTN; PAM sequence: CTG
gttgagtcctaaaagagacc

SEQ ID NO: 17665 - DNA, 20 bp, Artificial Sequence
  Description of Artificial Sequence: Synthetic oligonucleotide
  Target: DMPK; (-) strand; PAM type: YTN; PAM sequence: TTG
gggagtctggttgagtccta

SEQ ID NO: 17666 - DNA, 20 bp, Artificial Sequence
  Description of Artificial Sequence: Synthetic oligonucleotide
  Target: DMPK; (-) strand; PAM type: YTN; PAM sequence: TTT
ggggagtctggttgagtcct

SEQ ID NO: 17667 - DNA, 20 bp, Artificial Sequence
  Description of Artificial Sequence: Synthetic oligonucleotide
  Target: DMPK; (-) strand; PAM type: YTN; PAM sequence: CTC
agaggcaagagtggtgggat

SEQ ID NO: 17668 - DNA, 20 bp, Artificial Sequence
  Description of Artificial Sequence: Synthetic oligonucleotide
  Target: DMPK; (-) strand; PAM type: YTN; PAM sequence: CTG
agtgactcagaggcaagagt

SEQ ID NO: 17669 - DNA, 20 bp, Artificial Sequence
  Description of Artificial Sequence: Synthetic oligonucleotide
  Target: DMPK; (-) strand; PAM type: YTN; PAM sequence: TTG
agagcacagtctgagtgact

SEQ ID NO: 17670 - DNA, 20 bp, Artificial Sequence
  Description of Artificial Sequence: Synthetic oligonucleotide
  Target: DMPK; (-) strand; PAM type: YTN; PAM sequence: CTT
gagagcacagtctgagtgac

SEQ ID NO: 17671 - DNA, 20 bp, Artificial Sequence
  Description of Artificial Sequence: Synthetic oligonucleotide
  Target: DMPK; (-) strand; PAM type: YTN; PAM sequence: CTA
gaacttgagagcacagtctg

SEQ ID NO: 17672 - DNA, 20 bp, Artificial Sequence
  Description of Artificial Sequence: Synthetic oligonucleotide
  Target: DMPK; (-) strand; PAM type: YTN; PAM sequence: CTG
agtccctagaacttgagagc

SEQ ID NO: 17673 - DNA, 20 bp, Artificial Sequence
  Description of Artificial Sequence: Synthetic oligonucleotide
  Target: DMPK; (-) strand; PAM type: YTN; PAM sequence: TTG
gaatcgtagagtcctgagtc

SEQ ID NO: 17674 - DNA, 20 bp, Artificial Sequence
  Description of Artificial Sequence: Synthetic oligonucleotide
  Target: DMPK; (-) strand; PAM type: YTN; PAM sequence: TTT
ggaatcgtagagtcctgagt

SEQ ID NO: 17675 - DNA, 20 bp, Artificial Sequence
  Description of Artificial Sequence: Synthetic oligonucleotide
  Target: DMPK; (-) strand; PAM type: YTN; PAM sequence: TTT
tggaatcgtagagtcctgag

SEQ ID NO: 17676 - DNA, 20 bp, Artificial Sequence
  Description of Artificial Sequence: Synthetic oligonucleotide
  Target: DMPK; (-) strand; PAM type: YTN; PAM sequence: CTC
agttttggaatcgtagagtc

SEQ ID NO: 17677 - DNA, 20 bp, Artificial Sequence
  Description of Artificial Sequence: Synthetic oligonucleotide
  Target: DMPK; (-) strand; PAM type: YTN; PAM sequence: CTC
agatcctcagttttggaatc

SEQ ID NO: 17678 - DNA, 20 bp, Artificial Sequence
  Description of Artificial Sequence: Synthetic oligonucleotide
  Target: DMPK; (-) strand; PAM type: YTN; PAM sequence: TTC
ctcagatcctcagttttgga

SEQ ID NO: 17679 - DNA, 20 bp, Artificial Sequence
  Description of Artificial Sequence: Synthetic oligonucleotide
  Target: DMPK; (-) strand; PAM type: YTN; PAM sequence: TTG
gttcctcagatcctcagttt

SEQ ID NO: 17680 - DNA, 20 bp, Artificial Sequence
  Description of Artificial Sequence: Synthetic oligonucleotide
  Target: DMPK; (-) strand; PAM type: YTN; PAM sequence: CTT
ggttcctcagatcctcagtt

SEQ ID NO: 17681 - DNA, 20 bp, Artificial Sequence
  Description of Artificial Sequence: Synthetic oligonucleotide
  Target: DMPK; (-) strand; PAM type: YTN; PAM sequence: CTG
gaggccgtggcttggttcct

SEQ ID NO: 17682 - DNA, 20 bp, Artificial Sequence
  Description of Artificial Sequence: Synthetic oligonucleotide
  Target: DMPK; (-) strand; PAM type: YTN; PAM sequence: TTG
cccagggtcctggaggccgt

SEQ ID NO: 17683 - DNA, 20 bp, Artificial Sequence
  Description of Artificial Sequence: Synthetic oligonucleotide
  Target: DMPK; (-) strand; PAM type: YTN; PAM sequence: CTC
agttgcccagggtcctggag

SEQ ID NO: 17684 - DNA, 20 bp, Artificial Sequence
  Description of Artificial Sequence: Synthetic oligonucleotide
  Target: DMPK; (-) strand; PAM type: YTN; PAM sequence: TTG
gactcagttgcccagggtcc

SEQ ID NO: 17685 - DNA, 20 bp, Artificial Sequence
  Description of Artificial Sequence: Synthetic oligonucleotide
  Target: DMPK; (-) strand; PAM type: YTN; PAM sequence: CTT
ggactcagttgcccagggtc

SEQ ID NO: 17686 - DNA, 20 bp, Artificial Sequence
  Description of Artificial Sequence: Synthetic oligonucleotide
  Target: DMPK; (-) strand; PAM type: YTN; PAM sequence: TTA
gggcttggactcagttgccc

SEQ ID NO: 17687 - DNA, 20 bp, Artificial Sequence
  Description of Artificial Sequence: Synthetic oligonucleotide
  Target: DMPK; (-) strand; PAM type: YTN; PAM sequence: CTT
agggcttggactcagttgcc

SEQ ID NO: 17688 - DNA, 20 bp, Artificial Sequence
  Description of Artificial Sequence: Synthetic oligonucleotide
  Target: DMPK; (-) strand; PAM type: YTN; PAM sequence: TTC
ttagggcttggactcagttg

SEQ ID NO: 17689 - DNA, 20 bp, Artificial Sequence
  Description of Artificial Sequence: Synthetic oligonucleotide
  Target: DMPK; (-) strand; PAM type: YTN; PAM sequence: CTT
cttagggcttggactcagtt

SEQ ID NO: 17690 - DNA, 20 bp, Artificial Sequence
  Description of Artificial Sequence: Synthetic oligonucleotide
  Target: DMPK; (-) strand; PAM type: YTN; PAM sequence: CTC
agcttcttagggcttggact

SEQ ID NO: 17691 - DNA, 20 bp, Artificial Sequence
  Description of Artificial Sequence: Synthetic oligonucleotide
  Target: DMPK; (-) strand; PAM type: YTN; PAM sequence: TTG
ggtgtctcagcttcttaggg

SEQ ID NO: 17692 - DNA, 20 bp, Artificial Sequence
  Description of Artificial Sequence: Synthetic oligonucleotide
  Target: DMPK; (-) strand; PAM type: YTN; PAM sequence: CTT
gggtgtctcagcttcttagg

SEQ ID NO: 17693 - DNA, 20 bp, Artificial Sequence
  Description of Artificial Sequence: Synthetic oligonucleotide
  Target: DMPK; (-) strand; PAM type: YTN; PAM sequence: CTC
gtcttgggtgtctcagcttc

SEQ ID NO: 17694 - DNA, 20 bp, Artificial Sequence
  Description of Artificial Sequence: Synthetic oligonucleotide
  Target: DMPK; (-) strand; PAM type: YTN; PAM sequence: TTC
ggagctcgtcttgggtgtct

SEQ ID NO: 17695 - DNA, 20 bp, Artificial Sequence
  Description of Artificial Sequence: Synthetic oligonucleotide
  Target: DMPK; (-) strand; PAM type: YTN; PAM sequence: TTG
taagttcggagctcgtcttg

SEQ ID NO: 17696 - DNA, 20 bp, Artificial Sequence
  Description of Artificial Sequence: Synthetic oligonucleotide
  Target: DMPK; (-) strand; PAM type: YTN; PAM sequence: CTT
gtaagttcggagctcgtctt

SEQ ID NO: 17697 - DNA, 20 bp, Artificial Sequence
  Description of Artificial Sequence: Synthetic oligonucleotide
  Target: DMPK; (-) strand; PAM type: YTN; PAM sequence: CTG
gcatcttgtaagttcggagc

SEQ ID NO: 17698 - DNA, 20 bp, Artificial Sequence
  Description of Artificial Sequence: Synthetic oligonucleotide
  Target: DMPK; (-) strand; PAM type: YTN; PAM sequence: TTG
ggaaggtcatagtaggcgaa

SEQ ID NO: 17699 - DNA, 20 bp, Artificial Sequence
  Description of Artificial Sequence: Synthetic oligonucleotide
  Target: DMPK; (-) strand; PAM type: YTN; PAM sequence: CTG
tggcgttgggaaggtcatag

SEQ ID NO: 17700 - DNA, 20 bp, Artificial Sequence
  Description of Artificial Sequence: Synthetic oligonucleotide
  Target: DMPK; (-) strand; PAM type: YTN; PAM sequence: CTG
ggtgggctgtggcgttggga

SEQ ID NO: 17701 - DNA, 20 bp, Artificial Sequence
  Description of Artificial Sequence: Synthetic oligonucleotide
  Target: DMPK; (-) strand; PAM type: YTN; PAM sequence: CTC
ctgggtgggctgtggcgttg

SEQ ID NO: 17702 - DNA, 20 bp, Artificial Sequence
  Description of Artificial Sequence: Synthetic oligonucleotide
  Target: DMPK; (-) strand; PAM type: YTN; PAM sequence: TTG
cctcctgggtgggctgtggc

SEQ ID NO: 17703 - DNA, 20 bp, Artificial Sequence
  Description of Artificial Sequence: Synthetic oligonucleotide
  Target: DMPK; (-) strand; PAM type: YTN; PAM sequence: CTT
gcctcctgggtgggctgtgg

SEQ ID NO: 17704 - DNA, 20 bp, Artificial Sequence
  Description of Artificial Sequence: Synthetic oligonucleotide
  Target: DMPK; (-) strand; PAM type: YTN; PAM sequence: CTG
taggatgggcagtgggtgga

SEQ ID NO: 17705 - DNA, 20 bp, Artificial Sequence
  Description of Artificial Sequence: Synthetic oligonucleotide
  Target: DMPK; (-) strand; PAM type: YTN; PAM sequence: TTA
gaacagagcctgtaggatgg

SEQ ID NO: 17706 - DNA, 20 bp, Artificial Sequence
  Description of Artificial Sequence: Synthetic oligonucleotide
  Target: DMPK; (-) strand; PAM type: YTN; PAM sequence: CTT
agaacagagcctgtaggatg

SEQ ID NO: 17707 - DNA, 20 bp, Artificial Sequence
  Description of Artificial Sequence: Synthetic oligonucleotide
  Target: DMPK; (-) strand; PAM type: YTN; PAM sequence: CTC
ttagaacagagcctgtagga

SEQ ID NO: 17708 - DNA, 20 bp, Artificial Sequence
  Description of Artificial Sequence: Synthetic oligonucleotide
  Target: DMPK; (-) strand; PAM type: YTN; PAM sequence: CTC
atcacctcttagaacagagc

SEQ ID NO: 17709 - DNA, 20 bp, Artificial Sequence
  Description of Artificial Sequence: Synthetic oligonucleotide
  Target: DMPK; (-) strand; PAM type: YTN; PAM sequence: CTC
caactcatcacctcttagaa

SEQ ID NO: 17710 - DNA, 20 bp, Artificial Sequence
  Description of Artificial Sequence: Synthetic oligonucleotide
  Target: DMPK; (-) strand; PAM type: YTN; PAM sequence: CTG
acctccaactcatcacctct

SEQ ID NO: 17711 - DNA, 20 bp, Artificial Sequence
  Description of Artificial Sequence: Synthetic oligonucleotide
  Target: DMPK; (-) strand; PAM type: YTN; PAM sequence: CTC
tgacctccaactcatcacct

SEQ ID NO: 17712 - DNA, 20 bp, Artificial Sequence
  Description of Artificial Sequence: Synthetic oligonucleotide
  Target: DMPK; (-) strand; PAM type: YTN; PAM sequence: CTG
ccccctctgacctccaactc

SEQ ID NO: 17713 - DNA, 20 bp, Artificial Sequence
  Description of Artificial Sequence: Synthetic oligonucleotide
  Target: DMPK; (-) strand; PAM type: YTN; PAM sequence: CTG
gacaagtcactgccccctct

SEQ ID NO: 17714 - DNA, 20 bp, Artificial Sequence
  Description of Artificial Sequence: Synthetic oligonucleotide
  Target: DMPK; (-) strand; PAM type: YTN; PAM sequence: CTG
tgaccctggacaagtcactg

SEQ ID NO: 17715 - DNA, 20 bp, Artificial Sequence
  Description of Artificial Sequence: Synthetic oligonucleotide
  Target: DMPK; (-) strand; PAM type: YTN; PAM sequence: CTC
tgtgaccctggacaagtcac

SEQ ID NO: 17716 - DNA, 20 bp, Artificial Sequence
  Description of Artificial Sequence: Synthetic oligonucleotide
  Target: DMPK; (-) strand; PAM type: YTN; PAM sequence: CTC
cctctgtgaccctggacaag

SEQ ID NO: 17717 - DNA, 20 bp, Artificial Sequence
  Description of Artificial Sequence: Synthetic oligonucleotide
  Target: DMPK; (-) strand; PAM type: YTN; PAM sequence: TTC
cagtcccactccctctgtga

SEQ ID NO: 17718 - DNA, 20 bp, Artificial Sequence
  Description of Artificial Sequence: Synthetic oligonucleotide
  Target: DMPK; (-) strand; PAM type: YTN; PAM sequence: CTG
ggttccagtcccactccctc

SEQ ID NO: 17719 - DNA, 20 bp, Artificial Sequence
  Description of Artificial Sequence: Synthetic oligonucleotide
  Target: DMPK; (-) strand; PAM type: YTN; PAM sequence: CTG
ggaatcccaggcctgggttc

SEQ ID NO: 17720 - DNA, 20 bp, Artificial Sequence
  Description of Artificial Sequence: Synthetic oligonucleotide
  Target: DMPK; (-) strand; PAM type: YTN; PAM sequence: CTG
aaggcacaggctgggaatcc

SEQ ID NO: 17721 - DNA, 20 bp, Artificial Sequence
  Description of Artificial Sequence: Synthetic oligonucleotide
  Target: DMPK; (-) strand; PAM type: YTN; PAM sequence: CTG
ctgaaggcacaggctgggaa

SEQ ID NO: 17722 - DNA, 20 bp, Artificial Sequence
  Description of Artificial Sequence: Synthetic oligonucleotide
  Target: DMPK; (-) strand; PAM type: YTN; PAM sequence: CTC
ctgctgaaggcacaggctgg

SEQ ID NO: 17723 - DNA, 20 bp, Artificial Sequence
  Description of Artificial Sequence: Synthetic oligonucleotide
  Target: DMPK; (-) strand; PAM type: YTN; PAM sequence: CTG
agcctcctgctgaaggcaca

SEQ ID NO: 17724 - DNA, 20 bp, Artificial Sequence
  Description of Artificial Sequence: Synthetic oligonucleotide
  Target: DMPK; (-) strand; PAM type: YTN; PAM sequence: CTC
aggatctgagcctcctgctg

SEQ ID NO: 17725 - DNA, 20 bp, Artificial Sequence
  Description of Artificial Sequence: Synthetic oligonucleotide
  Target: DMPK; (-) strand; PAM type: YTN; PAM sequence: CTG
ggactcaggatctgagcctc

SEQ ID NO: 17726 - DNA, 20 bp, Artificial Sequence
  Description of Artificial Sequence: Synthetic oligonucleotide
  Target: DMPK; (-) strand; PAM type: YTN; PAM sequence: CTG
ggtctgggactcaggatctg

SEQ ID NO: 17727 - DNA, 20 bp, Artificial Sequence
  Description of Artificial Sequence: Synthetic oligonucleotide
  Target: DMPK; (-) strand; PAM type: YTN; PAM sequence: CTG
ccagcctgggtctgggactc

SEQ ID NO: 17728 - DNA, 20 bp, Artificial Sequence
  Description of Artificial Sequence: Synthetic oligonucleotide
  Target: DMPK; (-) strand; PAM type: YTN; PAM sequence: CTG
tgggcatggctgccagcctg

SEQ ID NO: 17729 - DNA, 20 bp, Artificial Sequence
  Description of Artificial Sequence: Synthetic oligonucleotide
  Target: DMPK; (-) strand; PAM type: YTN; PAM sequence: CTC
aagcctgtgggcatggctgc

SEQ ID NO: 17730 - DNA, 20 bp, Artificial Sequence
  Description of Artificial Sequence: Synthetic oligonucleotide
  Target: DMPK; (-) strand; PAM type: YTN; PAM sequence: CTA
ggggcgagctcaagcctgtg

SEQ ID NO: 17731 - DNA, 20 bp, Artificial Sequence
  Description of Artificial Sequence: Synthetic oligonucleotide
  Target: DMPK; (-) strand; PAM type: YTN; PAM sequence: TTC
aggccaaaactaggggcgag

SEQ ID NO: 17732 - DNA, 20 bp, Artificial Sequence
  Description of Artificial Sequence: Synthetic oligonucleotide
  Target: DMPK; (-) strand; PAM type: YTN; PAM sequence: CTT
caggccaaaactaggggcga

SEQ ID NO: 17733 - DNA, 20 bp, Artificial Sequence
  Description of Artificial Sequence: Synthetic oligonucleotide
  Target: DMPK; (-) strand; PAM type: YTN; PAM sequence: TTG
agtacttcaggccaaaacta

SEQ ID NO: 17734 - DNA, 20 bp, Artificial Sequence
  Description of Artificial Sequence: Synthetic oligonucleotide
  Target: DMPK; (-) strand; PAM type: YTN; PAM sequence: TTT
gagtacttcaggccaaaact

SEQ ID NO: 17735 - DNA, 20 bp, Artificial Sequence
  Description of Artificial Sequence: Synthetic oligonucleotide
  Target: DMPK; (-) strand; PAM type: YTN; PAM sequence: TTT
tgagtacttcaggccaaaac

SEQ ID NO: 17736 - DNA, 20 bp, Artificial Sequence
  Description of Artificial Sequence: Synthetic oligonucleotide
  Target: DMPK; (-) strand; PAM type: YTN; PAM sequence: TTT
ttgagtacttcaggccaaaa

SEQ ID NO: 17737 - DNA, 20 bp, Artificial Sequence
  Description of Artificial Sequence: Synthetic oligonucleotide
  Target: DMPK; (-) strand; PAM type: YTN; PAM sequence: TTT
tttgagtacttcaggccaaa

SEQ ID NO: 17738 - DNA, 20 bp, Artificial Sequence
  Description of Artificial Sequence: Synthetic oligonucleotide
  Target: DMPK; (-) strand; PAM type: YTN; PAM sequence: CTT
ttttgagtacttcaggccaa

SEQ ID NO: 17739 - DNA, 20 bp, Artificial Sequence
  Description of Artificial Sequence: Synthetic oligonucleotide
  Target: DMPK; (-) strand; PAM type: YTN; PAM sequence: TTA
aatcgtgaaacttttttgag

SEQ ID NO: 17740 - DNA, 20 bp, Artificial Sequence
  Description of Artificial Sequence: Synthetic oligonucleotide
  Target: DMPK; (-) strand; PAM type: YTN; PAM sequence: TTT
aaatcgtgaaacttttttga

SEQ ID NO: 17741 - DNA, 20 bp, Artificial Sequence
  Description of Artificial Sequence: Synthetic oligonucleotide
  Target: DMPK; (-) strand; PAM type: YTN; PAM sequence: TTT
taaatcgtgaaacttttttg

SEQ ID NO: 17742 - DNA, 20 bp, Artificial Sequence
  Description of Artificial Sequence: Synthetic oligonucleotide
  Target: DMPK; (-) strand; PAM type: YTN; PAM sequence: TTT
ttaaatcgtgaaactttttt

SEQ ID NO: 17743 - DNA, 20 bp, Artificial Sequence
  Description of Artificial Sequence: Synthetic oligonucleotide
  Target: DMPK; (-) strand; PAM type: YTN; PAM sequence: TTT
tttaaatcgtgaaacttttt

SEQ ID NO: 17744 - DNA, 20 bp, Artificial Sequence
  Description of Artificial Sequence: Synthetic oligonucleotide
  Target: DMPK; (-) strand; PAM type: YTN; PAM sequence: CTG
ttttttaaatcgtgaaactt

SEQ ID NO: 17745 - DNA, 20 bp, Artificial Sequence
  Description of Artificial Sequence: Synthetic oligonucleotide
  Target: DMPK; (-) strand; PAM type: YTN; PAM sequence: TTG
aacatctgttttttaaatcg

SEQ ID NO: 17746 - DNA, 20 bp, Artificial Sequence
  Description of Artificial Sequence: Synthetic oligonucleotide
  Target: DMPK; (-) strand; PAM type: YTN; PAM sequence: CTG
ttgaacatctgttttttaaa

SEQ ID NO: 17747 - DNA, 20 bp, Artificial Sequence
  Description of Artificial Sequence: Synthetic oligonucleotide
  Target: DMPK; (-) strand; PAM type: YTN; PAM sequence: TTC
tgttgaacatctgtttttta

SEQ ID NO: 17748 - DNA, 20 bp, Artificial Sequence
  Description of Artificial Sequence: Synthetic oligonucleotide
  Target: DMPK; (-) strand; PAM type: YTN; PAM sequence: TTT
ctgttgaacatctgtttttt

SEQ ID NO: 17749 - DNA, 20 bp, Artificial Sequence
  Description of Artificial Sequence: Synthetic oligonucleotide
  Target: DMPK; (-) strand; PAM type: YTN; PAM sequence: CTA
tttctgttgaacatctgttt

SEQ ID NO: 17750 - DNA, 20 bp, Artificial Sequence
  Description of Artificial Sequence: Synthetic oligonucleotide
  Target: DMPK; (-) strand; PAM type: YTN; PAM sequence: CTC
gaaccagaatctatttctgt

SEQ ID NO: 17751 - DNA, 20 bp, Artificial Sequence
  Description of Artificial Sequence: Synthetic oligonucleotide
  Target: DMPK; (-) strand; PAM type: YTN; PAM sequence: CTG
tcactcgaaccagaatctat

SEQ ID NO: 17752 - DNA, 20 bp, Artificial Sequence
  Description of Artificial Sequence: Synthetic oligonucleotide
  Target: DMPK; (-) strand; PAM type: YTN; PAM sequence: CTG
cctgtcactcgaaccagaat

SEQ ID NO: 17753 - DNA, 20 bp, Artificial Sequence
  Description of Artificial Sequence: Synthetic oligonucleotide
  Target: DMPK; (-) strand; PAM type: YTN; PAM sequence: TTA
ctgcctgtcactcgaaccag

SEQ ID NO: 17754 - DNA, 20 bp, Artificial Sequence
  Description of Artificial Sequence: Synthetic oligonucleotide
  Target: DMPK; (-) strand; PAM type: YTN; PAM sequence: CTT
actgcctgtcactcgaacca

SEQ ID NO: 17755 - DNA, 20 bp, Artificial Sequence
  Description of Artificial Sequence: Synthetic oligonucleotide
  Target: DMPK; (-) strand; PAM type: YTN; PAM sequence: CTG
aagggcagcagatgggcccc

SEQ ID NO: 17756 - DNA, 20 bp, Artificial Sequence
  Description of Artificial Sequence: Synthetic oligonucleotide
  Target: DMPK; (-) strand; PAM type: YTN; PAM sequence: CTG
gccgtctgaagggcagcaga

SEQ ID NO: 17757 - DNA, 20 bp, Artificial Sequence
  Description of Artificial Sequence: Synthetic oligonucleotide
  Target: DMPK; (-) strand; PAM type: YTN; PAM sequence: TTG
gggcatccaaggctggccgt

SEQ ID NO: 17758 - DNA, 20 bp, Artificial Sequence
  Description of Artificial Sequence: Synthetic oligonucleotide
  Target: DMPK; (-) strand; PAM type: YTN; PAM sequence: CTA
ggaattggggcatccaaggc

SEQ ID NO: 17759 - DNA, 20 bp, Artificial Sequence
  Description of Artificial Sequence: Synthetic oligonucleotide
  Target: DMPK; (-) strand; PAM type: YTN; PAM sequence: CTA
ggcagcaggcagcagaaaga

SEQ ID NO: 17760 - DNA, 20 bp, Artificial Sequence
  Description of Artificial Sequence: Synthetic oligonucleotide
  Target: DMPK; (-) strand; PAM type: YTN; PAM sequence: CTA
gccctaggcagcaggcagca

SEQ ID NO: 17761 - DNA, 20 bp, Artificial Sequence
  Description of Artificial Sequence: Synthetic oligonucleotide
  Target: DMPK; (-) strand; PAM type: YTN; PAM sequence: TTA
gagtgagggggtctagccct

SEQ ID NO: 17762 - DNA, 20 bp, Artificial Sequence
  Description of Artificial Sequence: Synthetic oligonucleotide
  Target: DMPK; (-) strand; PAM type: YTN; PAM sequence: CTT
agagtgagggggtctagccc

SEQ ID NO: 17763 - DNA, 20 bp, Artificial Sequence
  Description of Artificial Sequence: Synthetic oligonucleotide
  Target: DMPK; (-) strand; PAM type: YTN; PAM sequence: CTC
agatccttagagtgaggggg

SEQ ID NO: 17764 - DNA, 20 bp, Artificial Sequence
  Description of Artificial Sequence: Synthetic oligonucleotide
  Target: DMPK; (-) strand; PAM type: YTN; PAM sequence: CTC
tcagatccttagagtgaggg

SEQ ID NO: 17765 - DNA, 20 bp, Artificial Sequence
  Description of Artificial Sequence: Synthetic oligonucleotide
  Target: DMPK; (-) strand; PAM type: YTN; PAM sequence: CTC
agtacaagacctctcagatc

SEQ ID NO: 17766 - DNA, 20 bp, Artificial Sequence
  Description of Artificial Sequence: Synthetic oligonucleotide
  Target: DMPK; (-) strand; PAM type: YTN; PAM sequence: TTA
gtgtctcagtacaagacctc

SEQ ID NO: 17767 - DNA, 20 bp, Artificial Sequence
  Description of Artificial Sequence: Synthetic oligonucleotide
  Target: DMPK; (-) strand; PAM type: YTN; PAM sequence: CTT
agtgtctcagtacaagacct

SEQ ID NO: 17768 - DNA, 20 bp, Artificial Sequence
  Description of Artificial Sequence: Synthetic oligonucleotide
  Target: DMPK; (-) strand; PAM type: YTN; PAM sequence: CTC
cgtggggtgaggggaagcca

SEQ ID NO: 17769 - DNA, 20 bp, Artificial Sequence
  Description of Artificial Sequence: Synthetic oligonucleotide
  Target: DMPK; (-) strand; PAM type: YTN; PAM sequence: CTG
gctccgtggggtgaggggaa

SEQ ID NO: 17770 - DNA, 20 bp, Artificial Sequence
  Description of Artificial Sequence: Synthetic oligonucleotide
  Target: DMPK; (-) strand; PAM type: YTN; PAM sequence: CTC
tggctccgtggggtgagggg

SEQ ID NO: 17771 - DNA, 20 bp, Artificial Sequence
  Description of Artificial Sequence: Synthetic oligonucleotide
  Target: DMPK; (-) strand; PAM type: YTN; PAM sequence: CTG
tcacagcctctggctccgtg

SEQ ID NO: 17772 - DNA, 20 bp, Artificial Sequence
  Description of Artificial Sequence: Synthetic oligonucleotide
  Target: DMPK; (-) strand; PAM type: YTN; PAM sequence: TTG
ctgtcacagcctctggctcc

SEQ ID NO: 17773 - DNA, 20 bp, Artificial Sequence
  Description of Artificial Sequence: Synthetic oligonucleotide
  Target: DMPK; (-) strand; PAM type: YTN; PAM sequence: TTG
ttgctgtcacagcctctggc

SEQ ID NO: 17774 - DNA, 20 bp, Artificial Sequence
  Description of Artificial Sequence: Synthetic oligonucleotide
  Target: DMPK; (-) strand; PAM type: YTN; PAM sequence: TTT
gttgctgtcacagcctctgg

SEQ ID NO: 17775 - DNA, 20 bp, Artificial Sequence
  Description of Artificial Sequence: Synthetic oligonucleotide
  Target: DMPK; (-) strand; PAM type: YTN; PAM sequence: CTT
tgttgctgtcacagcctctg

SEQ ID NO: 17776 - DNA, 20 bp, Artificial Sequence
  Description of Artificial Sequence: Synthetic oligonucleotide
  Target: DMPK; (-) strand; PAM type: YTN; PAM sequence: TTG
gcagagagagggctttgttg

SEQ ID NO: 17777 - DNA, 20 bp, Artificial Sequence
  Description of Artificial Sequence: Synthetic oligonucleotide
  Target: DMPK; (-) strand; PAM type: YTN; PAM sequence: TTC
gtgggaagaggcaggcattg

SEQ ID NO: 17778 - DNA, 20 bp, Artificial Sequence
  Description of Artificial Sequence: Synthetic oligonucleotide
  Target: DMPK; (-) strand; PAM type: YTN; PAM sequence: TTT
cgtgggaagaggcaggcatt

SEQ ID NO: 17779 - DNA, 20 bp, Artificial Sequence
  Description of Artificial Sequence: Synthetic oligonucleotide
  Target: DMPK; (-) strand; PAM type: YTN; PAM sequence: CTT
tcgtgggaagaggcaggcat

SEQ ID NO: 17780 - DNA, 20 bp, Artificial Sequence
  Description of Artificial Sequence: Synthetic oligonucleotide
  Target: DMPK; (-) strand; PAM type: YTN; PAM sequence: CTG
gcaggacctttcgtgggaag

SEQ ID NO: 17781 - DNA, 20 bp, Artificial Sequence
  Description of Artificial Sequence: Synthetic oligonucleotide
  Target: DMPK; (-) strand; PAM type: YTN; PAM sequence: CTG
ccggggacctggcaggacct

SEQ ID NO: 17782 - DNA, 20 bp, Artificial Sequence
  Description of Artificial Sequence: Synthetic oligonucleotide
  Target: DMPK; (-) strand; PAM type: YTN; PAM sequence: CTG
ggcccggccgggcaaggcgg

SEQ ID NO: 17783 - DNA, 20 bp, Artificial Sequence
  Description of Artificial Sequence: Synthetic oligonucleotide
  Target: DMPK; (-) strand; PAM type: YTN; PAM sequence: CTG
cacctgggcccggccgggca

SEQ ID NO: 17784 - DNA, 20 bp, Artificial Sequence
  Description of Artificial Sequence: Synthetic oligonucleotide
  Target: DMPK; (-) strand; PAM type: YTN; PAM sequence: CTC
atctgcacctgggcccggcc

SEQ ID NO: 17785 - DNA, 20 bp, Artificial Sequence
  Description of Artificial Sequence: Synthetic oligonucleotide
  Target: DMPK; (-) strand; PAM type: YTN; PAM sequence: CTG
ccaggagggcctcatctgca

SEQ ID NO: 17786 - DNA, 20 bp, Artificial Sequence
  Description of Artificial Sequence: Synthetic oligonucleotide
  Target: DMPK; (-) strand; PAM type: YTN; PAM sequence: CTG
cctgccaggagggcctcatc

SEQ ID NO: 17787 - DNA, 20 bp, Artificial Sequence
  Description of Artificial Sequence: Synthetic oligonucleotide
  Target: DMPK; (-) strand; PAM type: YTN; PAM sequence: CTG
catcatcactgcctgccagg

SEQ ID NO: 17788 - DNA, 20 bp, Artificial Sequence
  Description of Artificial Sequence: Synthetic oligonucleotide
  Target: DMPK; (-) strand; PAM type: YTN; PAM sequence: CTG
gaggactgcatcatcactgc

SEQ ID NO: 17789 - DNA, 20 bp, Artificial Sequence
  Description of Artificial Sequence: Synthetic oligonucleotide
  Target: DMPK; (-) strand; PAM type: YTN; PAM sequence: TTC
ctggaggactgcatcatcac

SEQ ID NO: 17790 - DNA, 20 bp, Artificial Sequence
  Description of Artificial Sequence: Synthetic oligonucleotide
  Target: DMPK; (-) strand; PAM type: YTN; PAM sequence: CTG
ttcctggaggactgcatcat

SEQ ID NO: 17791 - DNA, 20 bp, Artificial Sequence
  Description of Artificial Sequence: Synthetic oligonucleotide
  Target: DMPK; (-) strand; PAM type: YTN; PAM sequence: CTC
ctgttcctggaggactgcat

SEQ ID NO: 17792 - DNA, 20 bp, Artificial Sequence
  Description of Artificial Sequence: Synthetic oligonucleotide
  Target: DMPK; (-) strand; PAM type: YTN; PAM sequence: CTC
acagtcctcctgttcctgga

SEQ ID NO: 17793 - DNA, 20 bp, Artificial Sequence
  Description of Artificial Sequence: Synthetic oligonucleotide
  Target: DMPK; (-) strand; PAM type: YTN; PAM sequence: TTG
tgtgcaagaagatcgcccag

SEQ ID NO: 17794 - DNA, 20 bp, Artificial Sequence
  Description of Artificial Sequence: Synthetic oligonucleotide
  Target: DMPK; (-) strand; PAM type: YTN; PAM sequence: CTT
gtgtgcaagaagatcgccca

SEQ ID NO: 17795 - DNA, 20 bp, Artificial Sequence
  Description of Artificial Sequence: Synthetic oligonucleotide
  Target: DMPK; (-) strand; PAM type: YTN; PAM sequence: CTG
gagccccttgtgtgcaagaa

SEQ ID NO: 17796 - DNA, 20 bp, Artificial Sequence
  Description of Artificial Sequence: Synthetic oligonucleotide
  Target: DMPK; (-) strand; PAM type: YTN; PAM sequence: CTG
ctggagccccttgtgtgcaa

SEQ ID NO: 17797 - DNA, 20 bp, Artificial Sequence
  Description of Artificial Sequence: Synthetic oligonucleotide
  Target: DMPK; (-) strand; PAM type: YTN; PAM sequence: CTG
tgcccgcgcatccacgaggt

SEQ ID NO: 17798 - DNA, 20 bp, Artificial Sequence
  Description of Artificial Sequence: Synthetic oligonucleotide
  Target: DMPK; (-) strand; PAM type: YTN; PAM sequence: CTG
cgctgtgcccgcgcatccac

SEQ ID NO: 17799 - DNA, 20 bp, Artificial Sequence
  Description of Artificial Sequence: Synthetic oligonucleotide
  Target: DMPK; (-) strand; PAM type: YTN; PAM sequence: CTG
ggcactgcgctgtgcccgcg

SEQ ID NO: 17800 - DNA, 20 bp, Artificial Sequence
  Description of Artificial Sequence: Synthetic oligonucleotide
  Target: DMPK; (-) strand; PAM type: YTN; PAM sequence: CTG
gaccccgccaaggtgctggg

SEQ ID NO: 17801 - DNA, 20 bp, Artificial Sequence
  Description of Artificial Sequence: Synthetic oligonucleotide
  Target: DMPK; (-) strand; PAM type: YTN; PAM sequence: TTC
cccgcagccgcctggacccc

SEQ ID NO: 17802 - DNA, 20 bp, Artificial Sequence
  Description of Artificial Sequence: Synthetic oligonucleotide
  Target: DMPK; (-) strand; PAM type: YTN; PAM sequence: CTG
ttccccgcagccgcctggac

SEQ ID NO: 17803 - DNA, 20 bp, Artificial Sequence
  Description of Artificial Sequence: Synthetic oligonucleotide
  Target: DMPK; (-) strand; PAM type: YTN; PAM sequence: CTG
ggcaacatcagccggggtgg

SEQ ID NO: 17804 - DNA, 20 bp, Artificial Sequence
  Description of Artificial Sequence: Synthetic oligonucleotide
  Target: DMPK; (-) strand; PAM type: YTN; PAM sequence: CTA
ccacagcctgggcaacatca

SEQ ID NO: 17805 - DNA, 20 bp, Artificial Sequence
  Description of Artificial Sequence: Synthetic oligonucleotide
  Target: DMPK; (-) strand; PAM type: YTN; PAM sequence: CTG
caggagcggcgggaccgggg

SEQ ID NO: 17806 - DNA, 20 bp, Artificial Sequence
  Description of Artificial Sequence: Synthetic oligonucleotide
  Target: DMPK; (-) strand; PAM type: YTN; PAM sequence: CTC
acactgcaggagcggcggga

SEQ ID NO: 17807 - DNA, 20 bp, Artificial Sequence
  Description of Artificial Sequence: Synthetic oligonucleotide
  Target: DMPK; (-) strand; PAM type: YTN; PAM sequence: TTC
gccacgctcacactgcagga

SEQ ID NO: 17808 - DNA, 20 bp, Artificial Sequence
  Description of Artificial Sequence: Synthetic oligonucleotide
  Target: DMPK; (-) strand; PAM type: YTN; PAM sequence: CTT
cgccacgctcacactgcagg

SEQ ID NO: 17809 - DNA, 20 bp, Artificial Sequence
  Description of Artificial Sequence: Synthetic oligonucleotide
  Target: DMPK; (-) strand; PAM type: YTN; PAM sequence: TTG
gccgcttcgccacgctcaca

SEQ ID NO: 17810 - DNA, 20 bp, Artificial Sequence
  Description of Artificial Sequence: Synthetic oligonucleotide
  Target: DMPK; (-) strand; PAM type: YTN; PAM sequence: TTC
agcattggccgcttcgccac

SEQ ID NO: 17811 - DNA, 20 bp, Artificial Sequence
  Description of Artificial Sequence: Synthetic oligonucleotide
  Target: DMPK; (-) strand; PAM type: YTN; PAM sequence: CTG
gcacaccattcagcattggc

SEQ ID NO: 17812 - DNA, 20 bp, Artificial Sequence
  Description of Artificial Sequence: Synthetic oligonucleotide
  Target: DMPK; (-) strand; PAM type: YTN; PAM sequence: CTG
gcgggggcaaggcgggcggc

SEQ ID NO: 17813 - DNA, 20 bp, Artificial Sequence
  Description of Artificial Sequence: Synthetic oligonucleotide
  Target: DMPK; (-) strand; PAM type: YTN; PAM sequence: CTC
ccgcacccagctggcggggg

SEQ ID NO: 17814 - DNA, 20 bp, Artificial Sequence
  Description of Artificial Sequence: Synthetic oligonucleotide
  Target: DMPK; (-) strand; PAM type: YTN; PAM sequence: CTC
caacagtctcccgcacccag

SEQ ID NO: 17815 - DNA, 20 bp, Artificial Sequence
  Description of Artificial Sequence: Synthetic oligonucleotide
  Target: DMPK; (-) strand; PAM type: YTN; PAM sequence: CTG
tcccgctccaacagtctccc

SEQ ID NO: 17816 - DNA, 20 bp, Artificial Sequence
  Description of Artificial Sequence: Synthetic oligonucleotide
  Target: DMPK; (-) strand; PAM type: YTN; PAM sequence: CTC
gctgtcccgctccaacagtc

SEQ ID NO: 17817 - DNA, 20 bp, Artificial Sequence
  Description of Artificial Sequence: Synthetic oligonucleotide
  Target: DMPK; (-) strand; PAM type: YTN; PAM sequence: CTC
gctcgctgtcccgctccaac

SEQ ID NO: 17818 - DNA, 20 bp, Artificial Sequence
  Description of Artificial Sequence: Synthetic oligonucleotide
  Target: DMPK; (-) strand; PAM type: YTN; PAM sequence: CTG
cctcgctcgctgtcccgctc

SEQ ID NO: 17819 - DNA, 20 bp, Artificial Sequence
  Description of Artificial Sequence: Synthetic oligonucleotide
  Target: DMPK; (-) strand; PAM type: YTN; PAM sequence: CTG
gcccaggccccctgcctcgc

SEQ ID NO: 17820 - DNA, 20 bp, Artificial Sequence
  Description of Artificial Sequence: Synthetic oligonucleotide
  Target: DMPK; (-) strand; PAM type: YTN; PAM sequence: CTC
gaggggtggcgagcctggcc

SEQ ID NO: 17821 - DNA, 20 bp, Artificial Sequence
  Description of Artificial Sequence: Synthetic oligonucleotide
  Target: DMPK; (-) strand; PAM type: YTN; PAM sequence: CTG
gcaccacgccaccggccgcc

SEQ ID NO: 17822 - DNA, 20 bp, Artificial Sequence
  Description of Artificial Sequence: Synthetic oligonucleotide
  Target: DMPK; (-) strand; PAM type: YTN; PAM sequence: CTG
gcacacctggcaccacgcca

SEQ ID NO: 17823 - DNA, 20 bp, Artificial Sequence
  Description of Artificial Sequence: Synthetic oligonucleotide
  Target: DMPK; (-) strand; PAM type: YTN; PAM sequence: CTC
cctggcacacctggcaccac

SEQ ID NO: 17824 - DNA, 20 bp, Artificial Sequence
  Description of Artificial Sequence: Synthetic oligonucleotide
  Target: DMPK; (-) strand; PAM type: YTN; PAM sequence: CTG
gcccgcacccgcaccctccc

SEQ ID NO: 17825 - DNA, 20 bp, Artificial Sequence
  Description of Artificial Sequence: Synthetic oligonucleotide
  Target: DMPK; (-) strand; PAM type: YTN; PAM sequence: CTA
cccgcacccccccctggccc

SEQ ID NO: 17826 - DNA, 20 bp, Artificial Sequence
  Description of Artificial Sequence: Synthetic oligonucleotide
  Target: DMPK; (-) strand; PAM type: YTN; PAM sequence: CTC
tacccgcacccccccctggc

SEQ ID NO: 17827 - DNA, 20 bp, Artificial Sequence
  Description of Artificial Sequence: Synthetic oligonucleotide
  Target: DMPK; (-) strand; PAM type: YTN; PAM sequence: CTG
aagacgtgctctacccgcac

SEQ ID NO: 17828 - DNA, 20 bp, Artificial Sequence
  Description of Artificial Sequence: Synthetic oligonucleotide
  Target: DMPK; (-) strand; PAM type: YTN; PAM sequence: CTC
actgaagacgtgctctaccc

SEQ ID NO: 17829 - DNA, 20 bp, Artificial Sequence
  Description of Artificial Sequence: Synthetic oligonucleotide
  Target: DMPK; (-) strand; PAM type: YTN; PAM sequence: CTG
tgggacctcactgaagacgt

SEQ ID NO: 17830 - DNA, 20 bp, Artificial Sequence
  Description of Artificial Sequence: Synthetic oligonucleotide
  Target: DMPK; (-) strand; PAM type: YTN; PAM sequence: CTG
cctgtgggacctcactgaag

SEQ ID NO: 17831 - DNA, 20 bp, Artificial Sequence
  Description of Artificial Sequence: Synthetic oligonucleotide
  Target: DMPK; (-) strand; PAM type: YTN; PAM sequence: TTC
tgcctgtgggacctcactga

SEQ ID NO: 17832 - DNA, 20 bp, Artificial Sequence
  Description of Artificial Sequence: Synthetic oligonucleotide
  Target: DMPK; (-) strand; PAM type: YTN; PAM sequence: CTC
ggcgggccaggacacgcagt

SEQ ID NO: 17833 - DNA, 20 bp, Artificial Sequence
  Description of Artificial Sequence: Synthetic oligonucleotide
  Target: DMPK; (-) strand; PAM type: YTN; PAM sequence: TTG
gctcggcgggccaggacacg

SEQ ID NO: 17834 - DNA, 20 bp, Artificial Sequence
  Description of Artificial Sequence: Synthetic oligonucleotide
  Target: DMPK; (-) strand; PAM type: YTN; PAM sequence: TTT
ggctcggcgggccaggacac

SEQ ID NO: 17835 - DNA, 20 bp, Artificial Sequence
  Description of Artificial Sequence: Synthetic oligonucleotide
  Target: DMPK; (-) strand; PAM type: YTN; PAM sequence: CTT
tggctcggcgggccaggaca

SEQ ID NO: 17836 - DNA, 20 bp, Artificial Sequence
  Description of Artificial Sequence: Synthetic oligonucleotide
  Target: DMPK; (-) strand; PAM type: YTN; PAM sequence: TTA
ccgctttggctcggcgggcc

SEQ ID NO: 17837 - DNA, 20 bp, Artificial Sequence
  Description of Artificial Sequence: Synthetic oligonucleotide
  Target: DMPK; (-) strand; PAM type: YTN; PAM sequence: CTT
accgctttggctcggcgggc

SEQ ID NO: 17838 - DNA, 20 bp, Artificial Sequence
  Description of Artificial Sequence: Synthetic oligonucleotide
  Target: DMPK; (-) strand; PAM type: YTN; PAM sequence: TTA
cttaccgctttggctcggcg

SEQ ID NO: 17839 - DNA, 20 bp, Artificial Sequence
  Description of Artificial Sequence: Synthetic oligonucleotide
  Target: DMPK; (-) strand; PAM type: YTN; PAM sequence: CTC
cattacttaccgctttggct

SEQ ID NO: 17840 - DNA, 20 bp, Artificial Sequence
  Description of Artificial Sequence: Synthetic oligonucleotide
  Target: DMPK; (-) strand; PAM type: YTN; PAM sequence: CTG
gctccattacttaccgcttt

SEQ ID NO: 17841 - DNA, 20 bp, Artificial Sequence
  Description of Artificial Sequence: Synthetic oligonucleotide
  Target: DMPK; (-) strand; PAM type: YTN; PAM sequence: CTG
cccaaggctggctccattac

SEQ ID NO: 17842 - DNA, 20 bp, Artificial Sequence
  Description of Artificial Sequence: Synthetic oligonucleotide
  Target: DMPK; (-) strand; PAM type: YTN; PAM sequence: CTC
cactgcccaaggctggctcc

SEQ ID NO: 17843 - DNA, 20 bp, Artificial Sequence
  Description of Artificial Sequence: Synthetic oligonucleotide
  Target: DMPK; (-) strand; PAM type: YTN; PAM sequence: CTC
tccactgcccaaggctggct

SEQ ID NO: 17844 - DNA, 20 bp, Artificial Sequence
  Description of Artificial Sequence: Synthetic oligonucleotide
  Target: DMPK; (-) strand; PAM type: YTN; PAM sequence: CTC
tctccactgcccaaggctgg

SEQ ID NO: 17845 - DNA, 20 bp, Artificial Sequence
  Description of Artificial Sequence: Synthetic oligonucleotide
  Target: DMPK; (-) strand; PAM type: YTN; PAM sequence: CTC
ggccgggggcgccccgctct

SEQ ID NO: 17846 - DNA, 20 bp, Artificial Sequence
  Description of Artificial Sequence: Synthetic oligonucleotide
  Target: DMPK; (-) strand; PAM type: YTN; PAM sequence: CTG
cgggcacaggctcggccggg

SEQ ID NO: 17847 - DNA, 20 bp, Artificial Sequence
  Description of Artificial Sequence: Synthetic oligonucleotide
  Target: DMPK; (-) strand; PAM type: YTN; PAM sequence: CTG
atggggagcggagcggcgaa

SEQ ID NO: 17848 - DNA, 20 bp, Artificial Sequence
  Description of Artificial Sequence: Synthetic oligonucleotide
  Target: DMPK; (-) strand; PAM type: YTN; PAM sequence: CTA
caccacaagggcagaggagg

SEQ ID NO: 17849 - DNA, 20 bp, Artificial Sequence
  Description of Artificial Sequence: Synthetic oligonucleotide
  Target: DMPK; (-) strand; PAM type: YTN; PAM sequence: TTG
acccctacaccacaagggca

SEQ ID NO: 17850 - DNA, 20 bp, Artificial Sequence
  Description of Artificial Sequence: Synthetic oligonucleotide
  Target: DMPK; (-) strand; PAM type: YTN; PAM sequence: TTT
gacccctacaccacaagggc

SEQ ID NO: 17851 - DNA, 20 bp, Artificial Sequence
  Description of Artificial Sequence: Synthetic oligonucleotide
  Target: DMPK; (-) strand; PAM type: YTN; PAM sequence: CTT
tgacccctacaccacaaggg

SEQ ID NO: 17852 - DNA, 20 bp, Artificial Sequence
  Description of Artificial Sequence: Synthetic oligonucleotide
  Target: DMPK; (-) strand; PAM type: YTN; PAM sequence: CTG
tggcctttgacccctacacc

SEQ ID NO: 17853 - DNA, 20 bp, Artificial Sequence
  Description of Artificial Sequence: Synthetic oligonucleotide
  Target: DMPK; (-) strand; PAM type: YTN; PAM sequence: CTG
ggtcaacgctgtggcctttg

SEQ ID NO: 17854 - DNA, 20 bp, Artificial Sequence
  Description of Artificial Sequence: Synthetic oligonucleotide
  Target: DMPK; (-) strand; PAM type: YTN; PAM sequence: CTC
gaggccatggccacaagtcc

SEQ ID NO: 17855 - DNA, 20 bp, Artificial Sequence
  Description of Artificial Sequence: Synthetic oligonucleotide
  Target: DMPK; (-) strand; PAM type: YTN; PAM sequence: TTC
accgagggccgcgtggtggc

SEQ ID NO: 17856 - DNA, 20 bp, Artificial Sequence
  Description of Artificial Sequence: Synthetic oligonucleotide
  Target: DMPK; (-) strand; PAM type: YTN; PAM sequence: CTT
caccgagggccgcgtggtgg

SEQ ID NO: 17857 - DNA, 20 bp, Artificial Sequence
  Description of Artificial Sequence: Synthetic oligonucleotide
  Target: DMPK; (-) strand; PAM type: YTN; PAM sequence: CTG
gtcaccgtgtggtccttcac

SEQ ID NO: 17858 - DNA, 20 bp, Artificial Sequence
  Description of Artificial Sequence: Synthetic oligonucleotide
  Target: DMPK; (-) strand; PAM type: YTN; PAM sequence: CTA
cgtggtgacgggtggcgaag

SEQ ID NO: 17859 - DNA, 20 bp, Artificial Sequence
  Description of Artificial Sequence: Synthetic oligonucleotide
  Target: DMPK; (-) strand; PAM type: YTN; PAM sequence: CTG
acggccgctacgtggtgacg

SEQ ID NO: 17860 - DNA, 20 bp, Artificial Sequence
  Description of Artificial Sequence: Synthetic oligonucleotide
  Target: DMPK; (-) strand; PAM type: YTN; PAM sequence: CTG
gagccctgacggccgctacg

SEQ ID NO: 17861 - DNA, 20 bp, Artificial Sequence
  Description of Artificial Sequence: Synthetic oligonucleotide
  Target: DMPK; (-) strand; PAM type: YTN; PAM sequence: CTG
tgtgtgtgctggagccctga

SEQ ID NO: 17862 - DNA, 20 bp, Artificial Sequence
  Description of Artificial Sequence: Synthetic oligonucleotide
  Target: DMPK; (-) strand; PAM type: YTN; PAM sequence: CTG
ctgtgtgtgtgctggagccc

SEQ ID NO: 17863 - DNA, 20 bp, Artificial Sequence
  Description of Artificial Sequence: Synthetic oligonucleotide
  Target: DMPK; (-) strand; PAM type: YTN; PAM sequence: TTG
ggggcctgctgtgtgtgtgc

SEQ ID NO: 17864 - DNA, 20 bp, Artificial Sequence
  Description of Artificial Sequence: Synthetic oligonucleotide
  Target: DMPK; (-) strand; PAM type: YTN; PAM sequence: TTT
gggggcctgctgtgtgtgtg

SEQ ID NO: 17865 - DNA, 20 bp, Artificial Sequence
  Description of Artificial Sequence: Synthetic oligonucleotide
  Target: DMPK; (-) strand; PAM type: YTN; PAM sequence: CTT
tgggggcctgctgtgtgtgt

SEQ ID NO: 17866 - DNA, 20 bp, Artificial Sequence
  Description of Artificial Sequence: Synthetic oligonucleotide
  Target: DMPK; (-) strand; PAM type: YTN; PAM sequence: CTA
ctttgggggcctgctgtgtg

SEQ ID NO: 17867 - DNA, 20 bp, Artificial Sequence
  Description of Artificial Sequence: Synthetic oligonucleotide
  Target: DMPK; (-) strand; PAM type: YTN; PAM sequence: CTC
atgaagagctactttggggg

SEQ ID NO: 17868 - DNA, 20 bp, Artificial Sequence
  Description of Artificial Sequence: Synthetic oligonucleotide
  Target: DMPK; (-) strand; PAM type: YTN; PAM sequence: CTG
cgtgggctcatgaagagcta

SEQ ID NO: 17869 - DNA, 20 bp, Artificial Sequence
  Description of Artificial Sequence: Synthetic oligonucleotide
  Target: DMPK; (-) strand; PAM type: YTN; PAM sequence: CTC
ctgcgtgggctcatgaagag

SEQ ID NO: 17870 - DNA, 20 bp, Artificial Sequence
  Description of Artificial Sequence: Synthetic oligonucleotide
  Target: DMPK; (-) strand; PAM type: YTN; PAM sequence: CTC
catgctcctgcgtgggctca

SEQ ID NO: 17871 - DNA, 20 bp, Artificial Sequence
  Description of Artificial Sequence: Synthetic oligonucleotide
  Target: DMPK; (-) strand; PAM type: YTN; PAM sequence: TTC
gactccatgctcctgcgtgg

SEQ ID NO: 17872 - DNA, 20 bp, Artificial Sequence
  Description of Artificial Sequence: Synthetic oligonucleotide
  Target: DMPK; (-) strand; PAM type: YTN; PAM sequence: CTT
cgactccatgctcctgcgtg

SEQ ID NO: 17873 - DNA, 20 bp, Artificial Sequence
  Description of Artificial Sequence: Synthetic oligonucleotide
  Target: DMPK; (-) strand; PAM type: YTN; PAM sequence: TTC
cacttcgactccatgctcct

SEQ ID NO: 17874 - DNA, 20 bp, Artificial Sequence
  Description of Artificial Sequence: Synthetic oligonucleotide
  Target: DMPK; (-) strand; PAM type: YTN; PAM sequence: CTT
ccacttcgactccatgctcc

SEQ ID NO: 17875 - DNA, 20 bp, Artificial Sequence
  Description of Artificial Sequence: Synthetic oligonucleotide
  Target: DMPK; (-) strand; PAM type: YTN; PAM sequence: CTG
cgcgtcttccacttcgactc

SEQ ID NO: 17876 - DNA, 20 bp, Artificial Sequence
  Description of Artificial Sequence: Synthetic oligonucleotide
  Target: DMPK; (-) strand; PAM type: YTN; PAM sequence: CTG
cctgcgcgtcttccacttcg

SEQ ID NO: 17877 - DNA, 20 bp, Artificial Sequence
  Description of Artificial Sequence: Synthetic oligonucleotide
  Target: DMPK; (-) strand; PAM type: YTN; PAM sequence: CTG
tgtgagccaggatggctgcc

SEQ ID NO: 17878 - DNA, 20 bp, Artificial Sequence
  Description of Artificial Sequence: Synthetic oligonucleotide
  Target: DMPK; (-) strand; PAM type: YTN; PAM sequence: CTG
gcctgtgtgagccaggatgg

SEQ ID NO: 17879 - DNA, 20 bp, Artificial Sequence
  Description of Artificial Sequence: Synthetic oligonucleotide
  Target: DMPK; (-) strand; PAM type: YTN; PAM sequence: CTC
gcccgatggccggcacctgg

SEQ ID NO: 17880 - DNA, 20 bp, Artificial Sequence
  Description of Artificial Sequence: Synthetic oligonucleotide
  Target: DMPK; (-) strand; PAM type: YTN; PAM sequence: TTC
tcgcccgatggccggcacct

SEQ ID NO: 17881 - DNA, 20 bp, Artificial Sequence
  Description of Artificial Sequence: Synthetic oligonucleotide
  Target: DMPK; (-) strand; PAM type: YTN; PAM sequence: CTT
ctcgcccgatggccggcacc

SEQ ID NO: 17882 - DNA, 20 bp, Artificial Sequence
  Description of Artificial Sequence: Synthetic oligonucleotide
  Target: DMPK; (-) strand; PAM type: YTN; PAM sequence: TTC
gccttctcgcccgatggccg

SEQ ID NO: 17883 - DNA, 20 bp, Artificial Sequence
  Description of Artificial Sequence: Synthetic oligonucleotide
  Target: DMPK; (-) strand; PAM type: YTN; PAM sequence: CTC
aacgagttcgccttctcgcc

SEQ ID NO: 17884 - DNA, 20 bp, Artificial Sequence
  Description of Artificial Sequence: Synthetic oligonucleotide
  Target: DMPK; (-) strand; PAM type: YTN; PAM sequence: CTG
gccaagtgggcggtgggtga

SEQ ID NO: 17885 - DNA, 20 bp, Artificial Sequence
  Description of Artificial Sequence: Synthetic oligonucleotide
  Target: DMPK; (-) strand; PAM type: YTN; PAM sequence: CTG
ccaagagcaaggcaccccgc

SEQ ID NO: 17886 - DNA, 20 bp, Artificial Sequence
  Description of Artificial Sequence: Synthetic oligonucleotide
  Target: DMPK; (-) strand; PAM type: YTN; PAM sequence: CTA
tgctgccaagagcaaggcac

SEQ ID NO: 17887 - DNA, 20 bp, Artificial Sequence
  Description of Artificial Sequence: Synthetic oligonucleotide
  Target: DMPK; (-) strand; PAM type: YTN; PAM sequence: CTG
tctatgctgccaagagcaag

SEQ ID NO: 17888 - DNA, 20 bp, Artificial Sequence
  Description of Artificial Sequence: Synthetic oligonucleotide
  Target: DMPK; (-) strand; PAM type: YTN; PAM sequence: CTC
tgtctatgctgccaagagca

SEQ ID NO: 17889 - DNA, 20 bp, Artificial Sequence
  Description of Artificial Sequence: Synthetic oligonucleotide
  Target: DMPK; (-) strand; PAM type: YTN; PAM sequence: TTC
tctgtctatgctgccaagag

SEQ ID NO: 17890 - DNA, 20 bp, Artificial Sequence
  Description of Artificial Sequence: Synthetic oligonucleotide
  Target: DMPK; (-) strand; PAM type: YTN; PAM sequence: CTT
ctctgtctatgctgccaaga

SEQ ID NO: 17891 - DNA, 20 bp, Artificial Sequence
  Description of Artificial Sequence: Synthetic oligonucleotide
  Target: DMPK; (-) strand; PAM type: YTN; PAM sequence: CTG
aagcagggcgagggcttctc

SEQ ID NO: 17892 - DNA, 20 bp, Artificial Sequence
  Description of Artificial Sequence: Synthetic oligonucleotide
  Target: DMPK; (-) strand; PAM type: YTN; PAM sequence: CTG
ctgaagcagggcgagggctt

SEQ ID NO: 17893 - DNA, 20 bp, Artificial Sequence
  Description of Artificial Sequence: Synthetic oligonucleotide
  Target: DMPK; (-) strand; PAM type: YTN; PAM sequence: CTC
ggccccgccccagtacagcc

SEQ ID NO: 17894 - DNA, 20 bp, Artificial Sequence
  Description of Artificial Sequence: Synthetic oligonucleotide
  Target: DMPK; (-) strand; PAM type: YTN; PAM sequence: CTG
cgcctcggccccgccccagt

SEQ ID NO: 17895 - DNA, 20 bp, Artificial Sequence
  Description of Artificial Sequence: Synthetic oligonucleotide
  Target: DMPK; (-) strand; PAM type: YTN; PAM sequence: CTG
tacaacgtcagccacccctg

SEQ ID NO: 17896 - DNA, 20 bp, Artificial Sequence
  Description of Artificial Sequence: Synthetic oligonucleotide
  Target: DMPK; (-) strand; PAM type: YTN; PAM sequence: CTG
tacctgtacaacgtcagcca

SEQ ID NO: 17897 - DNA, 20 bp, Artificial Sequence
  Description of Artificial Sequence: Synthetic oligonucleotide
  Target: DMPK; (-) strand; PAM type: YTN; PAM sequence: CTG
gcatcacacgccagtggcca

SEQ ID NO: 17898 - DNA, 20 bp, Artificial Sequence
  Description of Artificial Sequence: Synthetic oligonucleotide
  Target: DMPK; (-) strand; PAM type: YTN; PAM sequence: TTC
ctggcatcacacgccagtgg

SEQ ID NO: 17899 - DNA, 20 bp, Artificial Sequence
  Description of Artificial Sequence: Synthetic oligonucleotide
  Target: DMPK; (-) strand; PAM type: YTN; PAM sequence: CTG
ttcctggcatcacacgccag

SEQ ID NO: 17900 - DNA, 20 bp, Artificial Sequence
  Description of Artificial Sequence: Synthetic oligonucleotide
  Target: DMPK; (-) strand; PAM type: YTN; PAM sequence: CTG
agtcggagagcctgttcctg

SEQ ID NO: 17901 - DNA, 20 bp, Artificial Sequence
  Description of Artificial Sequence: Synthetic oligonucleotide
  Target: DMPK; (-) strand; PAM type: YTN; PAM sequence: CTG
cctgagtcggagagcctgtt

SEQ ID NO: 17902 - DNA, 20 bp, Artificial Sequence
  Description of Artificial Sequence: Synthetic oligonucleotide
  Target: DMPK; (-) strand; PAM type: YTN; PAM sequence: CTG
aagtggctgcctgagtcgga

SEQ ID NO: 17903 - DNA, 20 bp, Artificial Sequence
  Description of Artificial Sequence: Synthetic oligonucleotide
  Target: DMPK; (-) strand; PAM type: YTN; PAM sequence: TTG
atcgacaagaccaaggtgac

SEQ ID NO: 17904 - DNA, 20 bp, Artificial Sequence
  Description of Artificial Sequence: Synthetic oligonucleotide
  Target: DMPK; (-) strand; PAM type: YTN; PAM sequence: CTG
gcagcggttgatcgacaaga

SEQ ID NO: 17905 - DNA, 20 bp, Artificial Sequence
  Description of Artificial Sequence: Synthetic oligonucleotide
  Target: DMPK; (-) strand; PAM type: YTN; PAM sequence: CTC
ccctggcagcggttgatcga

SEQ ID NO: 17906 - DNA, 20 bp, Artificial Sequence
  Description of Artificial Sequence: Synthetic oligonucleotide
  Target: DMPK; (-) strand; PAM type: YTN; PAM sequence: CTG
tctcccctggcagcggttga

SEQ ID NO: 17907 - DNA, 20 bp, Artificial Sequence
  Description of Artificial Sequence: Synthetic oligonucleotide
  Target: DMPK; (-) strand; PAM type: YTN; PAM sequence: CTC
ccaaccccacactgtctccc

SEQ ID NO: 17908 - DNA, 20 bp, Artificial Sequence
  Description of Artificial Sequence: Synthetic oligonucleotide
  Target: DMPK; (-) strand; PAM type: YTN; PAM sequence: TTC
tcccaaccccacactgtctc

SEQ ID NO: 17909 - DNA, 20 bp, Artificial Sequence
  Description of Artificial Sequence: Synthetic oligonucleotide
  Target: DMPK; (-) strand; PAM type: YTN; PAM sequence: CTT
ctcccaaccccacactgtct

SEQ ID NO: 17910 - DNA, 20 bp, Artificial Sequence
  Description of Artificial Sequence: Synthetic oligonucleotide
  Target: DMPK; (-) strand; PAM type: YTN; PAM sequence: CTG
ccttctcccaaccccacact

SEQ ID NO: 17911 - DNA, 20 bp, Artificial Sequence
  Description of Artificial Sequence: Synthetic oligonucleotide
  Target: DMPK; (-) strand; PAM type: YTN; PAM sequence: TTA
ctgccttctcccaaccccac

SEQ ID NO: 17912 - DNA, 20 bp, Artificial Sequence
  Description of Artificial Sequence: Synthetic oligonucleotide
  Target: DMPK; (-) strand; PAM type: YTN; PAM sequence: TTT
actgccttctcccaacccca

SEQ ID NO: 17913 - DNA, 20 bp, Artificial Sequence
  Description of Artificial Sequence: Synthetic oligonucleotide
  Target: DMPK; (-) strand; PAM type: YTN; PAM sequence: TTT
tactgccttctcccaacccc

SEQ ID NO: 17914 - DNA, 20 bp, Artificial Sequence
  Description of Artificial Sequence: Synthetic oligonucleotide
  Target: DMPK; (-) strand; PAM type: YTN; PAM sequence: CTG
ggttttactgccttctccca

SEQ ID NO: 17915 - DNA, 20 bp, Artificial Sequence
  Description of Artificial Sequence: Synthetic oligonucleotide
  Target: DMPK; (-) strand; PAM type: YTN; PAM sequence: CTG
cctgggttttactgccttct

SEQ ID NO: 17916 - DNA, 20 bp, Artificial Sequence
  Description of Artificial Sequence: Synthetic oligonucleotide
  Target: DMPK; (-) strand; PAM type: YTN; PAM sequence: TTC
tgcctgggttttactgcctt

SEQ ID NO: 17917 - DNA, 20 bp, Artificial Sequence
  Description of Artificial Sequence: Synthetic oligonucleotide
  Target: DMPK; (-) strand; PAM type: YTN; PAM sequence: TTG
ggtcggggagaagttctgcc

SEQ ID NO: 17918 - DNA, 20 bp, Artificial Sequence
  Description of Artificial Sequence: Synthetic oligonucleotide
  Target: DMPK; (-) strand; PAM type: YTN; PAM sequence: TTT
gggtcggggagaagttctgc

SEQ ID NO: 17919 - DNA, 20 bp, Artificial Sequence
  Description of Artificial Sequence: Synthetic oligonucleotide
  Target: DMPK; (-) strand; PAM type: YTN; PAM sequence: CTT
tgggtcggggagaagttctg

SEQ ID NO: 17920 - DNA, 20 bp, Artificial Sequence
  Description of Artificial Sequence: Synthetic oligonucleotide
  Target: DMPK; (-) strand; PAM type: YTN; PAM sequence: TTG
gggactttgggtcggggaga

SEQ ID NO: 17921 - DNA, 20 bp, Artificial Sequence
  Description of Artificial Sequence: Synthetic oligonucleotide
  Target: DMPK; (-) strand; PAM type: YTN; PAM sequence: CTT
ggggactttgggtcggggag

SEQ ID NO: 17922 - DNA, 20 bp, Artificial Sequence
  Description of Artificial Sequence: Synthetic oligonucleotide
  Target: DMPK; (-) strand; PAM type: YTN; PAM sequence: TTC
ttggggactttgggtcgggg

SEQ ID NO: 17923 - DNA, 20 bp, Artificial Sequence
  Description of Artificial Sequence: Synthetic oligonucleotide
  Target: DMPK; (-) strand; PAM type: YTN; PAM sequence: CTT
cttggggactttgggtcggg

SEQ ID NO: 17924 - DNA, 20 bp, Artificial Sequence
  Description of Artificial Sequence: Synthetic oligonucleotide
  Target: DMPK; (-) strand; PAM type: YTN; PAM sequence: CTG
tgtgagcggggccatgtcca

SEQ ID NO: 17925 - DNA, 20 bp, Artificial Sequence
  Description of Artificial Sequence: Synthetic oligonucleotide
  Target: DMPK; (-) strand; PAM type: YTN; PAM sequence: CTG
ctgtgtgagcggggccatgt

SEQ ID NO: 17926 - DNA, 20 bp, Artificial Sequence
  Description of Artificial Sequence: Synthetic oligonucleotide
  Target: DMPK; (-) strand; PAM type: YTN; PAM sequence: CTG
gtgtggcacctgctgtgtga

SEQ ID NO: 17927 - DNA, 20 bp, Artificial Sequence
  Description of Artificial Sequence: Synthetic oligonucleotide
  Target: DMPK; (-) strand; PAM type: YTN; PAM sequence: CTG
ggcctggtgtggcacctgct

SEQ ID NO: 17928 - DNA, 20 bp, Artificial Sequence
  Description of Artificial Sequence: Synthetic oligonucleotide
  Target: DMPK; (-) strand; PAM type: YTN; PAM sequence: CTC
cgaggaggacctgggcctgg

SEQ ID NO: 17929 - DNA, 20 bp, Artificial Sequence
  Description of Artificial Sequence: Synthetic oligonucleotide
  Target: DMPK; (-) strand; PAM type: YTN; PAM sequence: CTC
tccgaggaggacctgggcct

SEQ ID NO: 17930 - DNA, 20 bp, Artificial Sequence
  Description of Artificial Sequence: Synthetic oligonucleotide
  Target: DMPK; (-) strand; PAM type: YTN; PAM sequence: TTC
tctccgaggaggacctgggc

SEQ ID NO: 17931 - DNA, 20 bp, Artificial Sequence
  Description of Artificial Sequence: Synthetic oligonucleotide
  Target: DMPK; (-) strand; PAM type: YTN; PAM sequence: CTT
ctctccgaggaggacctggg

SEQ ID NO: 17932 - DNA, 20 bp, Artificial Sequence
  Description of Artificial Sequence: Synthetic oligonucleotide
  Target: DMPK; (-) strand; PAM type: YTN; PAM sequence: TTG
ggagcttctctccgaggagg

SEQ ID NO: 17933 - DNA, 20 bp, Artificial Sequence
  Description of Artificial Sequence: Synthetic oligonucleotide
  Target: DMPK; (-) strand; PAM type: YTN; PAM sequence: TTT
gggagcttctctccgaggag

SEQ ID NO: 17934 - DNA, 20 bp, Artificial Sequence
  Description of Artificial Sequence: Synthetic oligonucleotide
  Target: DMPK; (-) strand; PAM type: YTN; PAM sequence: TTC
cccagtttgggagcttctct

SEQ ID NO: 17935 - DNA, 20 bp, Artificial Sequence
  Description of Artificial Sequence: Synthetic oligonucleotide
  Target: DMPK; (-) strand; PAM type: YTN; PAM sequence: CTT
ccccagtttgggagcttctc

SEQ ID NO: 17936 - DNA, 20 bp, Artificial Sequence
  Description of Artificial Sequence: Synthetic oligonucleotide
  Target: DMPK; (-) strand; PAM type: YTN; PAM sequence: CTG
tcttccccagtttgggagct

SEQ ID NO: 17937 - DNA, 20 bp, Artificial Sequence
  Description of Artificial Sequence: Synthetic oligonucleotide
  Target: DMPK; (-) strand; PAM type: YTN; PAM sequence: CTG
gtgtccatctgtcttcccca

SEQ ID NO: 17938 - DNA, 20 bp, Artificial Sequence
  Description of Artificial Sequence: Synthetic oligonucleotide
  Target: DMPK; (-) strand; PAM type: YTN; PAM sequence: TTC
catgacctggtgtccatctg

SEQ ID NO: 17939 - DNA, 20 bp, Artificial Sequence
  Description of Artificial Sequence: Synthetic oligonucleotide
  Target: DMPK; (-) strand; PAM type: YTN; PAM sequence: TTT
ccatgacctggtgtccatct

SEQ ID NO: 17940 - DNA, 20 bp, Artificial Sequence
  Description of Artificial Sequence: Synthetic oligonucleotide
  Target: DMPK; (-) strand; PAM type: YTN; PAM sequence: TTC
cccatgtttccatgacctgg

SEQ ID NO: 17941 - DNA, 20 bp, Artificial Sequence
  Description of Artificial Sequence: Synthetic oligonucleotide
  Target: DMPK; (-) strand; PAM type: YTN; PAM sequence: TTT
ccccatgtttccatgacctg

SEQ ID NO: 17942 - DNA, 20 bp, Artificial Sequence
  Description of Artificial Sequence: Synthetic oligonucleotide
  Target: DMPK; (-) strand; PAM type: YTN; PAM sequence: CTG
tttccccatgtttccatgac

SEQ ID NO: 17943 - DNA, 20 bp, Artificial Sequence
  Description of Artificial Sequence: Synthetic oligonucleotide
  Target: DMPK; (-) strand; PAM type: YTN; PAM sequence: CTC
tgtttccccatgtttccatg

SEQ ID NO: 17944 - DNA, 20 bp, Artificial Sequence
  Description of Artificial Sequence: Synthetic oligonucleotide
  Target: DMPK; (-) strand; PAM type: YTN; PAM sequence: TTG
cagcagcctctgtttcccca

SEQ ID NO: 17945 - DNA, 20 bp, Artificial Sequence
  Description of Artificial Sequence: Synthetic oligonucleotide
  Target: DMPK; (-) strand; PAM type: YTN; PAM sequence: CTT
gcagcagcctctgtttcccc

SEQ ID NO: 17946 - DNA, 20 bp, Artificial Sequence
  Description of Artificial Sequence: Synthetic oligonucleotide
  Target: DMPK; (-) strand; PAM type: YTN; PAM sequence: CTG
tggccaccttgcagcagcct

SEQ ID NO: 17947 - DNA, 20 bp, Artificial Sequence
  Description of Artificial Sequence: Synthetic oligonucleotide
  Target: DMPK; (-) strand; PAM type: YTN; PAM sequence: TTG
gagcaccctgtggccacctt

SEQ ID NO: 17948 - DNA, 20 bp, Artificial Sequence
  Description of Artificial Sequence: Synthetic oligonucleotide
  Target: DMPK; (-) strand; PAM type: YTN; PAM sequence: CTT
ggagcaccctgtggccacct

SEQ ID NO: 17949 - DNA, 20 bp, Artificial Sequence
  Description of Artificial Sequence: Synthetic oligonucleotide
  Target: DMPK; (-) strand; PAM type: YTN; PAM sequence: CTC
cttggagcaccctgtggcca

SEQ ID NO: 17950 - DNA, 20 bp, Artificial Sequence
  Description of Artificial Sequence: Synthetic oligonucleotide
  Target: DMPK; (-) strand; PAM type: YTN; PAM sequence: CTC
gccaaagatgggacatcgag

SEQ ID NO: 17951 - DNA, 20 bp, Artificial Sequence
  Description of Artificial Sequence: Synthetic oligonucleotide
  Target: DMPK; (-) strand; PAM type: YTN; PAM sequence: CTG
tcccctcgccaaagatggga

SEQ ID NO: 17952 - DNA, 20 bp, Artificial Sequence
  Description of Artificial Sequence: Synthetic oligonucleotide
  Target: DMPK; (-) strand; PAM type: YTN; PAM sequence: CTG
tggcaagcaggactgtcccc

SEQ ID NO: 17953 - DNA, 20 bp, Artificial Sequence
  Description of Artificial Sequence: Synthetic oligonucleotide
  Target: DMPK; (-) strand; PAM type: YTN; PAM sequence: TTC
tgtggcaagcaggactgtcc

SEQ ID NO: 17954 - DNA, 20 bp, Artificial Sequence
  Description of Artificial Sequence: Synthetic oligonucleotide
  Target: DMPK; (-) strand; PAM type: YTN; PAM sequence: TTG
aggaccccgagatacaggac

SEQ ID NO: 17955 - DNA, 20 bp, Artificial Sequence
  Description of Artificial Sequence: Synthetic oligonucleotide
  Target: DMPK; (-) strand; PAM type: YTN; PAM sequence: TTC
catggcccggaggttgagga

SEQ ID NO: 17956 - DNA, 20 bp, Artificial Sequence
  Description of Artificial Sequence: Synthetic oligonucleotide
  Target: DMPK; (-) strand; PAM type: YTN; PAM sequence: CTG
ttccatggcccggaggttga

SEQ ID NO: 17957 - DNA, 20 bp, Artificial Sequence
  Description of Artificial Sequence: Synthetic oligonucleotide
  Target: DMPK; (-) strand; PAM type: YTN; PAM sequence: CTA
ctgttccatggcccggaggt

SEQ ID NO: 17958 - DNA, 20 bp, Artificial Sequence
  Description of Artificial Sequence: Synthetic oligonucleotide
  Target: DMPK; (-) strand; PAM type: YTN; PAM sequence: CTA
acaggccacggaccactact

SEQ ID NO: 17959 - DNA, 20 bp, Artificial Sequence
  Description of Artificial Sequence: Synthetic oligonucleotide
  Target: DMPK; (-) strand; PAM type: YTN; PAM sequence: TTC
ctaacaggccacggaccact

SEQ ID NO: 17960 - DNA, 20 bp, Artificial Sequence
  Description of Artificial Sequence: Synthetic oligonucleotide
  Target: DMPK; (-) strand; PAM type: YTN; PAM sequence: CTG
gttcctaacaggccacggac

SEQ ID NO: 17961 - DNA, 20 bp, Artificial Sequence
  Description of Artificial Sequence: Synthetic oligonucleotide
  Target: DMPK; (-) strand; PAM type: YTN; PAM sequence: CTG
catggcctggttcctaacag

SEQ ID NO: 17962 - DNA, 20 bp, Artificial Sequence
  Description of Artificial Sequence: Synthetic oligonucleotide
  Target: DMPK; (-) strand; PAM type: YTN; PAM sequence: CTG
ctgcatggcctggttcctaa

SEQ ID NO: 17963 - DNA, 20 bp, Artificial Sequence
  Description of Artificial Sequence: Synthetic oligonucleotide
  Target: DMPK; (-) strand; PAM type: YTN; PAM sequence: CTC
ctgctgcatggcctggttcc

SEQ ID NO: 17964 - DNA, 20 bp, Artificial Sequence
  Description of Artificial Sequence: Synthetic oligonucleotide
  Target: DMPK; (-) strand; PAM type: YTN; PAM sequence: CTC
acctcctgctgcatggcctg

SEQ ID NO: 17965 - DNA, 20 bp, Artificial Sequence
  Description of Artificial Sequence: Synthetic oligonucleotide
  Target: DMPK; (-) strand; PAM type: YTN; PAM sequence: CTC
gcccaccactcacctcctgc

SEQ ID NO: 17966 - DNA, 20 bp, Artificial Sequence
  Description of Artificial Sequence: Synthetic oligonucleotide
  Target: DMPK; (-) strand; PAM type: YTN; PAM sequence: CTG
ctcgcccaccactcacctcc

SEQ ID NO: 17967 - DNA, 20 bp, Artificial Sequence
  Description of Artificial Sequence: Synthetic oligonucleotide
  Target: DMPK; (-) strand; PAM type: YTN; PAM sequence: CTG
taatgcctgctcgcccacca

SEQ ID NO: 17968 - DNA, 20 bp, Artificial Sequence
  Description of Artificial Sequence: Synthetic oligonucleotide
  Target: DMPK; (-) strand; PAM type: YTN; PAM sequence: CTC
aggctgtaatgcctgctcgc

SEQ ID NO: 17969 - DNA, 20 bp, Artificial Sequence
  Description of Artificial Sequence: Synthetic oligonucleotide
  Target: DMPK; (-) strand; PAM type: YTN; PAM sequence: CTG
ggctcaggctgtaatgcctg

SEQ ID NO: 17970 - DNA, 20 bp, Artificial Sequence
  Description of Artificial Sequence: Synthetic oligonucleotide
  Target: DMPK; (-) strand; PAM type: YTN; PAM sequence: CTC
cggtaggaggctgggctcag

SEQ ID NO: 17971 - DNA, 20 bp, Artificial Sequence
  Description of Artificial Sequence: Synthetic oligonucleotide
  Target: DMPK; (-) strand; PAM type: YTN; PAM sequence: CTG
ctccggtaggaggctgggct

SEQ ID NO: 17972 - DNA, 20 bp, Artificial Sequence
  Description of Artificial Sequence: Synthetic oligonucleotide
  Target: DMPK; (-) strand; PAM type: YTN; PAM sequence: TTG
aatggtgcgctgctccggta

SEQ ID NO: 17973 - DNA, 20 bp, Artificial Sequence
  Description of Artificial Sequence: Synthetic oligonucleotide
  Target: DMPK; (-) strand; PAM type: YTN; PAM sequence: TTA
cgaggattgaatggtgcgct

SEQ ID NO: 17974 - DNA, 20 bp, Artificial Sequence
  Description of Artificial Sequence: Synthetic oligonucleotide
  Target: DMPK; (-) strand; PAM type: YTN; PAM sequence: CTT
acgaggattgaatggtgcgc

SEQ ID NO: 17975 - DNA, 20 bp, Artificial Sequence
  Description of Artificial Sequence: Synthetic oligonucleotide
  Target: DMPK; (-) strand; PAM type: YTN; PAM sequence: CTC
ttacgaggattgaatggtgc

SEQ ID NO: 17976 - DNA, 20 bp, Artificial Sequence
  Description of Artificial Sequence: Synthetic oligonucleotide
  Target: DMPK; (-) strand; PAM type: YTN; PAM sequence: TTC
gcactcttacgaggattgaa

SEQ ID NO: 17977 - DNA, 20 bp, Artificial Sequence
  Description of Artificial Sequence: Synthetic oligonucleotide
  Target: DMPK; (-) strand; PAM type: YTN; PAM sequence: TTC
atggtggggttcgcactctt

SEQ ID NO: 17978 - DNA, 20 bp, Artificial Sequence
  Description of Artificial Sequence: Synthetic oligonucleotide
  Target: DMPK; (-) strand; PAM type: YTN; PAM sequence: CTC
gcatgcatagttcatggtgg

SEQ ID NO: 17979 - DNA, 20 bp, Artificial Sequence
  Description of Artificial Sequence: Synthetic oligonucleotide
  Target: DMPK; (-) strand; PAM type: YTN; PAM sequence: CTA
gatccctcgcatgcatagtt

SEQ ID NO: 17980 - DNA, 20 bp, Artificial Sequence
  Description of Artificial Sequence: Synthetic oligonucleotide
  Target: DMPK; (-) strand; PAM type: YTN; PAM sequence: CTA
ataaggagcgcacacctaga

SEQ ID NO: 17981 - DNA, 20 bp, Artificial Sequence
  Description of Artificial Sequence: Synthetic oligonucleotide
  Target: DMPK; (-) strand; PAM type: YTN; PAM sequence: TTC
taataaggagcgcacaccta

SEQ ID NO: 17982 - DNA, 20 bp, Artificial Sequence
  Description of Artificial Sequence: Synthetic oligonucleotide
  Target: DMPK; (-) strand; PAM type: YTN; PAM sequence: TTA
gattctaataaggagcgcac

SEQ ID NO: 17983 - DNA, 20 bp, Artificial Sequence
  Description of Artificial Sequence: Synthetic oligonucleotide
  Target: DMPK; (-) strand; PAM type: YTN; PAM sequence: CTG
atcatcaggtgttagattct

SEQ ID NO: 17984 - DNA, 20 bp, Artificial Sequence
  Description of Artificial Sequence: Synthetic oligonucleotide
  Target: DMPK; (-) strand; PAM type: YTN; PAM sequence: CTC
tgatcatcaggtgttagatt

SEQ ID NO: 17985 - DNA, 20 bp, Artificial Sequence
  Description of Artificial Sequence: Synthetic oligonucleotide
  Target: DMPK; (-) strand; PAM type: YTN; PAM sequence: CTG
cctctgatcatcaggtgtta

SEQ ID NO: 17986 - DNA, 20 bp, Artificial Sequence
  Description of Artificial Sequence: Synthetic oligonucleotide
  Target: DMPK; (-) strand; PAM type: YTN; PAM sequence: TTC
tgcctctgatcatcaggtgt

SEQ ID NO: 17987 - DNA, 20 bp, Artificial Sequence
  Description of Artificial Sequence: Synthetic oligonucleotide
  Target: DMPK; (-) strand; PAM type: YTN; PAM sequence: TTG
ggatgaaaccgttctgcctc

SEQ ID NO: 17988 - DNA, 20 bp, Artificial Sequence
  Description of Artificial Sequence: Synthetic oligonucleotide
  Target: DMPK; (-) strand; PAM type: YTN; PAM sequence: TTT
gggatgaaaccgttctgcct

SEQ ID NO: 17989 - DNA, 20 bp, Artificial Sequence
  Description of Artificial Sequence: Synthetic oligonucleotide
  Target: DMPK; (-) strand; PAM type: YTN; PAM sequence: TTT
tgggatgaaaccgttctgcc

SEQ ID NO: 17990 - DNA, 20 bp, Artificial Sequence
  Description of Artificial Sequence: Synthetic oligonucleotide
  Target: DMPK; (-) strand; PAM type: YTN; PAM sequence: TTG
gggggatggttttgggatga

SEQ ID NO: 17991 - DNA, 20 bp, Artificial Sequence
  Description of Artificial Sequence: Synthetic oligonucleotide
  Target: DMPK; (-) strand; PAM type: YTN; PAM sequence: CTG
ttggggggatggttttggga

SEQ ID NO: 17992 - DNA, 20 bp, Artificial Sequence
  Description of Artificial Sequence: Synthetic oligonucleotide
  Target: DMPK; (-) strand; PAM type: YTN; PAM sequence: TTC
cacagactgttggggggatg

SEQ ID NO: 17993 - DNA, 20 bp, Artificial Sequence
  Description of Artificial Sequence: Synthetic oligonucleotide
  Target: DMPK; (-) strand; PAM type: YTN; PAM sequence: TTT
ccacagactgttggggggat

SEQ ID NO: 17994 - DNA, 20 bp, Artificial Sequence
  Description of Artificial Sequence: Synthetic oligonucleotide
  Target: DMPK; (-) strand; PAM type: YTN; PAM sequence: TTT
tccacagactgttgggggga

SEQ ID NO: 17995 - DNA, 20 bp, Artificial Sequence
  Description of Artificial Sequence: Synthetic oligonucleotide
  Target: DMPK; (-) strand; PAM type: YTN; PAM sequence: TTT
ttccacagactgttgggggg

SEQ ID NO: 17996 - DNA, 20 bp, Artificial Sequence
  Description of Artificial Sequence: Synthetic oligonucleotide
  Target: DMPK; (-) strand; PAM type: YTN; PAM sequence: TTA
tggaagacagtttttccaca

SEQ ID NO: 17997 - DNA, 20 bp, Artificial Sequence
  Description of Artificial Sequence: Synthetic oligonucleotide
  Target: DMPK; (-) strand; PAM type: YTN; PAM sequence: CTT
atggaagacagtttttccac

SEQ ID NO: 17998 - DNA, 20 bp, Artificial Sequence
  Description of Artificial Sequence: Synthetic oligonucleotide
  Target: DMPK; (-) strand; PAM type: YTN; PAM sequence: CTG
gtcttatggaagacagtttt

SEQ ID NO: 17999 - DNA, 20 bp, Artificial Sequence
  Description of Artificial Sequence: Synthetic oligonucleotide
  Target: DMPK; (+) strand; PAM type: YTN; PAM sequence: CTC
gaggtgggctctgtgttcag

SEQ ID NO: 18000 - DNA, 20 bp, Artificial Sequence
  Description of Artificial Sequence: Synthetic oligonucleotide
  Target: DMPK; (+) strand; PAM type: YTN; PAM sequence: CTC
tgtgttcagcgctgctttgg

SEQ ID NO: 18001 - DNA, 20 bp, Artificial Sequence
  Description of Artificial Sequence: Synthetic oligonucleotide
  Target: DMPK; (+) strand; PAM type: YTN; PAM sequence: CTG
tgttcagcgctgctttggac

SEQ ID NO: 18002 - DNA, 20 bp, Artificial Sequence
  Description of Artificial Sequence: Synthetic oligonucleotide
  Target: DMPK; (+) strand; PAM type: YTN; PAM sequence: TTC
agcgctgctttggacagaca

SEQ ID NO: 18003 - DNA, 20 bp, Artificial Sequence
  Description of Artificial Sequence: Synthetic oligonucleotide
  Target: DMPK; (+) strand; PAM type: YTN; PAM sequence: CTG
ctttggacagacactggaag

SEQ ID NO: 18004 - DNA, 20 bp, Artificial Sequence
  Description of Artificial Sequence: Synthetic oligonucleotide
  Target: DMPK; (+) strand; PAM type: YTN; PAM sequence: CTT
tggacagacactggaaggca

SEQ ID NO: 18005 - DNA, 20 bp, Artificial Sequence
  Description of Artificial Sequence: Synthetic oligonucleotide
  Target: DMPK; (+) strand; PAM type: YTN; PAM sequence: TTT
ggacagacactggaaggcac

SEQ ID NO: 18006 - DNA, 20 bp, Artificial Sequence
  Description of Artificial Sequence: Synthetic oligonucleotide
  Target: DMPK; (+) strand; PAM type: YTN; PAM sequence: TTG
gacagacactggaaggcacc

SEQ ID NO: 18007 - DNA, 20 bp, Artificial Sequence
  Description of Artificial Sequence: Synthetic oligonucleotide
  Target: DMPK; (+) strand; PAM type: YTN; PAM sequence: CTG
gaaggcaccccagacccctg

SEQ ID NO: 18008 - DNA, 20 bp, Artificial Sequence
  Description of Artificial Sequence: Synthetic oligonucleotide
  Target: DMPK; (+) strand; PAM type: YTN; PAM sequence: CTG
gtggtggtgtaatccgataa

SEQ ID NO: 18009 - DNA, 20 bp, Artificial Sequence
  Description of Artificial Sequence: Synthetic oligonucleotide
  Target: DMPK; (+) strand; PAM type: YTN; PAM sequence: CTT
tattttaattgaaaatggag

SEQ ID NO: 18010 - DNA, 20 bp, Artificial Sequence
  Description of Artificial Sequence: Synthetic oligonucleotide
  Target: DMPK; (+) strand; PAM type: YTN; PAM sequence: TTT
attttaattgaaaatggagg

SEQ ID NO: 18011 - DNA, 20 bp, Artificial Sequence
  Description of Artificial Sequence: Synthetic oligonucleotide
  Target: DMPK; (+) strand; PAM type: YTN; PAM sequence: TTA
ttttaattgaaaatggaggc

SEQ ID NO: 18012 - DNA, 20 bp, Artificial Sequence
  Description of Artificial Sequence: Synthetic oligonucleotide
  Target: DMPK; (+) strand; PAM type: YTN; PAM sequence: TTT
taattgaaaatggaggcata

SEQ ID NO: 18013 - DNA, 20 bp, Artificial Sequence
  Description of Artificial Sequence: Synthetic oligonucleotide
  Target: DMPK; (+) strand; PAM type: YTN; PAM sequence: TTT
aattgaaaatggaggcataa

SEQ ID NO: 18014 - DNA, 20 bp, Artificial Sequence
  Description of Artificial Sequence: Synthetic oligonucleotide
  Target: DMPK; (+) strand; PAM type: YTN; PAM sequence: TTA
attgaaaatggaggcataac

SEQ ID NO: 18015 - DNA, 20 bp, Artificial Sequence
  Description of Artificial Sequence: Synthetic oligonucleotide
  Target: DMPK; (+) strand; PAM type: YTN; PAM sequence: TTG
aaaatggaggcataacatgt

SEQ ID NO: 18016 - DNA, 20 bp, Artificial Sequence
  Description of Artificial Sequence: Synthetic oligonucleotide
  Target: DMPK; (+) strand; PAM type: YTN; PAM sequence: CTA
gaaaaataaagatttaggat

SEQ ID NO: 18017 - DNA, 20 bp, Artificial Sequence
  Description of Artificial Sequence: Synthetic oligonucleotide
  Target: DMPK; (+) strand; PAM type: YTN; PAM sequence: TTT
aggatacaaaggagacacag

SEQ ID NO: 18018 - DNA, 20 bp, Artificial Sequence
  Description of Artificial Sequence: Synthetic oligonucleotide
  Target: DMPK; (+) strand; PAM type: YTN; PAM sequence: TTA
ggatacaaaggagacacagc

SEQ ID NO: 18019 - DNA, 20 bp, Artificial Sequence
  Description of Artificial Sequence: Synthetic oligonucleotide
  Target: DMPK; (+) strand; PAM type: YTN; PAM sequence: CTG
cccccagggatgagggaatc

SEQ ID NO: 18020 - DNA, 20 bp, Artificial Sequence
  Description of Artificial Sequence: Synthetic oligonucleotide
  Target: DMPK; (+) strand; PAM type: YTN; PAM sequence: CTT
tggtctgggccggataatga

SEQ ID NO: 18021 - DNA, 20 bp, Artificial Sequence
  Description of Artificial Sequence: Synthetic oligonucleotide
  Target: DMPK; (+) strand; PAM type: YTN; PAM sequence: TTT
ggtctgggccggataatgag

SEQ ID NO: 18022 - DNA, 20 bp, Artificial Sequence
  Description of Artificial Sequence: Synthetic oligonucleotide
  Target: DMPK; (+) strand; PAM type: YTN; PAM sequence: TTG
gtctgggccggataatgagg

SEQ ID NO: 18023 - DNA, 20 bp, Artificial Sequence
  Description of Artificial Sequence: Synthetic oligonucleotide
  Target: DMPK; (+) strand; PAM type: YTN; PAM sequence: CTG
ggccggataatgaggacaag

SEQ ID NO: 18024 - DNA, 20 bp, Artificial Sequence
  Description of Artificial Sequence: Synthetic oligonucleotide
  Target: DMPK; (+) strand; PAM type: YTN; PAM sequence: CTT
gagtcgaggggagctggtga

SEQ ID NO: 18025 - DNA, 20 bp, Artificial Sequence
  Description of Artificial Sequence: Synthetic oligonucleotide
  Target: DMPK; (+) strand; PAM type: YTN; PAM sequence: TTG
agtcgaggggagctggtgaa

SEQ ID NO: 18026 - DNA, 20 bp, Artificial Sequence
  Description of Artificial Sequence: Synthetic oligonucleotide
  Target: DMPK; (+) strand; PAM type: YTN; PAM sequence: CTG
gtgaaggaagacccccgtct

SEQ ID NO: 18027 - DNA, 20 bp, Artificial Sequence
  Description of Artificial Sequence: Synthetic oligonucleotide
  Target: DMPK; (+) strand; PAM type: YTN; PAM sequence: CTC
cccacagctgccccaccccc

SEQ ID NO: 18028 - DNA, 20 bp, Artificial Sequence
  Description of Artificial Sequence: Synthetic oligonucleotide
  Target: DMPK; (+) strand; PAM type: YTN; PAM sequence: CTG
ccccaccccccgcccctggc

SEQ ID NO: 18029 - DNA, 20 bp, Artificial Sequence
  Description of Artificial Sequence: Synthetic oligonucleotide
  Target: DMPK; (+) strand; PAM type: YTN; PAM sequence: CTG
gcaggaaatgccacactggg

SEQ ID NO: 18030 - DNA, 20 bp, Artificial Sequence
  Description of Artificial Sequence: Synthetic oligonucleotide
  Target: DMPK; (+) strand; PAM type: YTN; PAM sequence: CTG
gggagggtctccagtctcag

SEQ ID NO: 18031 - DNA, 20 bp, Artificial Sequence
  Description of Artificial Sequence: Synthetic oligonucleotide
  Target: DMPK; (+) strand; PAM type: YTN; PAM sequence: CTC
cagtctcaggggcgcggggc

SEQ ID NO: 18032 - DNA, 20 bp, Artificial Sequence
  Description of Artificial Sequence: Synthetic oligonucleotide
  Target: DMPK; (+) strand; PAM type: YTN; PAM sequence: CTC
aggggcgcggggctgcctgt

SEQ ID NO: 18033 - DNA, 20 bp, Artificial Sequence
  Description of Artificial Sequence: Synthetic oligonucleotide
  Target: DMPK; (+) strand; PAM type: YTN; PAM sequence: CTG
cctgtcctccaccttcggat

SEQ ID NO: 18034 - DNA, 20 bp, Artificial Sequence
  Description of Artificial Sequence: Synthetic oligonucleotide
  Target: DMPK; (+) strand; PAM type: YTN; PAM sequence: CTG
tcctccaccttcggattcca

SEQ ID NO: 18035 - DNA, 20 bp, Artificial Sequence
  Description of Artificial Sequence: Synthetic oligonucleotide
  Target: DMPK; (+) strand; PAM type: YTN; PAM sequence: CTC
caccttcggattccaggcag

SEQ ID NO: 18036 - DNA, 20 bp, Artificial Sequence
  Description of Artificial Sequence: Synthetic oligonucleotide
  Target: DMPK; (+) strand; PAM type: YTN; PAM sequence: CTT
cggattccaggcagttgtga

SEQ ID NO: 18037 - DNA, 20 bp, Artificial Sequence
  Description of Artificial Sequence: Synthetic oligonucleotide
  Target: DMPK; (+) strand; PAM type: YTN; PAM sequence: TTC
ggattccaggcagttgtgac

SEQ ID NO: 18038 - DNA, 20 bp, Artificial Sequence
  Description of Artificial Sequence: Synthetic oligonucleotide
  Target: DMPK; (+) strand; PAM type: YTN; PAM sequence: TTC
caggcagttgtgacaacacc

SEQ ID NO: 18039 - DNA, 20 bp, Artificial Sequence
  Description of Artificial Sequence: Synthetic oligonucleotide
  Target: DMPK; (+) strand; PAM type: YTN; PAM sequence: TTG
tgacaacaccagctatcggc

SEQ ID NO: 18040 - DNA, 20 bp, Artificial Sequence
  Description of Artificial Sequence: Synthetic oligonucleotide
  Target: DMPK; (+) strand; PAM type: YTN; PAM sequence: CTA
tcggcagagctattaatagt

SEQ ID NO: 18041 - DNA, 20 bp, Artificial Sequence
  Description of Artificial Sequence: Synthetic oligonucleotide
  Target: DMPK; (+) strand; PAM type: YTN; PAM sequence: CTA
ttaatagtgtttcagggagt

SEQ ID NO: 18042 - DNA, 20 bp, Artificial Sequence
  Description of Artificial Sequence: Synthetic oligonucleotide
  Target: DMPK; (+) strand; PAM type: YTN; PAM sequence: TTA
atagtgtttcagggagtgac

SEQ ID NO: 18043 - DNA, 20 bp, Artificial Sequence
  Description of Artificial Sequence: Synthetic oligonucleotide
  Target: DMPK; (+) strand; PAM type: YTN; PAM sequence: TTT
cagggagtgacagggagagg

SEQ ID NO: 18044 - DNA, 20 bp, Artificial Sequence
  Description of Artificial Sequence: Synthetic oligonucleotide
  Target: DMPK; (+) strand; PAM type: YTN; PAM sequence: TTC
agggagtgacagggagaggg

SEQ ID NO: 18045 - DNA, 20 bp, Artificial Sequence
  Description of Artificial Sequence: Synthetic oligonucleotide
  Target: DMPK; (+) strand; PAM type: YTN; PAM sequence: CTC
tgggggctggaagtccggcc

SEQ ID NO: 18046 - DNA, 20 bp, Artificial Sequence
  Description of Artificial Sequence: Synthetic oligonucleotide
  Target: DMPK; (+) strand; PAM type: YTN; PAM sequence: CTG
ggggctggaagtccggccct

SEQ ID NO: 18047 - DNA, 20 bp, Artificial Sequence
  Description of Artificial Sequence: Synthetic oligonucleotide
  Target: DMPK; (+) strand; PAM type: YTN; PAM sequence: CTG
gaagtccggccctggggcag

SEQ ID NO: 18048 - DNA, 20 bp, Artificial Sequence
  Description of Artificial Sequence: Synthetic oligonucleotide
  Target: DMPK; (+) strand; PAM type: YTN; PAM sequence: CTG
gggcagggtgttccgcttac

SEQ ID NO: 18049 - DNA, 20 bp, Artificial Sequence
  Description of Artificial Sequence: Synthetic oligonucleotide
  Target: DMPK; (+) strand; PAM type: YTN; PAM sequence: TTC
cgcttacagctagtaccaag

SEQ ID NO: 18050 - DNA, 20 bp, Artificial Sequence
  Description of Artificial Sequence: Synthetic oligonucleotide
  Target: DMPK; (+) strand; PAM type: YTN; PAM sequence: CTT
acagctagtaccaagtggag

SEQ ID NO: 18051 - DNA, 20 bp, Artificial Sequence
  Description of Artificial Sequence: Synthetic oligonucleotide
  Target: DMPK; (+) strand; PAM type: YTN; PAM sequence: TTA
cagctagtaccaagtggagg

SEQ ID NO: 18052 - DNA, 20 bp, Artificial Sequence
  Description of Artificial Sequence: Synthetic oligonucleotide
  Target: DMPK; (+) strand; PAM type: YTN; PAM sequence: CTA
gtaccaagtggagggggcag

SEQ ID NO: 18053 - DNA, 20 bp, Artificial Sequence
  Description of Artificial Sequence: Synthetic oligonucleotide
  Target: DMPK; (+) strand; PAM type: YTN; PAM sequence: CTG
agtcaggaccctgagtcccc

SEQ ID NO: 18054 - DNA, 20 bp, Artificial Sequence
  Description of Artificial Sequence: Synthetic oligonucleotide
  Target: DMPK; (+) strand; PAM type: YTN; PAM sequence: CTG
agtcccccacgtatatggca

SEQ ID NO: 18055 - DNA, 20 bp, Artificial Sequence
  Description of Artificial Sequence: Synthetic oligonucleotide
  Target: DMPK; (+) strand; PAM type: YTN; PAM sequence: CTG
taacagagaggcctcccatc

SEQ ID NO: 18056 - DNA, 20 bp, Artificial Sequence
  Description of Artificial Sequence: Synthetic oligonucleotide
  Target: DMPK; (+) strand; PAM type: YTN; PAM sequence: CTC
ccatccaaagggggatggag

SEQ ID NO: 18057 - DNA, 20 bp, Artificial Sequence
  Description of Artificial Sequence: Synthetic oligonucleotide
  Target: DMPK; (+) strand; PAM type: YTN; PAM sequence: CTG
gacaggaggtggccggggat

SEQ ID NO: 18058 - DNA, 20 bp, Artificial Sequence
  Description of Artificial Sequence: Synthetic oligonucleotide
  Target: DMPK; (+) strand; PAM type: YTN; PAM sequence: CTT
ggagaggccacccaggcaga

SEQ ID NO: 18059 - DNA, 20 bp, Artificial Sequence
  Description of Artificial Sequence: Synthetic oligonucleotide
  Target: DMPK; (+) strand; PAM type: YTN; PAM sequence: TTG
gagaggccacccaggcagaa

SEQ ID NO: 18060 - DNA, 20 bp, Artificial Sequence
  Description of Artificial Sequence: Synthetic oligonucleotide
  Target: DMPK; (+) strand; PAM type: YTN; PAM sequence: CTG
gggtcttcagcaaccgcatt

SEQ ID NO: 18061 - DNA, 20 bp, Artificial Sequence
  Description of Artificial Sequence: Synthetic oligonucleotide
  Target: DMPK; (+) strand; PAM type: YTN; PAM sequence: CTT
cagcaaccgcatttctgggg

SEQ ID NO: 18062 - DNA, 20 bp, Artificial Sequence
  Description of Artificial Sequence: Synthetic oligonucleotide
  Target: DMPK; (+) strand; PAM type: YTN; PAM sequence: TTC
agcaaccgcatttctggggc

SEQ ID NO: 18063 - DNA, 20 bp, Artificial Sequence
  Description of Artificial Sequence: Synthetic oligonucleotide
  Target: DMPK; (+) strand; PAM type: YTN; PAM sequence: TTT
ctggggctcccccctcccat

SEQ ID NO: 18064 - DNA, 20 bp, Artificial Sequence
  Description of Artificial Sequence: Synthetic oligonucleotide
  Target: DMPK; (+) strand; PAM type: YTN; PAM sequence: TTC
tggggctcccccctcccatt

SEQ ID NO: 18065 - DNA, 20 bp, Artificial Sequence
  Description of Artificial Sequence: Synthetic oligonucleotide
  Target: DMPK; (+) strand; PAM type: YTN; PAM sequence: CTG
gggctcccccctcccattcc

SEQ ID NO: 18066 - DNA, 20 bp, Artificial Sequence
  Description of Artificial Sequence: Synthetic oligonucleotide
  Target: DMPK; (+) strand; PAM type: YTN; PAM sequence: CTC
ccccctcccattcctgtccc

SEQ ID NO: 18067 - DNA, 20 bp, Artificial Sequence
  Description of Artificial Sequence: Synthetic oligonucleotide
  Target: DMPK; (+) strand; PAM type: YTN; PAM sequence: CTC
ccattcctgtccctgcgtct

SEQ ID NO: 18068 - DNA, 20 bp, Artificial Sequence
  Description of Artificial Sequence: Synthetic oligonucleotide
  Target: DMPK; (+) strand; PAM type: YTN; PAM sequence: TTC
ctgtccctgcgtcttcagca

SEQ ID NO: 18069 - DNA, 20 bp, Artificial Sequence
  Description of Artificial Sequence: Synthetic oligonucleotide
  Target: DMPK; (+) strand; PAM type: YTN; PAM sequence: CTG
tccctgcgtcttcagcacca

SEQ ID NO: 18070 - DNA, 20 bp, Artificial Sequence
  Description of Artificial Sequence: Synthetic oligonucleotide
  Target: DMPK; (+) strand; PAM type: YTN; PAM sequence: CTG
cgtcttcagcaccaatgtcg

SEQ ID NO: 18071 - DNA, 20 bp, Artificial Sequence
  Description of Artificial Sequence: Synthetic oligonucleotide
  Target: DMPK; (+) strand; PAM type: YTN; PAM sequence: CTT
cagcaccaatgtcgggagag

SEQ ID NO: 18072 - DNA, 20 bp, Artificial Sequence
  Description of Artificial Sequence: Synthetic oligonucleotide
  Target: DMPK; (+) strand; PAM type: YTN; PAM sequence: TTC
agcaccaatgtcgggagagg

SEQ ID NO: 18073 - DNA, 20 bp, Artificial Sequence
  Description of Artificial Sequence: Synthetic oligonucleotide
  Target: DMPK; (+) strand; PAM type: YTN; PAM sequence: CTG
ggtcacagttccaagggctc

SEQ ID NO: 18074 - DNA, 20 bp, Artificial Sequence
  Description of Artificial Sequence: Synthetic oligonucleotide
  Target: DMPK; (+) strand; PAM type: YTN; PAM sequence: TTC
caagggctcctccacaggca

SEQ ID NO: 18075 - DNA, 20 bp, Artificial Sequence
  Description of Artificial Sequence: Synthetic oligonucleotide
  Target: DMPK; (+) strand; PAM type: YTN; PAM sequence: CTC
ctccacaggcaccgactgga

SEQ ID NO: 18076 - DNA, 20 bp, Artificial Sequence
  Description of Artificial Sequence: Synthetic oligonucleotide
  Target: DMPK; (+) strand; PAM type: YTN; PAM sequence: CTC
cacaggcaccgactggagct

SEQ ID NO: 18077 - DNA, 20 bp, Artificial Sequence
  Description of Artificial Sequence: Synthetic oligonucleotide
  Target: DMPK; (+) strand; PAM type: YTN; PAM sequence: CTG
gagctgggtcagaaccttgg

SEQ ID NO: 18078 - DNA, 20 bp, Artificial Sequence
  Description of Artificial Sequence: Synthetic oligonucleotide
  Target: DMPK; (+) strand; PAM type: YTN; PAM sequence: CTG
ggtcagaaccttggcctcag

SEQ ID NO: 18079 - DNA, 20 bp, Artificial Sequence
  Description of Artificial Sequence: Synthetic oligonucleotide
  Target: DMPK; (+) strand; PAM type: YTN; PAM sequence: CTT
ggcctcagcttccaacccct

SEQ ID NO: 18080 - DNA, 20 bp, Artificial Sequence
  Description of Artificial Sequence: Synthetic oligonucleotide
  Target: DMPK; (+) strand; PAM type: YTN; PAM sequence: TTG
gcctcagcttccaacccctc

SEQ ID NO: 18081 - DNA, 20 bp, Artificial Sequence
  Description of Artificial Sequence: Synthetic oligonucleotide
  Target: DMPK; (+) strand; PAM type: YTN; PAM sequence: CTC
agcttccaacccctcgtcaa

SEQ ID NO: 18082 - DNA, 20 bp, Artificial Sequence
  Description of Artificial Sequence: Synthetic oligonucleotide
  Target: DMPK; (+) strand; PAM type: YTN; PAM sequence: CTT
ccaacccctcgtcaacctca

SEQ ID NO: 18083 - DNA, 20 bp, Artificial Sequence
  Description of Artificial Sequence: Synthetic oligonucleotide
  Target: DMPK; (+) strand; PAM type: YTN; PAM sequence: TTC
caacccctcgtcaacctcac

SEQ ID NO: 18084 - DNA, 20 bp, Artificial Sequence
  Description of Artificial Sequence: Synthetic oligonucleotide
  Target: DMPK; (+) strand; PAM type: YTN; PAM sequence: CTC
gtcaacctcaccccctgcgg

SEQ ID NO: 18085 - DNA, 20 bp, Artificial Sequence
  Description of Artificial Sequence: Synthetic oligonucleotide
  Target: DMPK; (+) strand; PAM type: YTN; PAM sequence: CTC
accccctgcggtggccccca

SEQ ID NO: 18086 - DNA, 20 bp, Artificial Sequence
  Description of Artificial Sequence: Synthetic oligonucleotide
  Target: DMPK; (+) strand; PAM type: YTN; PAM sequence: CTG
cggtggcccccaggagcagc

SEQ ID NO: 18087 - DNA, 20 bp, Artificial Sequence
  Description of Artificial Sequence: Synthetic oligonucleotide
  Target: DMPK; (+) strand; PAM type: YTN; PAM sequence: CTC
agggtcggggtctggcagcc

SEQ ID NO: 18088 - DNA, 20 bp, Artificial Sequence
  Description of Artificial Sequence: Synthetic oligonucleotide
  Target: DMPK; (+) strand; PAM type: YTN; PAM sequence: CTG
gcagcctcagcacggtgtgg

SEQ ID NO: 18089 - DNA, 20 bp, Artificial Sequence
  Description of Artificial Sequence: Synthetic oligonucleotide
  Target: DMPK; (+) strand; PAM type: YTN; PAM sequence: CTC
agcacggtgtggggggcctg

SEQ ID NO: 18090 - DNA, 20 bp, Artificial Sequence
  Description of Artificial Sequence: Synthetic oligonucleotide
  Target: DMPK; (+) strand; PAM type: YTN; PAM sequence: CTG
tgtccccagccccttttccg

SEQ ID NO: 18091 - DNA, 20 bp, Artificial Sequence
  Description of Artificial Sequence: Synthetic oligonucleotide
  Target: DMPK; (+) strand; PAM type: YTN; PAM sequence: CTT
ttccgcttccagcagcccct

SEQ ID NO: 18092 - DNA, 20 bp, Artificial Sequence
  Description of Artificial Sequence: Synthetic oligonucleotide
  Target: DMPK; (+) strand; PAM type: YTN; PAM sequence: TTT
tccgcttccagcagcccctc

SEQ ID NO: 18093 - DNA, 20 bp, Artificial Sequence
  Description of Artificial Sequence: Synthetic oligonucleotide
  Target: DMPK; (+) strand; PAM type: YTN; PAM sequence: TTT
ccgcttccagcagcccctct

SEQ ID NO: 18094 - DNA, 20 bp, Artificial Sequence
  Description of Artificial Sequence: Synthetic oligonucleotide
  Target: DMPK; (+) strand; PAM type: YTN; PAM sequence: TTC
cgcttccagcagcccctctg

SEQ ID NO: 18095 - DNA, 20 bp, Artificial Sequence
  Description of Artificial Sequence: Synthetic oligonucleotide
  Target: DMPK; (+) strand; PAM type: YTN; PAM sequence: CTT
ccagcagcccctctgttcct

SEQ ID NO: 18096 - DNA, 20 bp, Artificial Sequence
  Description of Artificial Sequence: Synthetic oligonucleotide
  Target: DMPK; (+) strand; PAM type: YTN; PAM sequence: TTC
cagcagcccctctgttcctg

SEQ ID NO: 18097 - DNA, 20 bp, Artificial Sequence
  Description of Artificial Sequence: Synthetic oligonucleotide
  Target: DMPK; (+) strand; PAM type: YTN; PAM sequence: CTC
tgttcctgcgcttagttcca

SEQ ID NO: 18098 - DNA, 20 bp, Artificial Sequence
  Description of Artificial Sequence: Synthetic oligonucleotide
  Target: DMPK; (+) strand; PAM type: YTN; PAM sequence: CTG
ttcctgcgcttagttccagc

SEQ ID NO: 18099 - DNA, 20 bp, Artificial Sequence
  Description of Artificial Sequence: Synthetic oligonucleotide
  Target: DMPK; (+) strand; PAM type: YTN; PAM sequence: TTC
ctgcgcttagttccagccct

SEQ ID NO: 18100 - DNA, 20 bp, Artificial Sequence
  Description of Artificial Sequence: Synthetic oligonucleotide
  Target: DMPK; (+) strand; PAM type: YTN; PAM sequence: CTG
cgcttagttccagccctgct

SEQ ID NO: 18101 - DNA, 20 bp, Artificial Sequence
  Description of Artificial Sequence: Synthetic oligonucleotide
  Target: DMPK; (+) strand; PAM type: YTN; PAM sequence: CTT
agttccagccctgctgacca

SEQ ID NO: 18102 - DNA, 20 bp, Artificial Sequence
  Description of Artificial Sequence: Synthetic oligonucleotide
  Target: DMPK; (+) strand; PAM type: YTN; PAM sequence: TTA
gttccagccctgctgaccag

SEQ ID NO: 18103 - DNA, 20 bp, Artificial Sequence
  Description of Artificial Sequence: Synthetic oligonucleotide
  Target: DMPK; (+) strand; PAM type: YTN; PAM sequence: TTC
cagccctgctgaccagacag

SEQ ID NO: 18104 - DNA, 20 bp, Artificial Sequence
  Description of Artificial Sequence: Synthetic oligonucleotide
  Target: DMPK; (+) strand; PAM type: YTN; PAM sequence: CTG
ctgaccagacaggcacggcc

SEQ ID NO: 18105 - DNA, 20 bp, Artificial Sequence
  Description of Artificial Sequence: Synthetic oligonucleotide
  Target: DMPK; (+) strand; PAM type: YTN; PAM sequence: CTG
accagacaggcacggccgcg

SEQ ID NO: 18106 - DNA, 20 bp, Artificial Sequence
  Description of Artificial Sequence: Synthetic oligonucleotide
  Target: DMPK; (+) strand; PAM type: YTN; PAM sequence: CTC
tggtgggggcgccgggaagt

SEQ ID NO: 18107 - DNA, 20 bp, Artificial Sequence
  Description of Artificial Sequence: Synthetic oligonucleotide
  Target: DMPK; (+) strand; PAM type: YTN; PAM sequence: CTG
gtgggggcgccgggaagttg

SEQ ID NO: 18108 - DNA, 20 bp, Artificial Sequence
  Description of Artificial Sequence: Synthetic oligonucleotide
  Target: DMPK; (+) strand; PAM type: YTN; PAM sequence: TTG
ggcaggaggccaggggagtc

SEQ ID NO: 18109 - DNA, 20 bp, Artificial Sequence
  Description of Artificial Sequence: Synthetic oligonucleotide
  Target: DMPK; (+) strand; PAM type: YTN; PAM sequence: CTG
gtgctggaggtggtggcagc

SEQ ID NO: 18110 - DNA, 20 bp, Artificial Sequence
  Description of Artificial Sequence: Synthetic oligonucleotide
  Target: DMPK; (+) strand; PAM type: YTN; PAM sequence: CTG
gaggtggtggcagcggcggg

SEQ ID NO: 18111 - DNA, 20 bp, Artificial Sequence
  Description of Artificial Sequence: Synthetic oligonucleotide
  Target: DMPK; (+) strand; PAM type: YTN; PAM sequence: CTG
ctgtgcagaaagggtgccta

SEQ ID NO: 18112 - DNA, 20 bp, Artificial Sequence
  Description of Artificial Sequence: Synthetic oligonucleotide
  Target: DMPK; (+) strand; PAM type: YTN; PAM sequence: CTG
tgcagaaagggtgcctaggg

SEQ ID NO: 18113 - DNA, 20 bp, Artificial Sequence
  Description of Artificial Sequence: Synthetic oligonucleotide
  Target: DMPK; (+) strand; PAM type: YTN; PAM sequence: CTA
gggcgtgagcctctgggaga

SEQ ID NO: 18114 - DNA, 20 bp, Artificial Sequence
  Description of Artificial Sequence: Synthetic oligonucleotide
  Target: DMPK; (+) strand; PAM type: YTN; PAM sequence: CTC
tgggagagcagggctggggg

SEQ ID NO: 18115 - DNA, 20 bp, Artificial Sequence
  Description of Artificial Sequence: Synthetic oligonucleotide
  Target: DMPK; (+) strand; PAM type: YTN; PAM sequence: CTG
ggagagcagggctgggggcc

SEQ ID NO: 18116 - DNA, 20 bp, Artificial Sequence
  Description of Artificial Sequence: Synthetic oligonucleotide
  Target: DMPK; (+) strand; PAM type: YTN; PAM sequence: CTG
ggggccaccgggaggcctcc

SEQ ID NO: 18117 - DNA, 20 bp, Artificial Sequence
  Description of Artificial Sequence: Synthetic oligonucleotide
  Target: DMPK; (+) strand; PAM type: YTN; PAM sequence: CTC
cctcaggcacggagatggcc

SEQ ID NO: 18118 - DNA, 20 bp, Artificial Sequence
  Description of Artificial Sequence: Synthetic oligonucleotide
  Target: DMPK; (+) strand; PAM type: YTN; PAM sequence: CTC
aggcacggagatggccgtct

SEQ ID NO: 18119 - DNA, 20 bp, Artificial Sequence
  Description of Artificial Sequence: Synthetic oligonucleotide
  Target: DMPK; (+) strand; PAM type: YTN; PAM sequence: CTC
tggcttcagtggcagggcca

SEQ ID NO: 18120 - DNA, 20 bp, Artificial Sequence
  Description of Artificial Sequence: Synthetic oligonucleotide
  Target: DMPK; (+) strand; PAM type: YTN; PAM sequence: CTG
gcttcagtggcagggccagg

SEQ ID NO: 18121 - DNA, 20 bp, Artificial Sequence
  Description of Artificial Sequence: Synthetic oligonucleotide
  Target: DMPK; (+) strand; PAM type: YTN; PAM sequence: CTT
cagtggcagggccaggccgg

SEQ ID NO: 18122 - DNA, 20 bp, Artificial Sequence
  Description of Artificial Sequence: Synthetic oligonucleotide
  Target: DMPK; (+) strand; PAM type: YTN; PAM sequence: TTC
agtggcagggccaggccggg

SEQ ID NO: 18123 - DNA, 20 bp, Artificial Sequence
  Description of Artificial Sequence: Synthetic oligonucleotide
  Target: DMPK; (+) strand; PAM type: YTN; PAM sequence: CTG
gcggcaggacctgggagacg

SEQ ID NO: 18124 - DNA, 20 bp, Artificial Sequence
  Description of Artificial Sequence: Synthetic oligonucleotide
  Target: DMPK; (+) strand; PAM type: YTN; PAM sequence: CTG
ggagacgagcatgctggtgg

SEQ ID NO: 18125 - DNA, 20 bp, Artificial Sequence
  Description of Artificial Sequence: Synthetic oligonucleotide
  Target: DMPK; (+) strand; PAM type: YTN; PAM sequence: CTG
gtggggaaggtggcggtgag

SEQ ID NO: 18126 - DNA, 20 bp, Artificial Sequence
  Description of Artificial Sequence: Synthetic oligonucleotide
  Target: DMPK; (+) strand; PAM type: YTN; PAM sequence: CTT
gccctgctgcagggccacac

SEQ ID NO: 18127 - DNA, 20 bp, Artificial Sequence
  Description of Artificial Sequence: Synthetic oligonucleotide
  Target: DMPK; (+) strand; PAM type: YTN; PAM sequence: TTG
ccctgctgcagggccacacc

SEQ ID NO: 18128 - DNA, 20 bp, Artificial Sequence
  Description of Artificial Sequence: Synthetic oligonucleotide
  Target: DMPK; (+) strand; PAM type: YTN; PAM sequence: CTG
ctgcagggccacacccgtca

SEQ ID NO: 18129 - DNA, 20 bp, Artificial Sequence
  Description of Artificial Sequence: Synthetic oligonucleotide
  Target: DMPK; (+) strand; PAM type: YTN; PAM sequence: CTG
cagggccacacccgtcacga

SEQ ID NO: 18130 - DNA, 20 bp, Artificial Sequence
  Description of Artificial Sequence: Synthetic oligonucleotide
  Target: DMPK; (+) strand; PAM type: YTN; PAM sequence: CTG
ccagacacagggttggccag

SEQ ID NO: 18131 - DNA, 20 bp, Artificial Sequence
  Description of Artificial Sequence: Synthetic oligonucleotide
  Target: DMPK; (+) strand; PAM type: YTN; PAM sequence: TTG
gccaggaggaagtttcctgt

SEQ ID NO: 18132 - DNA, 20 bp, Artificial Sequence
  Description of Artificial Sequence: Synthetic oligonucleotide
  Target: DMPK; (+) strand; PAM type: YTN; PAM sequence: TTT
cctgtggggagagagggacc

SEQ ID NO: 18133 - DNA, 20 bp, Artificial Sequence
  Description of Artificial Sequence: Synthetic oligonucleotide
  Target: DMPK; (+) strand; PAM type: YTN; PAM sequence: TTC
ctgtggggagagagggaccg

SEQ ID NO: 18134 - DNA, 20 bp, Artificial Sequence
  Description of Artificial Sequence: Synthetic oligonucleotide
  Target: DMPK; (+) strand; PAM type: YTN; PAM sequence: CTG
tggggagagagggaccgagc

SEQ ID NO: 18135 - DNA, 20 bp, Artificial Sequence
  Description of Artificial Sequence: Synthetic oligonucleotide
  Target: DMPK; (+) strand; PAM type: YTN; PAM sequence: CTG
tgcagctggagggcgggcgg

SEQ ID NO: 18136 - DNA, 20 bp, Artificial Sequence
  Description of Artificial Sequence: Synthetic oligonucleotide
  Target: DMPK; (+) strand; PAM type: YTN; PAM sequence: CTG
gagggcgggcggagggagcc

SEQ ID NO: 18137 - DNA, 20 bp, Artificial Sequence
  Description of Artificial Sequence: Synthetic oligonucleotide
  Target: DMPK; (+) strand; PAM type: YTN; PAM sequence: CTT
gtggtgggccttggggcact

SEQ ID NO: 18138 - DNA, 20 bp, Artificial Sequence
  Description of Artificial Sequence: Synthetic oligonucleotide
  Target: DMPK; (+) strand; PAM type: YTN; PAM sequence: TTG
tggtgggccttggggcactg

SEQ ID NO: 18139 - DNA, 20 bp, Artificial Sequence
  Description of Artificial Sequence: Synthetic oligonucleotide
  Target: DMPK; (+) strand; PAM type: YTN; PAM sequence: CTT
ggggcactgggacttgccag

SEQ ID NO: 18140 - DNA, 20 bp, Artificial Sequence
  Description of Artificial Sequence: Synthetic oligonucleotide
  Target: DMPK; (+) strand; PAM type: YTN; PAM sequence: TTG
gggcactgggacttgccagg

SEQ ID NO: 18141 - DNA, 20 bp, Artificial Sequence
  Description of Artificial Sequence: Synthetic oligonucleotide
  Target: DMPK; (+) strand; PAM type: YTN; PAM sequence: CTG
ggacttgccagggatgagat

SEQ ID NO: 18142 - DNA, 20 bp, Artificial Sequence
  Description of Artificial Sequence: Synthetic oligonucleotide
  Target: DMPK; (+) strand; PAM type: YTN; PAM sequence: CTT
gccagggatgagatgccctc

SEQ ID NO: 18143 - DNA, 20 bp, Artificial Sequence
  Description of Artificial Sequence: Synthetic oligonucleotide
  Target: DMPK; (+) strand; PAM type: YTN; PAM sequence: TTG
ccagggatgagatgccctcc

SEQ ID NO: 18144 - DNA, 20 bp, Artificial Sequence
  Description of Artificial Sequence: Synthetic oligonucleotide
  Target: DMPK; (+) strand; PAM type: YTN; PAM sequence: CTC
caggagcccagggacagccc

SEQ ID NO: 18145 - DNA, 20 bp, Artificial Sequence
  Description of Artificial Sequence: Synthetic oligonucleotide
  Target: DMPK; (+) strand; PAM type: YTN; PAM sequence: CTC
cctctccgagatgactgcac

SEQ ID NO: 18146 - DNA, 20 bp, Artificial Sequence
  Description of Artificial Sequence: Synthetic oligonucleotide
  Target: DMPK; (+) strand; PAM type: YTN; PAM sequence: CTC
tccgagatgactgcacccct

SEQ ID NO: 18147 - DNA, 20 bp, Artificial Sequence
  Description of Artificial Sequence: Synthetic oligonucleotide
  Target: DMPK; (+) strand; PAM type: YTN; PAM sequence: CTC
cgagatgactgcacccctcc

SEQ ID NO: 18148 - DNA, 20 bp, Artificial Sequence
  Description of Artificial Sequence: Synthetic oligonucleotide
  Target: DMPK; (+) strand; PAM type: YTN; PAM sequence: CTG
cacccctccccggctctcac

SEQ ID NO: 18149 - DNA, 20 bp, Artificial Sequence
  Description of Artificial Sequence: Synthetic oligonucleotide
  Target: DMPK; (+) strand; PAM type: YTN; PAM sequence: CTC
cccggctctcacctaggcct

SEQ ID NO: 18150 - DNA, 20 bp, Artificial Sequence
  Description of Artificial Sequence: Synthetic oligonucleotide
  Target: DMPK; (+) strand; PAM type: YTN; PAM sequence: CTC
tcacctaggcctgagggagg

SEQ ID NO: 18151 - DNA, 20 bp, Artificial Sequence
  Description of Artificial Sequence: Synthetic oligonucleotide
  Target: DMPK; (+) strand; PAM type: YTN; PAM sequence: CTC
acctaggcctgagggaggga

SEQ ID NO: 18152 - DNA, 20 bp, Artificial Sequence
  Description of Artificial Sequence: Synthetic oligonucleotide
  Target: DMPK; (+) strand; PAM type: YTN; PAM sequence: CTA
ggcctgagggagggagatgg

SEQ ID NO: 18153 - DNA, 20 bp, Artificial Sequence
  Description of Artificial Sequence: Synthetic oligonucleotide
  Target: DMPK; (+) strand; PAM type: YTN; PAM sequence: CTG
agggagggagatgggggtac

SEQ ID NO: 18154 - DNA, 20 bp, Artificial Sequence
  Description of Artificial Sequence: Synthetic oligonucleotide
  Target: DMPK; (+) strand; PAM type: YTN; PAM sequence: CTG
gggcagtggccgaaggcagc

SEQ ID NO: 18155 - DNA, 20 bp, Artificial Sequence
  Description of Artificial Sequence: Synthetic oligonucleotide
  Target: DMPK; (+) strand; PAM type: YTN; PAM sequence: CTG
cagggcagtcacgcccaccc

SEQ ID NO: 18156 - DNA, 20 bp, Artificial Sequence
  Description of Artificial Sequence: Synthetic oligonucleotide
  Target: DMPK; (+) strand; PAM type: YTN; PAM sequence: TTG
atgaggtgcacattggcagg

SEQ ID NO: 18157 - DNA, 20 bp, Artificial Sequence
  Description of Artificial Sequence: Synthetic oligonucleotide
  Target: DMPK; (+) strand; PAM type: YTN; PAM sequence: TTG
gcagggcctgctgcagctgc

SEQ ID NO: 18158 - DNA, 20 bp, Artificial Sequence
  Description of Artificial Sequence: Synthetic oligonucleotide
  Target: DMPK; (+) strand; PAM type: YTN; PAM sequence: CTG
ctgcagctgccaccttcaca

SEQ ID NO: 18159 - DNA, 20 bp, Artificial Sequence
  Description of Artificial Sequence: Synthetic oligonucleotide
  Target: DMPK; (+) strand; PAM type: YTN; PAM sequence: CTG
cagctgccaccttcacaggg

SEQ ID NO: 18160 - DNA, 20 bp, Artificial Sequence
  Description of Artificial Sequence: Synthetic oligonucleotide
  Target: DMPK; (+) strand; PAM type: YTN; PAM sequence: CTG
ccaccttcacagggctgcct

SEQ ID NO: 18161 - DNA, 20 bp, Artificial Sequence
  Description of Artificial Sequence: Synthetic oligonucleotide
  Target: DMPK; (+) strand; PAM type: YTN; PAM sequence: CTT
cacagggctgcctggcccgg

SEQ ID NO: 18162 - DNA, 20 bp, Artificial Sequence
  Description of Artificial Sequence: Synthetic oligonucleotide
  Target: DMPK; (+) strand; PAM type: YTN; PAM sequence: TTC
acagggctgcctggcccggc

SEQ ID NO: 18163 - DNA, 20 bp, Artificial Sequence
  Description of Artificial Sequence: Synthetic oligonucleotide
  Target: DMPK; (+) strand; PAM type: YTN; PAM sequence: CTG
cctggcccggctgccaacag

SEQ ID NO: 18164 - DNA, 20 bp, Artificial Sequence
  Description of Artificial Sequence: Synthetic oligonucleotide
  Target: DMPK; (+) strand; PAM type: YTN; PAM sequence: CTG
gcccggctgccaacagctgc

SEQ ID NO: 18165 - DNA, 20 bp, Artificial Sequence
  Description of Artificial Sequence: Synthetic oligonucleotide
  Target: DMPK; (+) strand; PAM type: YTN; PAM sequence: CTG
ccaacagctgcaggggcccc

SEQ ID NO: 18166 - DNA, 20 bp, Artificial Sequence
  Description of Artificial Sequence: Synthetic oligonucleotide
  Target: DMPK; (+) strand; PAM type: YTN; PAM sequence: CTG
caggggccccacagcctggg

SEQ ID NO: 18167 - DNA, 20 bp, Artificial Sequence
  Description of Artificial Sequence: Synthetic oligonucleotide
  Target: DMPK; (+) strand; PAM type: YTN; PAM sequence: CTG
gggcagggtcaccacctgtg

SEQ ID NO: 18168 - DNA, 20 bp, Artificial Sequence
  Description of Artificial Sequence: Synthetic oligonucleotide
  Target: DMPK; (+) strand; PAM type: YTN; PAM sequence: CTG
tgaggtgggtactacctggg

SEQ ID NO: 18169 - DNA, 20 bp, Artificial Sequence
  Description of Artificial Sequence: Synthetic oligonucleotide
  Target: DMPK; (+) strand; PAM type: YTN; PAM sequence: CTA
cctggggcaggttcaatagt

SEQ ID NO: 18170 - DNA, 20 bp, Artificial Sequence
  Description of Artificial Sequence: Synthetic oligonucleotide
  Target: DMPK; (+) strand; PAM type: YTN; PAM sequence: CTG
gggcaggttcaatagtgggg

SEQ ID NO: 18171 - DNA, 20 bp, Artificial Sequence
  Description of Artificial Sequence: Synthetic oligonucleotide
  Target: DMPK; (+) strand; PAM type: YTN; PAM sequence: TTC
aatagtggggaggtggggct

SEQ ID NO: 18172 - DNA, 20 bp, Artificial Sequence
  Description of Artificial Sequence: Synthetic oligonucleotide
  Target: DMPK; (+) strand; PAM type: YTN; PAM sequence: CTC
aggcccgtgggataccccgg

SEQ ID NO: 18173 - DNA, 20 bp, Artificial Sequence
  Description of Artificial Sequence: Synthetic oligonucleotide
  Target: DMPK; (+) strand; PAM type: YTN; PAM sequence: CTT
gtggggcagccacagcaggc

SEQ ID NO: 18174 - DNA, 20 bp, Artificial Sequence
  Description of Artificial Sequence: Synthetic oligonucleotide
  Target: DMPK; (+) strand; PAM type: YTN; PAM sequence: TTG
tggggcagccacagcaggca

SEQ ID NO: 18175 - DNA, 20 bp, Artificial Sequence
  Description of Artificial Sequence: Synthetic oligonucleotide
  Target: DMPK; (+) strand; PAM type: YTN; PAM sequence: CTG
gccccgggggcagaggaaag

SEQ ID NO: 18176 - DNA, 20 bp, Artificial Sequence
  Description of Artificial Sequence: Synthetic oligonucleotide
  Target: DMPK; (+) strand; PAM type: YTN; PAM sequence: CTT
gggccaggggccccaggacc

SEQ ID NO: 18177 - DNA, 20 bp, Artificial Sequence
  Description of Artificial Sequence: Synthetic oligonucleotide
  Target: DMPK; (+) strand; PAM type: YTN; PAM sequence: TTG
ggccaggggccccaggacct

SEQ ID NO: 18178 - DNA, 20 bp, Artificial Sequence
  Description of Artificial Sequence: Synthetic oligonucleotide
  Target: DMPK; (+) strand; PAM type: YTN; PAM sequence: CTC
ctctccaagggctggtcccg

SEQ ID NO: 18179 - DNA, 20 bp, Artificial Sequence
  Description of Artificial Sequence: Synthetic oligonucleotide
  Target: DMPK; (+) strand; PAM type: YTN; PAM sequence: CTC
tccaagggctggtcccggag

SEQ ID NO: 18180 - DNA, 20 bp, Artificial Sequence
  Description of Artificial Sequence: Synthetic oligonucleotide
  Target: DMPK; (+) strand; PAM type: YTN; PAM sequence: CTC
caagggctggtcccggagca

SEQ ID NO: 18181 - DNA, 20 bp, Artificial Sequence
  Description of Artificial Sequence: Synthetic oligonucleotide
  Target: DMPK; (+) strand; PAM type: YTN; PAM sequence: CTG
gtcccggagcagccacctgg

SEQ ID NO: 18182 - DNA, 20 bp, Artificial Sequence
  Description of Artificial Sequence: Synthetic oligonucleotide
  Target: DMPK; (+) strand; PAM type: YTN; PAM sequence: CTG
ggcccctttggtctcagggg

SEQ ID NO: 18183 - DNA, 20 bp, Artificial Sequence
  Description of Artificial Sequence: Synthetic oligonucleotide
  Target: DMPK; (+) strand; PAM type: YTN; PAM sequence: CTT
tggtctcaggggcctccgac

SEQ ID NO: 18184 - DNA, 20 bp, Artificial Sequence
  Description of Artificial Sequence: Synthetic oligonucleotide
  Target: DMPK; (+) strand; PAM type: YTN; PAM sequence: TTT
ggtctcaggggcctccgact

SEQ ID NO: 18185 - DNA, 20 bp, Artificial Sequence
  Description of Artificial Sequence: Synthetic oligonucleotide
  Target: DMPK; (+) strand; PAM type: YTN; PAM sequence: TTG
gtctcaggggcctccgactg

SEQ ID NO: 18186 - DNA, 20 bp, Artificial Sequence
  Description of Artificial Sequence: Synthetic oligonucleotide
  Target: DMPK; (+) strand; PAM type: YTN; PAM sequence: CTC
aggggcctccgactgagcct

SEQ ID NO: 18187 - DNA, 20 bp, Artificial Sequence
  Description of Artificial Sequence: Synthetic oligonucleotide
  Target: DMPK; (+) strand; PAM type: YTN; PAM sequence: CTC
cgactgagcctcctccagcc

SEQ ID NO: 18188 - DNA, 20 bp, Artificial Sequence
  Description of Artificial Sequence: Synthetic oligonucleotide
  Target: DMPK; (+) strand; PAM type: YTN; PAM sequence: CTG
agcctcctccagccgcacct

SEQ ID NO: 18189 - DNA, 20 bp, Artificial Sequence
  Description of Artificial Sequence: Synthetic oligonucleotide
  Target: DMPK; (+) strand; PAM type: YTN; PAM sequence: CTC
ctccagccgcacctcccctg

SEQ ID NO: 18190 - DNA, 20 bp, Artificial Sequence
  Description of Artificial Sequence: Synthetic oligonucleotide
  Target: DMPK; (+) strand; PAM type: YTN; PAM sequence: CTC
cagccgcacctcccctgtct

SEQ ID NO: 18191 - DNA, 20 bp, Artificial Sequence
  Description of Artificial Sequence: Synthetic oligonucleotide
  Target: DMPK; (+) strand; PAM type: YTN; PAM sequence: CTC
ccctgtctgagggtccagga

SEQ ID NO: 18192 - DNA, 20 bp, Artificial Sequence
  Description of Artificial Sequence: Synthetic oligonucleotide
  Target: DMPK; (+) strand; PAM type: YTN; PAM sequence: CTG
tctgagggtccaggaccaga

SEQ ID NO: 18193 - DNA, 20 bp, Artificial Sequence
  Description of Artificial Sequence: Synthetic oligonucleotide
  Target: DMPK; (+) strand; PAM type: YTN; PAM sequence: CTG
agggtccaggaccagagagg

SEQ ID NO: 18194 - DNA, 20 bp, Artificial Sequence
  Description of Artificial Sequence: Synthetic oligonucleotide
  Target: DMPK; (+) strand; PAM type: YTN; PAM sequence: CTT
ggtctcgctggccccctgag

SEQ ID NO: 18195 - DNA, 20 bp, Artificial Sequence
  Description of Artificial Sequence: Synthetic oligonucleotide
  Target: DMPK; (+) strand; PAM type: YTN; PAM sequence: TTG
gtctcgctggccccctgagg

SEQ ID NO: 18196 - DNA, 20 bp, Artificial Sequence
  Description of Artificial Sequence: Synthetic oligonucleotide
  Target: DMPK; (+) strand; PAM type: YTN; PAM sequence: CTC
gctggccccctgagggctgg

SEQ ID NO: 18197 - DNA, 20 bp, Artificial Sequence
  Description of Artificial Sequence: Synthetic oligonucleotide
  Target: DMPK; (+) strand; PAM type: YTN; PAM sequence: CTG
gccccctgagggctgggctg

SEQ ID NO: 18198 - DNA, 20 bp, Artificial Sequence
  Description of Artificial Sequence: Synthetic oligonucleotide
  Target: DMPK; (+) strand; PAM type: YTN; PAM sequence: CTG
agggctgggctgcggtggag

SEQ ID NO: 18199 - DNA, 20 bp, Artificial Sequence
  Description of Artificial Sequence: Synthetic oligonucleotide
  Target: DMPK; (+) strand; PAM type: YTN; PAM sequence: CTG
ggctgcggtggaggggcacc

SEQ ID NO: 18200 - DNA, 20 bp, Artificial Sequence
  Description of Artificial Sequence: Synthetic oligonucleotide
  Target: DMPK; (+) strand; PAM type: YTN; PAM sequence: CTG
cggtggaggggcacccccgc

SEQ ID NO: 18201 - DNA, 20 bp, Artificial Sequence
  Description of Artificial Sequence: Synthetic oligonucleotide
  Target: DMPK; (+) strand; PAM type: YTN; PAM sequence: CTG
gaggcctcgcccagggccag

SEQ ID NO: 18202 - DNA, 20 bp, Artificial Sequence
  Description of Artificial Sequence: Synthetic oligonucleotide
  Target: DMPK; (+) strand; PAM type: YTN; PAM sequence: CTC
gcccagggccaggccgttga

SEQ ID NO: 18203 - DNA, 20 bp, Artificial Sequence
  Description of Artificial Sequence: Synthetic oligonucleotide
  Target: DMPK; (+) strand; PAM type: YTN; PAM sequence: TTG
atgatgacggggcccccgtt

SEQ ID NO: 18204 - DNA, 20 bp, Artificial Sequence
  Description of Artificial Sequence: Synthetic oligonucleotide
  Target: DMPK; (+) strand; PAM type: YTN; PAM sequence: TTG
aggagcactgctggggagcc

SEQ ID NO: 18205 - DNA, 20 bp, Artificial Sequence
  Description of Artificial Sequence: Synthetic oligonucleotide
  Target: DMPK; (+) strand; PAM type: YTN; PAM sequence: CTG
ctggggagccgctggctgcc

SEQ ID NO: 18206 - DNA, 20 bp, Artificial Sequence
  Description of Artificial Sequence: Synthetic oligonucleotide
  Target: DMPK; (+) strand; PAM type: YTN; PAM sequence: CTG
gggagccgctggctgccagg

SEQ ID NO: 18207 - DNA, 20 bp, Artificial Sequence
  Description of Artificial Sequence: Synthetic oligonucleotide
  Target: DMPK; (+) strand; PAM type: YTN; PAM sequence: CTG
gctgccaggaagctcccgtt

SEQ ID NO: 18208 - DNA, 20 bp, Artificial Sequence
  Description of Artificial Sequence: Synthetic oligonucleotide
  Target: DMPK; (+) strand; PAM type: YTN; PAM sequence: CTG
ccaggaagctcccgttcacc

SEQ ID NO: 18209 - DNA, 20 bp, Artificial Sequence
  Description of Artificial Sequence: Synthetic oligonucleotide
  Target: DMPK; (+) strand; PAM type: YTN; PAM sequence: CTC
ccgttcaccaggatggagga

SEQ ID NO: 18210 - DNA, 20 bp, Artificial Sequence
  Description of Artificial Sequence: Synthetic oligonucleotide
  Target: DMPK; (+) strand; PAM type: YTN; PAM sequence: TTC
accaggatggaggaggaagc

SEQ ID NO: 18211 - DNA, 20 bp, Artificial Sequence
  Description of Artificial Sequence: Synthetic oligonucleotide
  Target: DMPK; (+) strand; PAM type: YTN; PAM sequence: CTG
ccaggaatatggagccctgg

SEQ ID NO: 18212 - DNA, 20 bp, Artificial Sequence
  Description of Artificial Sequence: Synthetic oligonucleotide
  Target: DMPK; (+) strand; PAM type: YTN; PAM sequence: CTG
ggcagcggcctcggcggaca

SEQ ID NO: 18213 - DNA, 20 bp, Artificial Sequence
  Description of Artificial Sequence: Synthetic oligonucleotide
  Target: DMPK; (+) strand; PAM type: YTN; PAM sequence: CTC
ggcggacactggggccgccc

SEQ ID NO: 18214 - DNA, 20 bp, Artificial Sequence
  Description of Artificial Sequence: Synthetic oligonucleotide
  Target: DMPK; (+) strand; PAM type: YTN; PAM sequence: CTG
gggccgcccctctctccagg

SEQ ID NO: 18215 - DNA, 20 bp, Artificial Sequence
  Description of Artificial Sequence: Synthetic oligonucleotide
  Target: DMPK; (+) strand; PAM type: YTN; PAM sequence: CTC
tctccaggtcctcaggactt

SEQ ID NO: 18216 - DNA, 20 bp, Artificial Sequence
  Description of Artificial Sequence: Synthetic oligonucleotide
  Target: DMPK; (+) strand; PAM type: YTN; PAM sequence: CTC
tccaggtcctcaggacttcg

SEQ ID NO: 18217 - DNA, 20 bp, Artificial Sequence
  Description of Artificial Sequence: Synthetic oligonucleotide
  Target: DMPK; (+) strand; PAM type: YTN; PAM sequence: CTC
caggtcctcaggacttcggc

SEQ ID NO: 18218 - DNA, 20 bp, Artificial Sequence
  Description of Artificial Sequence: Synthetic oligonucleotide
  Target: DMPK; (+) strand; PAM type: YTN; PAM sequence: CTC
aggacttcggctggactcgt

SEQ ID NO: 18219 - DNA, 20 bp, Artificial Sequence
  Description of Artificial Sequence: Synthetic oligonucleotide
  Target: DMPK; (+) strand; PAM type: YTN; PAM sequence: CTT
cggctggactcgtcctcagt

SEQ ID NO: 18220 - DNA, 20 bp, Artificial Sequence
  Description of Artificial Sequence: Synthetic oligonucleotide
  Target: DMPK; (+) strand; PAM type: YTN; PAM sequence: TTC
ggctggactcgtcctcagtc

SEQ ID NO: 18221 - DNA, 20 bp, Artificial Sequence
  Description of Artificial Sequence: Synthetic oligonucleotide
  Target: DMPK; (+) strand; PAM type: YTN; PAM sequence: CTG
gactcgtcctcagtcgtggg

SEQ ID NO: 18222 - DNA, 20 bp, Artificial Sequence
  Description of Artificial Sequence: Synthetic oligonucleotide
  Target: DMPK; (+) strand; PAM type: YTN; PAM sequence: CTC
gtcctcagtcgtgggattcc

SEQ ID NO: 18223 - DNA, 20 bp, Artificial Sequence
  Description of Artificial Sequence: Synthetic oligonucleotide
  Target: DMPK; (+) strand; PAM type: YTN; PAM sequence: CTC
agtcgtgggattcccatcag

SEQ ID NO: 18224 - DNA, 20 bp, Artificial Sequence
  Description of Artificial Sequence: Synthetic oligonucleotide
  Target: DMPK; (+) strand; PAM type: YTN; PAM sequence: TTC
ccatcagactcgctggccgg

SEQ ID NO: 18225 - DNA, 20 bp, Artificial Sequence
  Description of Artificial Sequence: Synthetic oligonucleotide
  Target: DMPK; (+) strand; PAM type: YTN; PAM sequence: CTC
gctggccggagaaatggctg

SEQ ID NO: 18226 - DNA, 20 bp, Artificial Sequence
  Description of Artificial Sequence: Synthetic oligonucleotide
  Target: DMPK; (+) strand; PAM type: YTN; PAM sequence: CTG
gccggagaaatggctgtcag

SEQ ID NO: 18227 - DNA, 20 bp, Artificial Sequence
  Description of Artificial Sequence: Synthetic oligonucleotide
  Target: DMPK; (+) strand; PAM type: YTN; PAM sequence: CTG
tcagctggggtcccttagcc

SEQ ID NO: 18228 - DNA, 20 bp, Artificial Sequence
  Description of Artificial Sequence: Synthetic oligonucleotide
  Target: DMPK; (+) strand; PAM type: YTN; PAM sequence: CTG
gggtcccttagcctgtgggg

SEQ ID NO: 18229 - DNA, 20 bp, Artificial Sequence
  Description of Artificial Sequence: Synthetic oligonucleotide
  Target: DMPK; (+) strand; PAM type: YTN; PAM sequence: CTT
agcctgtggggcctcccgca

SEQ ID NO: 18230 - DNA, 20 bp, Artificial Sequence
  Description of Artificial Sequence: Synthetic oligonucleotide
  Target: DMPK; (+) strand; PAM type: YTN; PAM sequence: TTA
gcctgtggggcctcccgcat

SEQ ID NO: 18231 - DNA, 20 bp, Artificial Sequence
  Description of Artificial Sequence: Synthetic oligonucleotide
  Target: DMPK; (+) strand; PAM type: YTN; PAM sequence: CTG
tggggcctcccgcatagcca

SEQ ID NO: 18232 - DNA, 20 bp, Artificial Sequence
  Description of Artificial Sequence: Synthetic oligonucleotide
  Target: DMPK; (+) strand; PAM type: YTN; PAM sequence: CTC
ccgcatagccagccagctgc

SEQ ID NO: 18233 - DNA, 20 bp, Artificial Sequence
  Description of Artificial Sequence: Synthetic oligonucleotide
  Target: DMPK; (+) strand; PAM type: YTN; PAM sequence: CTG
ctcccccacctttccctggc

SEQ ID NO: 18234 - DNA, 20 bp, Artificial Sequence
  Description of Artificial Sequence: Synthetic oligonucleotide
  Target: DMPK; (+) strand; PAM type: YTN; PAM sequence: CTC
ccccacctttccctggccca

SEQ ID NO: 18235 - DNA, 20 bp, Artificial Sequence
  Description of Artificial Sequence: Synthetic oligonucleotide
  Target: DMPK; (+) strand; PAM type: YTN; PAM sequence: CTT
tccctggcccaagtttcggt

SEQ ID NO: 18236 - DNA, 20 bp, Artificial Sequence
  Description of Artificial Sequence: Synthetic oligonucleotide
  Target: DMPK; (+) strand; PAM type: YTN; PAM sequence: TTT
ccctggcccaagtttcggtg

SEQ ID NO: 18237 - DNA, 20 bp, Artificial Sequence
  Description of Artificial Sequence: Synthetic oligonucleotide
  Target: DMPK; (+) strand; PAM type: YTN; PAM sequence: TTC
cctggcccaagtttcggtgg

SEQ ID NO: 18238 - DNA, 20 bp, Artificial Sequence
  Description of Artificial Sequence: Synthetic oligonucleotide
  Target: DMPK; (+) strand; PAM type: YTN; PAM sequence: CTG
gcccaagtttcggtggatca

SEQ ID NO: 18239 - DNA, 20 bp, Artificial Sequence
  Description of Artificial Sequence: Synthetic oligonucleotide
  Target: DMPK; (+) strand; PAM type: YTN; PAM sequence: TTT
cggtggatcattccaggggt

SEQ ID NO: 18240 - DNA, 20 bp, Artificial Sequence
  Description of Artificial Sequence: Synthetic oligonucleotide
  Target: DMPK; (+) strand; PAM type: YTN; PAM sequence: TTC
ggtggatcattccaggggtt

SEQ ID NO: 18241 - DNA, 20 bp, Artificial Sequence
  Description of Artificial Sequence: Synthetic oligonucleotide
  Target: DMPK; (+) strand; PAM type: YTN; PAM sequence: TTC
caggggttatgacgcctctc

SEQ ID NO: 18242 - DNA, 20 bp, Artificial Sequence
  Description of Artificial Sequence: Synthetic oligonucleotide
  Target: DMPK; (+) strand; PAM type: YTN; PAM sequence: TTA
tgacgcctctctgagaccac

SEQ ID NO: 18243 - DNA, 20 bp, Artificial Sequence
  Description of Artificial Sequence: Synthetic oligonucleotide
  Target: DMPK; (+) strand; PAM type: YTN; PAM sequence: CTC
tctgagaccactccaaactc

SEQ ID NO: 18244 - DNA, 20 bp, Artificial Sequence
  Description of Artificial Sequence: Synthetic oligonucleotide
  Target: DMPK; (+) strand; PAM type: YTN; PAM sequence: CTC
tgagaccactccaaactcca

SEQ ID NO: 18245 - DNA, 20 bp, Artificial Sequence
  Description of Artificial Sequence: Synthetic oligonucleotide
  Target: DMPK; (+) strand; PAM type: YTN; PAM sequence: CTG
agaccactccaaactccagg

SEQ ID NO: 18246 - DNA, 20 bp, Artificial Sequence
  Description of Artificial Sequence: Synthetic oligonucleotide
  Target: DMPK; (+) strand; PAM type: YTN; PAM sequence: CTC
caaactccagggccttttgc

SEQ ID NO: 18247 - DNA, 20 bp, Artificial Sequence
  Description of Artificial Sequence: Synthetic oligonucleotide
  Target: DMPK; (+) strand; PAM type: YTN; PAM sequence: CTC
cagggccttttgcaagccct

SEQ ID NO: 18248 - DNA, 20 bp, Artificial Sequence
  Description of Artificial Sequence: Synthetic oligonucleotide
  Target: DMPK; (+) strand; PAM type: YTN; PAM sequence: CTT
ttgcaagccctgcgtggaca

SEQ ID NO: 18249 - DNA, 20 bp, Artificial Sequence
  Description of Artificial Sequence: Synthetic oligonucleotide
  Target: DMPK; (+) strand; PAM type: YTN; PAM sequence: TTT
tgcaagccctgcgtggacac

SEQ ID NO: 18250 - DNA, 20 bp, Artificial Sequence
  Description of Artificial Sequence: Synthetic oligonucleotide
  Target: DMPK; (+) strand; PAM type: YTN; PAM sequence: TTT
gcaagccctgcgtggacacc

SEQ ID NO: 18251 - DNA, 20 bp, Artificial Sequence
  Description of Artificial Sequence: Synthetic oligonucleotide
  Target: DMPK; (+) strand; PAM type: YTN; PAM sequence: TTG
caagccctgcgtggacacca

SEQ ID NO: 18252 - DNA, 20 bp, Artificial Sequence
  Description of Artificial Sequence: Synthetic oligonucleotide
  Target: DMPK; (+) strand; PAM type: YTN; PAM sequence: CTG
cgtggacaccactgcagaga

SEQ ID NO: 18253 - DNA, 20 bp, Artificial Sequence
  Description of Artificial Sequence: Synthetic oligonucleotide
  Target: DMPK; (+) strand; PAM type: YTN; PAM sequence: CTG
cagagaagcgctggggaggg

SEQ ID NO: 18254 - DNA, 20 bp, Artificial Sequence
  Description of Artificial Sequence: Synthetic oligonucleotide
  Target: DMPK; (+) strand; PAM type: YTN; PAM sequence: CTG
gggagggaagaggcccttgc

SEQ ID NO: 18255 - DNA, 20 bp, Artificial Sequence
  Description of Artificial Sequence: Synthetic oligonucleotide
  Target: DMPK; (+) strand; PAM type: YTN; PAM sequence: CTT
gctctcccccacctcggcct

SEQ ID NO: 18256 - DNA, 20 bp, Artificial Sequence
  Description of Artificial Sequence: Synthetic oligonucleotide
  Target: DMPK; (+) strand; PAM type: YTN; PAM sequence: TTG
ctctcccccacctcggcctc

SEQ ID NO: 18257 - DNA, 20 bp, Artificial Sequence
  Description of Artificial Sequence: Synthetic oligonucleotide
  Target: DMPK; (+) strand; PAM type: YTN; PAM sequence: CTC
tcccccacctcggcctcggg

SEQ ID NO: 18258 - DNA, 20 bp, Artificial Sequence
  Description of Artificial Sequence: Synthetic oligonucleotide
  Target: DMPK; (+) strand; PAM type: YTN; PAM sequence: CTC
ccccacctcggcctcgggtc

SEQ ID NO: 18259 - DNA, 20 bp, Artificial Sequence
  Description of Artificial Sequence: Synthetic oligonucleotide
  Target: DMPK; (+) strand; PAM type: YTN; PAM sequence: CTC
ggcctcgggtccccagaggc

SEQ ID NO: 18260 - DNA, 20 bp, Artificial Sequence
  Description of Artificial Sequence: Synthetic oligonucleotide
  Target: DMPK; (+) strand; PAM type: YTN; PAM sequence: CTC
gggtccccagaggctgagct

SEQ ID NO: 18261 - DNA, 20 bp, Artificial Sequence
  Description of Artificial Sequence: Synthetic oligonucleotide
  Target: DMPK; (+) strand; PAM type: YTN; PAM sequence: CTG
agctcccaggttgccctaaa

SEQ ID NO: 18262 - DNA, 20 bp, Artificial Sequence
  Description of Artificial Sequence: Synthetic oligonucleotide
  Target: DMPK; (+) strand; PAM type: YTN; PAM sequence: CTC
ccaggttgccctaaaagttc

SEQ ID NO: 18263 - DNA, 20 bp, Artificial Sequence
  Description of Artificial Sequence: Synthetic oligonucleotide
  Target: DMPK; (+) strand; PAM type: YTN; PAM sequence: TTG
ccctaaaagttccttggttg

SEQ ID NO: 18264 - DNA, 20 bp, Artificial Sequence
  Description of Artificial Sequence: Synthetic oligonucleotide
  Target: DMPK; (+) strand; PAM type: YTN; PAM sequence: CTA
aaagttccttggttgggcgg

SEQ ID NO: 18265 - DNA, 20 bp, Artificial Sequence
  Description of Artificial Sequence: Synthetic oligonucleotide
  Target: DMPK; (+) strand; PAM type: YTN; PAM sequence: TTC
cttggttgggcggaaagcgg

SEQ ID NO: 18266 - DNA, 20 bp, Artificial Sequence
  Description of Artificial Sequence: Synthetic oligonucleotide
  Target: DMPK; (+) strand; PAM type: YTN; PAM sequence: CTT
ggttgggcggaaagcgggcg

SEQ ID NO: 18267 - DNA, 20 bp, Artificial Sequence
  Description of Artificial Sequence: Synthetic oligonucleotide
  Target: DMPK; (+) strand; PAM type: YTN; PAM sequence: TTG
gttgggcggaaagcgggcga

SEQ ID NO: 18268 - DNA, 20 bp, Artificial Sequence
  Description of Artificial Sequence: Synthetic oligonucleotide
  Target: DMPK; (+) strand; PAM type: YTN; PAM sequence: TTG
ggcggaaagcgggcgagtgg

SEQ ID NO: 18269 - DNA, 20 bp, Artificial Sequence
  Description of Artificial Sequence: Synthetic oligonucleotide
  Target: DMPK; (+) strand; PAM type: YTN; PAM sequence: CTG
gagagagggagcagcagccg

SEQ ID NO: 18270 - DNA, 20 bp, Artificial Sequence
  Description of Artificial Sequence: Synthetic oligonucleotide
  Target: DMPK; (+) strand; PAM type: YTN; PAM sequence: TTC
ccggtgccctccccgcgggg

SEQ ID NO: 18271 - DNA, 20 bp, Artificial Sequence
  Description of Artificial Sequence: Synthetic oligonucleotide
  Target: DMPK; (+) strand; PAM type: YTN; PAM sequence: CTC
cccgcggggcgtcagagaag

SEQ ID NO: 18272 - DNA, 20 bp, Artificial Sequence
  Description of Artificial Sequence: Synthetic oligonucleotide
  Target: DMPK; (+) strand; PAM type: YTN; PAM sequence: CTC
agggtgggaggagaagggtt

SEQ ID NO: 18273 - DNA, 20 bp, Artificial Sequence
  Description of Artificial Sequence: Synthetic oligonucleotide
  Target: DMPK; (+) strand; PAM type: YTN; PAM sequence: TTT
gggttacagggaaaccggag

SEQ ID NO: 18274 - DNA, 20 bp, Artificial Sequence
  Description of Artificial Sequence: Synthetic oligonucleotide
  Target: DMPK; (+) strand; PAM type: YTN; PAM sequence: TTG
ggttacagggaaaccggagc

SEQ ID NO: 18275 - DNA, 20 bp, Artificial Sequence
  Description of Artificial Sequence: Synthetic oligonucleotide
  Target: DMPK; (+) strand; PAM type: YTN; PAM sequence: TTA
cagggaaaccggagctggga

SEQ ID NO: 18276 - DNA, 20 bp, Artificial Sequence
  Description of Artificial Sequence: Synthetic oligonucleotide
  Target: DMPK; (+) strand; PAM type: YTN; PAM sequence: CTG
ggaaaggttcacgtttcaca

SEQ ID NO: 18277 - DNA, 20 bp, Artificial Sequence
  Description of Artificial Sequence: Synthetic oligonucleotide
  Target: DMPK; (+) strand; PAM type: YTN; PAM sequence: TTC
acgtttcacaacaaaggcag

SEQ ID NO: 18278 - DNA, 20 bp, Artificial Sequence
  Description of Artificial Sequence: Synthetic oligonucleotide
  Target: DMPK; (+) strand; PAM type: YTN; PAM sequence: TTT
cacaacaaaggcagaagacg

SEQ ID NO: 18279 - DNA, 20 bp, Artificial Sequence
  Description of Artificial Sequence: Synthetic oligonucleotide
  Target: DMPK; (+) strand; PAM type: YTN; PAM sequence: TTC
acaacaaaggcagaagacgg

SEQ ID NO: 18280 - DNA, 20 bp, Artificial Sequence
  Description of Artificial Sequence: Synthetic oligonucleotide
  Target: DMPK; (+) strand; PAM type: YTN; PAM sequence: CTG
ggaggcagcccctacgcgga

SEQ ID NO: 18281 - DNA, 20 bp, Artificial Sequence
  Description of Artificial Sequence: Synthetic oligonucleotide
  Target: DMPK; (+) strand; PAM type: YTN; PAM sequence: CTA
cgcggagtggagtggccaca

SEQ ID NO: 18282 - DNA, 20 bp, Artificial Sequence
  Description of Artificial Sequence: Synthetic oligonucleotide
  Target: DMPK; (+) strand; PAM type: YTN; PAM sequence: CTG
tcctttttcctcagtccctc

SEQ ID NO: 18283 - DNA, 20 bp, Artificial Sequence
  Description of Artificial Sequence: Synthetic oligonucleotide
  Target: DMPK; (+) strand; PAM type: YTN; PAM sequence: CTT
tttcctcagtccctctagtg

SEQ ID NO: 18284 - DNA, 20 bp, Artificial Sequence
  Description of Artificial Sequence: Synthetic oligonucleotide
  Target: DMPK; (+) strand; PAM type: YTN; PAM sequence: TTT
ttcctcagtccctctagtgc

SEQ ID NO: 18285 - DNA, 20 bp, Artificial Sequence
  Description of Artificial Sequence: Synthetic oligonucleotide
  Target: DMPK; (+) strand; PAM type: YTN; PAM sequence: TTT
tcctcagtccctctagtgcc

SEQ ID NO: 18286 - DNA, 20 bp, Artificial Sequence
  Description of Artificial Sequence: Synthetic oligonucleotide
  Target: DMPK; (+) strand; PAM type: YTN; PAM sequence: TTT
cctcagtccctctagtgccc

SEQ ID NO: 18287 - DNA, 20 bp, Artificial Sequence
  Description of Artificial Sequence: Synthetic oligonucleotide
  Target: DMPK; (+) strand; PAM type: YTN; PAM sequence: TTC
ctcagtccctctagtgcccc

SEQ ID NO: 18288 - DNA, 20 bp, Artificial Sequence
  Description of Artificial Sequence: Synthetic oligonucleotide
  Target: DMPK; (+) strand; PAM type: YTN; PAM sequence: CTC
agtccctctagtgccccccg

SEQ ID NO: 18289 - DNA, 20 bp, Artificial Sequence
  Description of Artificial Sequence: Synthetic oligonucleotide
  Target: DMPK; (+) strand; PAM type: YTN; PAM sequence: CTC
tagtgccccccgcagtgtga

SEQ ID NO: 18290 - DNA, 20 bp, Artificial Sequence
  Description of Artificial Sequence: Synthetic oligonucleotide
  Target: DMPK; (+) strand; PAM type: YTN; PAM sequence: CTA
gtgccccccgcagtgtgatt

SEQ ID NO: 18291 - DNA, 20 bp, Artificial Sequence
  Description of Artificial Sequence: Synthetic oligonucleotide
  Target: DMPK; (+) strand; PAM type: YTN; PAM sequence: TTC
cccaacaccgatgggatttg

SEQ ID NO: 18292 - DNA, 20 bp, Artificial Sequence
  Description of Artificial Sequence: Synthetic oligonucleotide
  Target: DMPK; (+) strand; PAM type: YTN; PAM sequence: TTT
gggaaggagctcggaatgga

SEQ ID NO: 18293 - DNA, 20 bp, Artificial Sequence
  Description of Artificial Sequence: Synthetic oligonucleotide
  Target: DMPK; (+) strand; PAM type: YTN; PAM sequence: TTG
ggaaggagctcggaatggag

SEQ ID NO: 18294 - DNA, 20 bp, Artificial Sequence
  Description of Artificial Sequence: Synthetic oligonucleotide
  Target: DMPK; (+) strand; PAM type: YTN; PAM sequence: CTC
ggaatggagccgctggaaga

SEQ ID NO: 18295 - DNA, 20 bp, Artificial Sequence
  Description of Artificial Sequence: Synthetic oligonucleotide
  Target: DMPK; (+) strand; PAM type: YTN; PAM sequence: CTG
gaagaggagacgcgtgcggg

SEQ ID NO: 18296 - DNA, 20 bp, Artificial Sequence
  Description of Artificial Sequence: Synthetic oligonucleotide
  Target: DMPK; (+) strand; PAM type: YTN; PAM sequence: CTG
tcccgtccacacttagtccc

SEQ ID NO: 18297 - DNA, 20 bp, Artificial Sequence
  Description of Artificial Sequence: Synthetic oligonucleotide
  Target: DMPK; (+) strand; PAM type: YTN; PAM sequence: CTT
agtccccgcgccccgcgggc

SEQ ID NO: 18298 - DNA, 20 bp, Artificial Sequence
  Description of Artificial Sequence: Synthetic oligonucleotide
  Target: DMPK; (+) strand; PAM type: YTN; PAM sequence: TTA
gtccccgcgccccgcgggcg

SEQ ID NO: 18299 - DNA, 20 bp, Artificial Sequence
  Description of Artificial Sequence: Synthetic oligonucleotide
  Target: DMPK; (+) strand; PAM type: YTN; PAM sequence: CTG
agattgtgagctggtcccgg

SEQ ID NO: 18300 - DNA, 20 bp, Artificial Sequence
  Description of Artificial Sequence: Synthetic oligonucleotide
  Target: DMPK; (+) strand; PAM type: YTN; PAM sequence: TTG
tgagctggtcccgggagatg

SEQ ID NO: 18301 - DNA, 20 bp, Artificial Sequence
  Description of Artificial Sequence: Synthetic oligonucleotide
  Target: DMPK; (+) strand; PAM type: YTN; PAM sequence: CTG
gtcccgggagatgtccgagg

SEQ ID NO: 18302 - DNA, 20 bp, Artificial Sequence
  Description of Artificial Sequence: Synthetic oligonucleotide
  Target: DMPK; (+) strand; PAM type: YTN; PAM sequence: CTC
ggcgcgccggccccagcagt

SEQ ID NO: 18303 - DNA, 20 bp, Artificial Sequence
  Description of Artificial Sequence: Synthetic oligonucleotide
  Target: DMPK; (+) strand; PAM type: YTN; PAM sequence: CTG
gtggacgggatgtccccggg

SEQ ID NO: 18304 - DNA, 20 bp, Artificial Sequence
  Description of Artificial Sequence: Synthetic oligonucleotide
  Target: DMPK; (+) strand; PAM type: YTN; PAM sequence: CTG
gacttgcgccgcccgaggcc

SEQ ID NO: 18305 - DNA, 20 bp, Artificial Sequence
  Description of Artificial Sequence: Synthetic oligonucleotide
  Target: DMPK; (+) strand; PAM type: YTN; PAM sequence: CTT
gcgccgcccgaggcccctca

SEQ ID NO: 18306 - DNA, 20 bp, Artificial Sequence
  Description of Artificial Sequence: Synthetic oligonucleotide
  Target: DMPK; (+) strand; PAM type: YTN; PAM sequence: TTG
cgccgcccgaggcccctcac

SEQ ID NO: 18307 - DNA, 20 bp, Artificial Sequence
  Description of Artificial Sequence: Synthetic oligonucleotide
  Target: DMPK; (+) strand; PAM type: YTN; PAM sequence: CTC
acctcttgcagggcgcgccg

SEQ ID NO: 18308 - DNA, 20 bp, Artificial Sequence
  Description of Artificial Sequence: Synthetic oligonucleotide
  Target: DMPK; (+) strand; PAM type: YTN; PAM sequence: CTC
ttgcagggcgcgccgcctcc

SEQ ID NO: 18309 - DNA, 20 bp, Artificial Sequence
  Description of Artificial Sequence: Synthetic oligonucleotide
  Target: DMPK; (+) strand; PAM type: YTN; PAM sequence: CTT
gcagggcgcgccgcctccgg

SEQ ID NO: 18310 - DNA, 20 bp, Artificial Sequence
  Description of Artificial Sequence: Synthetic oligonucleotide
  Target: DMPK; (+) strand; PAM type: YTN; PAM sequence: TTG
cagggcgcgccgcctccggc

SEQ ID NO: 18311 - DNA, 20 bp, Artificial Sequence
  Description of Artificial Sequence: Synthetic oligonucleotide
  Target: DMPK; (+) strand; PAM type: YTN; PAM sequence: CTC
cggccccggtccggtcgcgc

SEQ ID NO: 18312 - DNA, 20 bp, Artificial Sequence
  Description of Artificial Sequence: Synthetic oligonucleotide
  Target: DMPK; (+) strand; PAM type: YTN; PAM sequence: CTG
tcgccggttcttgaaccagt

SEQ ID NO: 18313 - DNA, 20 bp, Artificial Sequence
  Description of Artificial Sequence: Synthetic oligonucleotide
  Target: DMPK; (+) strand; PAM type: YTN; PAM sequence: TTC
ttgaaccagttgctgacctg

SEQ ID NO: 18314 - DNA, 20 bp, Artificial Sequence
  Description of Artificial Sequence: Synthetic oligonucleotide
  Target: DMPK; (+) strand; PAM type: YTN; PAM sequence: CTT
gaaccagttgctgacctgcg

SEQ ID NO: 18315 - DNA, 20 bp, Artificial Sequence
  Description of Artificial Sequence: Synthetic oligonucleotide
  Target: DMPK; (+) strand; PAM type: YTN; PAM sequence: TTG
aaccagttgctgacctgcgt

SEQ ID NO: 18316 - DNA, 20 bp, Artificial Sequence
  Description of Artificial Sequence: Synthetic oligonucleotide
  Target: DMPK; (+) strand; PAM type: YTN; PAM sequence: TTG
ctgacctgcgtgagcgacag

SEQ ID NO: 18317 - DNA, 20 bp, Artificial Sequence
  Description of Artificial Sequence: Synthetic oligonucleotide
  Target: DMPK; (+) strand; PAM type: YTN; PAM sequence: CTG
acctgcgtgagcgacaggcc

SEQ ID NO: 18318 - DNA, 20 bp, Artificial Sequence
  Description of Artificial Sequence: Synthetic oligonucleotide
  Target: DMPK; (+) strand; PAM type: YTN; PAM sequence: CTG
cgtgagcgacaggccggtga

SEQ ID NO: 18319 - DNA, 20 bp, Artificial Sequence
  Description of Artificial Sequence: Synthetic oligonucleotide
  Target: DMPK; (+) strand; PAM type: YTN; PAM sequence: CTT
ctcgtccggcgtggggtagc

SEQ ID NO: 18320 - DNA, 20 bp, Artificial Sequence
  Description of Artificial Sequence: Synthetic oligonucleotide
  Target: DMPK; (+) strand; PAM type: YTN; PAM sequence: TTC
tcgtccggcgtggggtagcg

SEQ ID NO: 18321 - DNA, 20 bp, Artificial Sequence
  Description of Artificial Sequence: Synthetic oligonucleotide
  Target: DMPK; (+) strand; PAM type: YTN; PAM sequence: CTC
gtccggcgtggggtagcggt

SEQ ID NO: 18322 - DNA, 20 bp, Artificial Sequence
  Description of Artificial Sequence: Synthetic oligonucleotide
  Target: DMPK; (+) strand; PAM type: YTN; PAM sequence: TTG
ccgcggtagcaggccttgag

SEQ ID NO: 18323 - DNA, 20 bp, Artificial Sequence
  Description of Artificial Sequence: Synthetic oligonucleotide
  Target: DMPK; (+) strand; PAM type: YTN; PAM sequence: CTT
gagcgctgcgcgggagcgct

SEQ ID NO: 18324 - DNA, 20 bp, Artificial Sequence
  Description of Artificial Sequence: Synthetic oligonucleotide
  Target: DMPK; (+) strand; PAM type: YTN; PAM sequence: TTG
agcgctgcgcgggagcgctc

SEQ ID NO: 18325 - DNA, 20 bp, Artificial Sequence
  Description of Artificial Sequence: Synthetic oligonucleotide
  Target: DMPK; (+) strand; PAM type: YTN; PAM sequence: CTG
cgcgggagcgctccttgaag

SEQ ID NO: 18326 - DNA, 20 bp, Artificial Sequence
  Description of Artificial Sequence: Synthetic oligonucleotide
  Target: DMPK; (+) strand; PAM type: YTN; PAM sequence: CTC
cttgaagcagtagactgtct

SEQ ID NO: 18327 - DNA, 20 bp, Artificial Sequence
  Description of Artificial Sequence: Synthetic oligonucleotide
  Target: DMPK; (+) strand; PAM type: YTN; PAM sequence: CTT
gaagcagtagactgtctcct

SEQ ID NO: 18328 - DNA, 20 bp, Artificial Sequence
  Description of Artificial Sequence: Synthetic oligonucleotide
  Target: DMPK; (+) strand; PAM type: YTN; PAM sequence: TTG
aagcagtagactgtctcctc

SEQ ID NO: 18329 - DNA, 20 bp, Artificial Sequence
  Description of Artificial Sequence: Synthetic oligonucleotide
  Target: DMPK; (+) strand; PAM type: YTN; PAM sequence: CTG
tctcctcgccgtcccagatg

SEQ ID NO: 18330 - DNA, 20 bp, Artificial Sequence
  Description of Artificial Sequence: Synthetic oligonucleotide
  Target: DMPK; (+) strand; PAM type: YTN; PAM sequence: CTC
ctcgccgtcccagatggtct

SEQ ID NO: 18331 - DNA, 20 bp, Artificial Sequence
  Description of Artificial Sequence: Synthetic oligonucleotide
  Target: DMPK; (+) strand; PAM type: YTN; PAM sequence: CTC
gccgtcccagatggtcttgg

SEQ ID NO: 18332 - DNA, 20 bp, Artificial Sequence
  Description of Artificial Sequence: Synthetic oligonucleotide
  Target: DMPK; (+) strand; PAM type: YTN; PAM sequence: CTT
gggcagcgggaacttcttgc

SEQ ID NO: 18333 - DNA, 20 bp, Artificial Sequence
  Description of Artificial Sequence: Synthetic oligonucleotide
  Target: DMPK; (+) strand; PAM type: YTN; PAM sequence: TTG
ggcagcgggaacttcttgcg

SEQ ID NO: 18334 - DNA, 20 bp, Artificial Sequence
  Description of Artificial Sequence: Synthetic oligonucleotide
  Target: DMPK; (+) strand; PAM type: YTN; PAM sequence: CTT
cttgcgcagtcgatacttgt

SEQ ID NO: 18335 - DNA, 20 bp, Artificial Sequence
  Description of Artificial Sequence: Synthetic oligonucleotide
  Target: DMPK; (+) strand; PAM type: YTN; PAM sequence: TTC
ttgcgcagtcgatacttgtc

SEQ ID NO: 18336 - DNA, 20 bp, Artificial Sequence
  Description of Artificial Sequence: Synthetic oligonucleotide
  Target: DMPK; (+) strand; PAM type: YTN; PAM sequence: CTT
gcgcagtcgatacttgtcca

SEQ ID NO: 18337 - DNA, 20 bp, Artificial Sequence
  Description of Artificial Sequence: Synthetic oligonucleotide
  Target: DMPK; (+) strand; PAM type: YTN; PAM sequence: TTG
cgcagtcgatacttgtccac

SEQ ID NO: 18338 - DNA, 20 bp, Artificial Sequence
  Description of Artificial Sequence: Synthetic oligonucleotide
  Target: DMPK; (+) strand; PAM type: YTN; PAM sequence: CTT
gtccactgcgccaagcgcgc

SEQ ID NO: 18339 - DNA, 20 bp, Artificial Sequence
  Description of Artificial Sequence: Synthetic oligonucleotide
  Target: DMPK; (+) strand; PAM type: YTN; PAM sequence: TTG
tccactgcgccaagcgcgcg

SEQ ID NO: 18340 - DNA, 20 bp, Artificial Sequence
  Description of Artificial Sequence: Synthetic oligonucleotide
  Target: DMPK; (+) strand; PAM type: YTN; PAM sequence: CTG
cgccaagcgcgcggccgcgg

SEQ ID NO: 18341 - DNA, 20 bp, Artificial Sequence
  Description of Artificial Sequence: Synthetic oligonucleotide
  Target: DMPK; (+) strand; PAM type: YTN; PAM sequence: CTC
ggcctcatggtagcgcgcgc

SEQ ID NO: 18342 - DNA, 20 bp, Artificial Sequence
  Description of Artificial Sequence: Synthetic oligonucleotide
  Target: DMPK; (+) strand; PAM type: YTN; PAM sequence: CTC
atggtagcgcgcgcgcaggt

SEQ ID NO: 18343 - DNA, 20 bp, Artificial Sequence
  Description of Artificial Sequence: Synthetic oligonucleotide
  Target: DMPK; (+) strand; PAM type: YTN; PAM sequence: CTG
caggaaggcgtggtgggcgg

SEQ ID NO: 18344 - DNA, 20 bp, Artificial Sequence
  Description of Artificial Sequence: Synthetic oligonucleotide
  Target: DMPK; (+) strand; PAM type: YTN; PAM sequence: CTC
tcgagtagccggtagagctc

SEQ ID NO: 18345 - DNA, 20 bp, Artificial Sequence
  Description of Artificial Sequence: Synthetic oligonucleotide
  Target: DMPK; (+) strand; PAM type: YTN; PAM sequence: CTC
gagtagccggtagagctcgg

SEQ ID NO: 18346 - DNA, 20 bp, Artificial Sequence
  Description of Artificial Sequence: Synthetic oligonucleotide
  Target: DMPK; (+) strand; PAM type: YTN; PAM sequence: CTC
ggcgtactcgccccgctgga

SEQ ID NO: 18347 - DNA, 20 bp, Artificial Sequence
  Description of Artificial Sequence: Synthetic oligonucleotide
  Target: DMPK; (+) strand; PAM type: YTN; PAM sequence: CTC
gccccgctggaaggccacca

SEQ ID NO: 18348 - DNA, 20 bp, Artificial Sequence
  Description of Artificial Sequence: Synthetic oligonucleotide
  Target: DMPK; (+) strand; PAM type: YTN; PAM sequence: CTG
gaaggccaccagggcccgcg

SEQ ID NO: 18349 - DNA, 20 bp, Artificial Sequence
  Description of Artificial Sequence: Synthetic oligonucleotide
  Target: DMPK; (+) strand; PAM type: YTN; PAM sequence: CTG
ccacgtaggcgctcggccgg

SEQ ID NO: 18350 - DNA, 20 bp, Artificial Sequence
  Description of Artificial Sequence: Synthetic oligonucleotide
  Target: DMPK; (+) strand; PAM type: YTN; PAM sequence: CTC
ggccgggggcagtgcgccca

SEQ ID NO: 18351 - DNA, 20 bp, Artificial Sequence
  Description of Artificial Sequence: Synthetic oligonucleotide
  Target: DMPK; (+) strand; PAM type: YTN; PAM sequence: CTC
aagcggccggcgtggcccgc

SEQ ID NO: 18352 - DNA, 20 bp, Artificial Sequence
  Description of Artificial Sequence: Synthetic oligonucleotide
  Target: DMPK; (+) strand; PAM type: YTN; PAM sequence: CTG
gagcagcgcctcgcagacgc

SEQ ID NO: 18353 - DNA, 20 bp, Artificial Sequence
  Description of Artificial Sequence: Synthetic oligonucleotide
  Target: DMPK; (+) strand; PAM type: YTN; PAM sequence: CTC
gcagacgcacgccacctgct

SEQ ID NO: 18354 - DNA, 20 bp, Artificial Sequence
  Description of Artificial Sequence: Synthetic oligonucleotide
  Target: DMPK; (+) strand; PAM type: YTN; PAM sequence: CTG
ctcgggcgagaagcggaggc

SEQ ID NO: 18355 - DNA, 20 bp, Artificial Sequence
  Description of Artificial Sequence: Synthetic oligonucleotide
  Target: DMPK; (+) strand; PAM type: YTN; PAM sequence: CTC
gggcgagaagcggaggcccg

SEQ ID NO: 18356 - DNA, 20 bp, Artificial Sequence
  Description of Artificial Sequence: Synthetic oligonucleotide
  Target: DMPK; (+) strand; PAM type: YTN; PAM sequence: TTC
ggaagcggcctcggggggcg

SEQ ID NO: 18357 - DNA, 20 bp, Artificial Sequence
  Description of Artificial Sequence: Synthetic oligonucleotide
  Target: DMPK; (+) strand; PAM type: YTN; PAM sequence: CTC
ggggggcgacccggggacgc

SEQ ID NO: 18358 - DNA, 20 bp, Artificial Sequence
  Description of Artificial Sequence: Synthetic oligonucleotide
  Target: DMPK; (+) strand; PAM type: YTN; PAM sequence: CTC
agctcccgcagccgctgcgc

SEQ ID NO: 18359 - DNA, 20 bp, Artificial Sequence
  Description of Artificial Sequence: Synthetic oligonucleotide
  Target: DMPK; (+) strand; PAM type: YTN; PAM sequence: CTC
ccgcagccgctgcgcccgcc

SEQ ID NO: 18360 - DNA, 20 bp, Artificial Sequence
  Description of Artificial Sequence: Synthetic oligonucleotide
  Target: DMPK; (+) strand; PAM type: YTN; PAM sequence: CTG
cgcccgccccggccccggcc

SEQ ID NO: 18361 - DNA, 20 bp, Artificial Sequence
  Description of Artificial Sequence: Synthetic oligonucleotide
  Target: DMPK; (+) strand; PAM type: YTN; PAM sequence: CTC
accctcggccgcctgcaaag

SEQ ID NO: 18362 - DNA, 20 bp, Artificial Sequence
  Description of Artificial Sequence: Synthetic oligonucleotide
  Target: DMPK; (+) strand; PAM type: YTN; PAM sequence: CTC
ggccgcctgcaaagtctgca

SEQ ID NO: 18363 - DNA, 20 bp, Artificial Sequence
  Description of Artificial Sequence: Synthetic oligonucleotide
  Target: DMPK; (+) strand; PAM type: YTN; PAM sequence: CTG
caaagtctgcaagagctggc

SEQ ID NO: 18364 - DNA, 20 bp, Artificial Sequence
  Description of Artificial Sequence: Synthetic oligonucleotide
  Target: DMPK; (+) strand; PAM type: YTN; PAM sequence: CTG
caagagctggcgcgcttcct

SEQ ID NO: 18365 - DNA, 20 bp, Artificial Sequence
  Description of Artificial Sequence: Synthetic oligonucleotide
  Target: DMPK; (+) strand; PAM type: YTN; PAM sequence: CTG
gcgcgcttcctcctcctcct

SEQ ID NO: 18366 - DNA, 20 bp, Artificial Sequence
  Description of Artificial Sequence: Synthetic oligonucleotide
  Target: DMPK; (+) strand; PAM type: YTN; PAM sequence: CTT
cctcctcctcctcttcggtc

SEQ ID NO: 18367 - DNA, 20 bp, Artificial Sequence
  Description of Artificial Sequence: Synthetic oligonucleotide
  Target: DMPK; (+) strand; PAM type: YTN; PAM sequence: TTC
ctcctcctcctcttcggtcg

SEQ ID NO: 18368 - DNA, 20 bp, Artificial Sequence
  Description of Artificial Sequence: Synthetic oligonucleotide
  Target: DMPK; (+) strand; PAM type: YTN; PAM sequence: CTC
ctcctcctcttcggtcgccg

SEQ ID NO: 18369 - DNA, 20 bp, Artificial Sequence
  Description of Artificial Sequence: Synthetic oligonucleotide
  Target: DMPK; (+) strand; PAM type: YTN; PAM sequence: CTC
ctcctcttcggtcgccgccg

SEQ ID NO: 18370 - DNA, 20 bp, Artificial Sequence
  Description of Artificial Sequence: Synthetic oligonucleotide
  Target: DMPK; (+) strand; PAM type: YTN; PAM sequence: CTC
ctcttcggtcgccgccgccg

SEQ ID NO: 18371 - DNA, 20 bp, Artificial Sequence
  Description of Artificial Sequence: Synthetic oligonucleotide
  Target: DMPK; (+) strand; PAM type: YTN; PAM sequence: CTC
ttcggtcgccgccgccgccg

SEQ ID NO: 18372 - DNA, 20 bp, Artificial Sequence
  Description of Artificial Sequence: Synthetic oligonucleotide
  Target: DMPK; (+) strand; PAM type: YTN; PAM sequence: CTT
cggtcgccgccgccgccgcc

SEQ ID NO: 18373 - DNA, 20 bp, Artificial Sequence
  Description of Artificial Sequence: Synthetic oligonucleotide
  Target: DMPK; (+) strand; PAM type: YTN; PAM sequence: TTC
ggtcgccgccgccgccgcca

SEQ ID NO: 18374 - DNA, 20 bp, Artificial Sequence
  Description of Artificial Sequence: Synthetic oligonucleotide
  Target: DMPK; (+) strand; PAM type: YTN; PAM sequence: CTC
ccccccagccgccggccccg

SEQ ID NO: 18375 - DNA, 20 bp, Artificial Sequence
  Description of Artificial Sequence: Synthetic oligonucleotide
  Target: DMPK; (+) strand; PAM type: YTN; PAM sequence: CTC
ggctccgcaggcaaggtagc

SEQ ID NO: 18376 - DNA, 20 bp, Artificial Sequence
  Description of Artificial Sequence: Synthetic oligonucleotide
  Target: DMPK; (+) strand; PAM type: YTN; PAM sequence: CTC
cgcaggcaaggtagccatgt

SEQ ID NO: 18377 - DNA, 20 bp, Artificial Sequence
  Description of Artificial Sequence: Synthetic oligonucleotide
  Target: DMPK; (+) strand; PAM type: YTN; PAM sequence: TTT
tgcaactttgggaagttcct

SEQ ID NO: 18378 - DNA, 20 bp, Artificial Sequence
  Description of Artificial Sequence: Synthetic oligonucleotide
  Target: DMPK; (+) strand; PAM type: YTN; PAM sequence: TTT
gcaactttgggaagttcctc

SEQ ID NO: 18379 - DNA, 20 bp, Artificial Sequence
  Description of Artificial Sequence: Synthetic oligonucleotide
  Target: DMPK; (+) strand; PAM type: YTN; PAM sequence: TTG
caactttgggaagttcctcc

SEQ ID NO: 18380 - DNA, 20 bp, Artificial Sequence
  Description of Artificial Sequence: Synthetic oligonucleotide
  Target: DMPK; (+) strand; PAM type: YTN; PAM sequence: CTT
tgggaagttcctccctccct

SEQ ID NO: 18381 - DNA, 20 bp, Artificial Sequence
  Description of Artificial Sequence: Synthetic oligonucleotide
  Target: DMPK; (+) strand; PAM type: YTN; PAM sequence: TTT
gggaagttcctccctccctc

SEQ ID NO: 18382 - DNA, 20 bp, Artificial Sequence
  Description of Artificial Sequence: Synthetic oligonucleotide
  Target: DMPK; (+) strand; PAM type: YTN; PAM sequence: TTG
ggaagttcctccctccctct

SEQ ID NO: 18383 - DNA, 20 bp, Artificial Sequence
  Description of Artificial Sequence: Synthetic oligonucleotide
  Target: DMPK; (+) strand; PAM type: YTN; PAM sequence: TTC
ctccctccctctcttcctcc

SEQ ID NO: 18384 - DNA, 20 bp, Artificial Sequence
  Description of Artificial Sequence: Synthetic oligonucleotide
  Target: DMPK; (+) strand; PAM type: YTN; PAM sequence: CTC
cctccctctcttcctccctc

SEQ ID NO: 18385 - DNA, 20 bp, Artificial Sequence
  Description of Artificial Sequence: Synthetic oligonucleotide
  Target: DMPK; (+) strand; PAM type: YTN; PAM sequence: CTC
cctctcttcctccctcgggc

SEQ ID NO: 18386 - DNA, 20 bp, Artificial Sequence
  Description of Artificial Sequence: Synthetic oligonucleotide
  Target: DMPK; (+) strand; PAM type: YTN; PAM sequence: CTC
tcttcctccctcgggctttc

SEQ ID NO: 18387 - DNA, 20 bp, Artificial Sequence
  Description of Artificial Sequence: Synthetic oligonucleotide
  Target: DMPK; (+) strand; PAM type: YTN; PAM sequence: CTC
ttcctccctcgggctttccc

SEQ ID NO: 18388 - DNA, 20 bp, Artificial Sequence
  Description of Artificial Sequence: Synthetic oligonucleotide
  Target: DMPK; (+) strand; PAM type: YTN; PAM sequence: CTT
cctccctcgggctttcccca

SEQ ID NO: 18389 - DNA, 20 bp, Artificial Sequence
  Description of Artificial Sequence: Synthetic oligonucleotide
  Target: DMPK; (+) strand; PAM type: YTN; PAM sequence: TTC
ctccctcgggctttccccag

SEQ ID NO: 18390 - DNA, 20 bp, Artificial Sequence
  Description of Artificial Sequence: Synthetic oligonucleotide
  Target: DMPK; (+) strand; PAM type: YTN; PAM sequence: CTC
cctcgggctttccccagcct

SEQ ID NO: 18391 - DNA, 20 bp, Artificial Sequence
  Description of Artificial Sequence: Synthetic oligonucleotide
  Target: DMPK; (+) strand; PAM type: YTN; PAM sequence: CTC
gggctttccccagcctcctc

SEQ ID NO: 18392 - DNA, 20 bp, Artificial Sequence
  Description of Artificial Sequence: Synthetic oligonucleotide
  Target: DMPK; (+) strand; PAM type: YTN; PAM sequence: CTT
tccccagcctcctcccccac

SEQ ID NO: 18393 - DNA, 20 bp, Artificial Sequence
  Description of Artificial Sequence: Synthetic oligonucleotide
  Target: DMPK; (+) strand; PAM type: YTN; PAM sequence: TTT
ccccagcctcctcccccacc

SEQ ID NO: 18394 - DNA, 20 bp, Artificial Sequence
  Description of Artificial Sequence: Synthetic oligonucleotide
  Target: DMPK; (+) strand; PAM type: YTN; PAM sequence: TTC
cccagcctcctcccccacct

SEQ ID NO: 18395 - DNA, 20 bp, Artificial Sequence
  Description of Artificial Sequence: Synthetic oligonucleotide
  Target: DMPK; (+) strand; PAM type: YTN; PAM sequence: CTC
ctcccccacctgtcccccct

SEQ ID NO: 18396 - DNA, 20 bp, Artificial Sequence
  Description of Artificial Sequence: Synthetic oligonucleotide
  Target: DMPK; (+) strand; PAM type: YTN; PAM sequence: CTC
ccccacctgtcccccctttt

SEQ ID NO: 18397 - DNA, 20 bp, Artificial Sequence
  Description of Artificial Sequence: Synthetic oligonucleotide
  Target: DMPK; (+) strand; PAM type: YTN; PAM sequence: CTG
tccccccttttcgcccccac

SEQ ID NO: 18398 - DNA, 20 bp, Artificial Sequence
  Description of Artificial Sequence: Synthetic oligonucleotide
  Target: DMPK; (+) strand; PAM type: YTN; PAM sequence: CTT
ttcgcccccactccccgctc

SEQ ID NO: 18399 - DNA, 20 bp, Artificial Sequence
  Description of Artificial Sequence: Synthetic oligonucleotide
  Target: DMPK; (+) strand; PAM type: YTN; PAM sequence: TTT
tcgcccccactccccgctct

SEQ ID NO: 18400 - DNA, 20 bp, Artificial Sequence
  Description of Artificial Sequence: Synthetic oligonucleotide
  Target: DMPK; (+) strand; PAM type: YTN; PAM sequence: TTT
cgcccccactccccgctctt

SEQ ID NO: 18401 - DNA, 20 bp, Artificial Sequence
  Description of Artificial Sequence: Synthetic oligonucleotide
  Target: DMPK; (+) strand; PAM type: YTN; PAM sequence: TTC
gcccccactccccgctcttc

SEQ ID NO: 18402 - DNA, 20 bp, Artificial Sequence
  Description of Artificial Sequence: Synthetic oligonucleotide
  Target: DMPK; (+) strand; PAM type: YTN; PAM sequence: CTC
cccgctcttctcgatcttct

SEQ ID NO: 18403 - DNA, 20 bp, Artificial Sequence
  Description of Artificial Sequence: Synthetic oligonucleotide
  Target: DMPK; (+) strand; PAM type: YTN; PAM sequence: CTC
ttctcgatcttctttctggc

SEQ ID NO: 18404 - DNA, 20 bp, Artificial Sequence
  Description of Artificial Sequence: Synthetic oligonucleotide
  Target: DMPK; (+) strand; PAM type: YTN; PAM sequence: CTT
ctcgatcttctttctggccg

SEQ ID NO: 18405 - DNA, 20 bp, Artificial Sequence
  Description of Artificial Sequence: Synthetic oligonucleotide
  Target: DMPK; (+) strand; PAM type: YTN; PAM sequence: TTC
tcgatcttctttctggccga

SEQ ID NO: 18406 - DNA, 20 bp, Artificial Sequence
  Description of Artificial Sequence: Synthetic oligonucleotide
  Target: DMPK; (+) strand; PAM type: YTN; PAM sequence: CTC
gatcttctttctggccgacc

SEQ ID NO: 18407 - DNA, 20 bp, Artificial Sequence
  Description of Artificial Sequence: Synthetic oligonucleotide
  Target: DMPK; (+) strand; PAM type: YTN; PAM sequence: CTT
ctttctggccgaccctgcgc

SEQ ID NO: 18408 - DNA, 20 bp, Artificial Sequence
  Description of Artificial Sequence: Synthetic oligonucleotide
  Target: DMPK; (+) strand; PAM type: YTN; PAM sequence: TTC
tttctggccgaccctgcgcc

SEQ ID NO: 18409 - DNA, 20 bp, Artificial Sequence
  Description of Artificial Sequence: Synthetic oligonucleotide
  Target: DMPK; (+) strand; PAM type: YTN; PAM sequence: CTT
tctggccgaccctgcgcccc

SEQ ID NO: 18410 - DNA, 20 bp, Artificial Sequence
  Description of Artificial Sequence: Synthetic oligonucleotide
  Target: DMPK; (+) strand; PAM type: YTN; PAM sequence: TTT
ctggccgaccctgcgcccca

SEQ ID NO: 18411 - DNA, 20 bp, Artificial Sequence
  Description of Artificial Sequence: Synthetic oligonucleotide
  Target: DMPK; (+) strand; PAM type: YTN; PAM sequence: TTC
tggccgaccctgcgccccac

SEQ ID NO: 18412 - DNA, 20 bp, Artificial Sequence
  Description of Artificial Sequence: Synthetic oligonucleotide
  Target: DMPK; (+) strand; PAM type: YTN; PAM sequence: CTG
gccgaccctgcgccccacgc

SEQ ID NO: 18413 - DNA, 20 bp, Artificial Sequence
  Description of Artificial Sequence: Synthetic oligonucleotide
  Target: DMPK; (+) strand; PAM type: YTN; PAM sequence: CTG
cgccccacgccgggaaggcg

SEQ ID NO: 18414 - DNA, 20 bp, Artificial Sequence
  Description of Artificial Sequence: Synthetic oligonucleotide
  Target: DMPK; (+) strand; PAM type: YTN; PAM sequence: CTC
tccactcgggtctctgtccc

SEQ ID NO: 18415 - DNA, 20 bp, Artificial Sequence
  Description of Artificial Sequence: Synthetic oligonucleotide
  Target: DMPK; (+) strand; PAM type: YTN; PAM sequence: CTC
cactcgggtctctgtcccct

SEQ ID NO: 18416 - DNA, 20 bp, Artificial Sequence
  Description of Artificial Sequence: Synthetic oligonucleotide
  Target: DMPK; (+) strand; PAM type: YTN; PAM sequence: CTC
gggtctctgtccccttgtgt

SEQ ID NO: 18417 - DNA, 20 bp, Artificial Sequence
  Description of Artificial Sequence: Synthetic oligonucleotide
  Target: DMPK; (+) strand; PAM type: YTN; PAM sequence: CTC
tgtccccttgtgtgtgtccg

SEQ ID NO: 18418 - DNA, 20 bp, Artificial Sequence
  Description of Artificial Sequence: Synthetic oligonucleotide
  Target: DMPK; (+) strand; PAM type: YTN; PAM sequence: CTG
tccccttgtgtgtgtccgtc

SEQ ID NO: 18419 - DNA, 20 bp, Artificial Sequence
  Description of Artificial Sequence: Synthetic oligonucleotide
  Target: DMPK; (+) strand; PAM type: YTN; PAM sequence: CTT
gtgtgtgtccgtccccctcc

SEQ ID NO: 18420 - DNA, 20 bp, Artificial Sequence
  Description of Artificial Sequence: Synthetic oligonucleotide
  Target: DMPK; (+) strand; PAM type: YTN; PAM sequence: TTG
tgtgtgtccgtccccctccc

SEQ ID NO: 18421 - DNA, 20 bp, Artificial Sequence
  Description of Artificial Sequence: Synthetic oligonucleotide
  Target: DMPK; (+) strand; PAM type: YTN; PAM sequence: CTC
ccgtctgtctgtgattctcc

SEQ ID NO: 18422 - DNA, 20 bp, Artificial Sequence
  Description of Artificial Sequence: Synthetic oligonucleotide
  Target: DMPK; (+) strand; PAM type: YTN; PAM sequence: CTG
tctgtgattctccctttgtt

SEQ ID NO: 18423 - DNA, 20 bp, Artificial Sequence
  Description of Artificial Sequence: Synthetic oligonucleotide
  Target: DMPK; (+) strand; PAM type: YTN; PAM sequence: CTG
tgattctccctttgttttcc

SEQ ID NO: 18424 - DNA, 20 bp, Artificial Sequence
  Description of Artificial Sequence: Synthetic oligonucleotide
  Target: DMPK; (+) strand; PAM type: YTN; PAM sequence: TTC
tccctttgttttccctccgc

SEQ ID NO: 18425 - DNA, 20 bp, Artificial Sequence
  Description of Artificial Sequence: Synthetic oligonucleotide
  Target: DMPK; (+) strand; PAM type: YTN; PAM sequence: CTC
cctttgttttccctccgcct

SEQ ID NO: 18426 - DNA, 20 bp, Artificial Sequence
  Description of Artificial Sequence: Synthetic oligonucleotide
  Target: DMPK; (+) strand; PAM type: YTN; PAM sequence: CTT
tgttttccctccgcctctgg

SEQ ID NO: 18427 - DNA, 20 bp, Artificial Sequence
  Description of Artificial Sequence: Synthetic oligonucleotide
  Target: DMPK; (+) strand; PAM type: YTN; PAM sequence: TTT
gttttccctccgcctctggc

SEQ ID NO: 18428 - DNA, 20 bp, Artificial Sequence
  Description of Artificial Sequence: Synthetic oligonucleotide
  Target: DMPK; (+) strand; PAM type: YTN; PAM sequence: TTG
ttttccctccgcctctggcc

SEQ ID NO: 18429 - DNA, 20 bp, Artificial Sequence
  Description of Artificial Sequence: Synthetic oligonucleotide
  Target: DMPK; (+) strand; PAM type: YTN; PAM sequence: TTT
tccctccgcctctggccgcg

SEQ ID NO: 18430 - DNA, 20 bp, Artificial Sequence
  Description of Artificial Sequence: Synthetic oligonucleotide
  Target: DMPK; (+) strand; PAM type: YTN; PAM sequence: TTT
ccctccgcctctggccgcgc

SEQ ID NO: 18431 - DNA, 20 bp, Artificial Sequence
  Description of Artificial Sequence: Synthetic oligonucleotide
  Target: DMPK; (+) strand; PAM type: YTN; PAM sequence: TTC
cctccgcctctggccgcgct

SEQ ID NO: 18432 - DNA, 20 bp, Artificial Sequence
  Description of Artificial Sequence: Synthetic oligonucleotide
  Target: DMPK; (+) strand; PAM type: YTN; PAM sequence: CTC
cgcctctggccgcgctttct

SEQ ID NO: 18433 - DNA, 20 bp, Artificial Sequence
  Description of Artificial Sequence: Synthetic oligonucleotide
  Target: DMPK; (+) strand; PAM type: YTN; PAM sequence: CTC
tggccgcgctttctgcctcc

SEQ ID NO: 18434 - DNA, 20 bp, Artificial Sequence
  Description of Artificial Sequence: Synthetic oligonucleotide
  Target: DMPK; (+) strand; PAM type: YTN; PAM sequence: CTG
gccgcgctttctgcctcccc

SEQ ID NO: 18435 - DNA, 20 bp, Artificial Sequence
  Description of Artificial Sequence: Synthetic oligonucleotide
  Target: DMPK; (+) strand; PAM type: YTN; PAM sequence: CTT
tctgcctccccccagcgtgt

SEQ ID NO: 18436 - DNA, 20 bp, Artificial Sequence
  Description of Artificial Sequence: Synthetic oligonucleotide
  Target: DMPK; (+) strand; PAM type: YTN; PAM sequence: TTT
ctgcctccccccagcgtgtg

SEQ ID NO: 18437 - DNA, 20 bp, Artificial Sequence
  Description of Artificial Sequence: Synthetic oligonucleotide
  Target: DMPK; (+) strand; PAM type: YTN; PAM sequence: TTC
tgcctccccccagcgtgtgc

SEQ ID NO: 18438 - DNA, 20 bp, Artificial Sequence
  Description of Artificial Sequence: Synthetic oligonucleotide
  Target: DMPK; (+) strand; PAM type: YTN; PAM sequence: CTG
cctccccccagcgtgtgctt

SEQ ID NO: 18439 - DNA, 20 bp, Artificial Sequence
  Description of Artificial Sequence: Synthetic oligonucleotide
  Target: DMPK; (+) strand; PAM type: YTN; PAM sequence: CTC
cccccagcgtgtgcttctgg

SEQ ID NO: 18440 - DNA, 20 bp, Artificial Sequence
  Description of Artificial Sequence: Synthetic oligonucleotide
  Target: DMPK; (+) strand; PAM type: YTN; PAM sequence: CTT
ctggctcagggcctcagttt

SEQ ID NO: 18441 - DNA, 20 bp, Artificial Sequence
  Description of Artificial Sequence: Synthetic oligonucleotide
  Target: DMPK; (+) strand; PAM type: YTN; PAM sequence: TTC
tggctcagggcctcagtttc

SEQ ID NO: 18442 - DNA, 20 bp, Artificial Sequence
  Description of Artificial Sequence: Synthetic oligonucleotide
  Target: DMPK; (+) strand; PAM type: YTN; PAM sequence: CTG
gctcagggcctcagtttccc

SEQ ID NO: 18443 - DNA, 20 bp, Artificial Sequence
  Description of Artificial Sequence: Synthetic oligonucleotide
  Target: DMPK; (+) strand; PAM type: YTN; PAM sequence: CTC
agggcctcagtttccccatc

SEQ ID NO: 18444 - DNA, 20 bp, Artificial Sequence
  Description of Artificial Sequence: Synthetic oligonucleotide
  Target: DMPK; (+) strand; PAM type: YTN; PAM sequence: CTC
agtttccccatcgggacaac

SEQ ID NO: 18445 - DNA, 20 bp, Artificial Sequence
  Description of Artificial Sequence: Synthetic oligonucleotide
  Target: DMPK; (+) strand; PAM type: YTN; PAM sequence: TTT
ccccatcgggacaacgcaga

SEQ ID NO: 18446 - DNA, 20 bp, Artificial Sequence
  Description of Artificial Sequence: Synthetic oligonucleotide
  Target: DMPK; (+) strand; PAM type: YTN; PAM sequence: TTC
cccatcgggacaacgcagaa

SEQ ID NO: 18447 - DNA, 20 bp, Artificial Sequence
  Description of Artificial Sequence: Synthetic oligonucleotide
  Target: DMPK; (+) strand; PAM type: YTN; PAM sequence: CTA
agggcgcgaagcctccgccc

SEQ ID NO: 18448 - DNA, 20 bp, Artificial Sequence
  Description of Artificial Sequence: Synthetic oligonucleotide
  Target: DMPK; (+) strand; PAM type: YTN; PAM sequence: CTC
cgccccgagactgagcttct

SEQ ID NO: 18449 - DNA, 20 bp, Artificial Sequence
  Description of Artificial Sequence: Synthetic oligonucleotide
  Target: DMPK; (+) strand; PAM type: YTN; PAM sequence: CTG
agcttctgcacgcctccgtc

SEQ ID NO: 18450 - DNA, 20 bp, Artificial Sequence
  Description of Artificial Sequence: Synthetic oligonucleotide
  Target: DMPK; (+) strand; PAM type: YTN; PAM sequence: CTT
ctgcacgcctccgtctccag

SEQ ID NO: 18451 - DNA, 20 bp, Artificial Sequence
  Description of Artificial Sequence: Synthetic oligonucleotide
  Target: DMPK; (+) strand; PAM type: YTN; PAM sequence: TTC
tgcacgcctccgtctccagg

SEQ ID NO: 18452 - DNA, 20 bp, Artificial Sequence
  Description of Artificial Sequence: Synthetic oligonucleotide
  Target: DMPK; (+) strand; PAM type: YTN; PAM sequence: CTG
cacgcctccgtctccagggt

SEQ ID NO: 18453 - DNA, 20 bp, Artificial Sequence
  Description of Artificial Sequence: Synthetic oligonucleotide
  Target: DMPK; (+) strand; PAM type: YTN; PAM sequence: CTC
cgtctccagggtcctctgca

SEQ ID NO: 18454 - DNA, 20 bp, Artificial Sequence
  Description of Artificial Sequence: Synthetic oligonucleotide
  Target: DMPK; (+) strand; PAM type: YTN; PAM sequence: CTC
cagggtcctctgcaggcccc

SEQ ID NO: 18455 - DNA, 20 bp, Artificial Sequence
  Description of Artificial Sequence: Synthetic oligonucleotide
  Target: DMPK; (+) strand; PAM type: YTN; PAM sequence: CTC
tgcaggcccccacattcccc

SEQ ID NO: 18456 - DNA, 20 bp, Artificial Sequence
  Description of Artificial Sequence: Synthetic oligonucleotide
  Target: DMPK; (+) strand; PAM type: YTN; PAM sequence: CTG
caggcccccacattccccat

SEQ ID NO: 18457 - DNA, 20 bp, Artificial Sequence
  Description of Artificial Sequence: Synthetic oligonucleotide
  Target: DMPK; (+) strand; PAM type: YTN; PAM sequence: TTC
cccatctcggcctgcgctcc

SEQ ID NO: 18458 - DNA, 20 bp, Artificial Sequence
  Description of Artificial Sequence: Synthetic oligonucleotide
  Target: DMPK; (+) strand; PAM type: YTN; PAM sequence: CTC
ggcctgcgctccgcccctcg

SEQ ID NO: 18459 - DNA, 20 bp, Artificial Sequence
  Description of Artificial Sequence: Synthetic oligonucleotide
  Target: DMPK; (+) strand; PAM type: YTN; PAM sequence: CTG
cgctccgcccctcggaattc

SEQ ID NO: 18460 - DNA, 20 bp, Artificial Sequence
  Description of Artificial Sequence: Synthetic oligonucleotide
  Target: DMPK; (+) strand; PAM type: YTN; PAM sequence: CTC
cgcccctcggaattcccggc

SEQ ID NO: 18461 - DNA, 20 bp, Artificial Sequence
  Description of Artificial Sequence: Synthetic oligonucleotide
  Target: DMPK; (+) strand; PAM type: YTN; PAM sequence: CTC
ggaattcccggctccgcagg

SEQ ID NO: 18462 - DNA, 20 bp, Artificial Sequence
  Description of Artificial Sequence: Synthetic oligonucleotide
  Target: DMPK; (+) strand; PAM type: YTN; PAM sequence: TTC
ccggctccgcagggggggcg

SEQ ID NO: 18463 - DNA, 20 bp, Artificial Sequence
  Description of Artificial Sequence: Synthetic oligonucleotide
  Target: DMPK; (+) strand; PAM type: YTN; PAM sequence: CTC
cgcagggggggcgggtctgg

SEQ ID NO: 18464 - DNA, 20 bp, Artificial Sequence
  Description of Artificial Sequence: Synthetic oligonucleotide
  Target: DMPK; (+) strand; PAM type: YTN; PAM sequence: CTG
gccgggaggaggggcgggga

SEQ ID NO: 18465 - DNA, 20 bp, Artificial Sequence
  Description of Artificial Sequence: Synthetic oligonucleotide
  Target: DMPK; (+) strand; PAM type: YTN; PAM sequence: CTA
gaaagtttgcagcaactttt

SEQ ID NO: 18466 - DNA, 20 bp, Artificial Sequence
  Description of Artificial Sequence: Synthetic oligonucleotide
  Target: DMPK; (+) strand; PAM type: YTN; PAM sequence: TTT
gcagcaacttttctcgagct

SEQ ID NO: 18467 - DNA, 20 bp, Artificial Sequence
  Description of Artificial Sequence: Synthetic oligonucleotide
  Target: DMPK; (+) strand; PAM type: YTN; PAM sequence: TTG
cagcaacttttctcgagctt

SEQ ID NO: 18468 - DNA, 20 bp, Artificial Sequence
  Description of Artificial Sequence: Synthetic oligonucleotide
  Target: DMPK; (+) strand; PAM type: YTN; PAM sequence: CTT
ttctcgagcttgcgtcccag

SEQ ID NO: 18469 - DNA, 20 bp, Artificial Sequence
  Description of Artificial Sequence: Synthetic oligonucleotide
  Target: DMPK; (+) strand; PAM type: YTN; PAM sequence: TTT
tctcgagcttgcgtcccagg

SEQ ID NO: 18470 - DNA, 20 bp, Artificial Sequence
  Description of Artificial Sequence: Synthetic oligonucleotide
  Target: DMPK; (+) strand; PAM type: YTN; PAM sequence: TTT
ctcgagcttgcgtcccagga

SEQ ID NO: 18471 - DNA, 20 bp, Artificial Sequence
  Description of Artificial Sequence: Synthetic oligonucleotide
  Target: DMPK; (+) strand; PAM type: YTN; PAM sequence: TTC
tcgagcttgcgtcccaggag

SEQ ID NO: 18472 - DNA, 20 bp, Artificial Sequence
  Description of Artificial Sequence: Synthetic oligonucleotide
  Target: DMPK; (+) strand; PAM type: YTN; PAM sequence: CTC
gagcttgcgtcccaggagcg

SEQ ID NO: 18473 - DNA, 20 bp, Artificial Sequence
  Description of Artificial Sequence: Synthetic oligonucleotide
  Target: DMPK; (+) strand; PAM type: YTN; PAM sequence: CTT
gcgtcccaggagcggatgcg

SEQ ID NO: 18474 - DNA, 20 bp, Artificial Sequence
  Description of Artificial Sequence: Synthetic oligonucleotide
  Target: DMPK; (+) strand; PAM type: YTN; PAM sequence: TTG
cgtcccaggagcggatgcgc

SEQ ID NO: 18475 - DNA, 20 bp, Artificial Sequence
  Description of Artificial Sequence: Synthetic oligonucleotide
  Target: DMPK; (+) strand; PAM type: YTN; PAM sequence: CTG
ccagcccagccccctcttct

SEQ ID NO: 18476 - DNA, 20 bp, Artificial Sequence
  Description of Artificial Sequence: Synthetic oligonucleotide
  Target: DMPK; (+) strand; PAM type: YTN; PAM sequence: CTC
ttctcgacgctcggtggcac

SEQ ID NO: 18477 - DNA, 20 bp, Artificial Sequence
  Description of Artificial Sequence: Synthetic oligonucleotide
  Target: DMPK; (+) strand; PAM type: YTN; PAM sequence: CTT
ctcgacgctcggtggcacag

SEQ ID NO: 18478 - DNA, 20 bp, Artificial Sequence
  Description of Artificial Sequence: Synthetic oligonucleotide
  Target: DMPK; (+) strand; PAM type: YTN; PAM sequence: TTC
tcgacgctcggtggcacagc

SEQ ID NO: 18479 - DNA, 20 bp, Artificial Sequence
  Description of Artificial Sequence: Synthetic oligonucleotide
  Target: DMPK; (+) strand; PAM type: YTN; PAM sequence: CTC
gacgctcggtggcacagctg

SEQ ID NO: 18480 - DNA, 20 bp, Artificial Sequence
  Description of Artificial Sequence: Synthetic oligonucleotide
  Target: DMPK; (+) strand; PAM type: YTN; PAM sequence: CTC
ggtggcacagctgggccaca

SEQ ID NO: 18481 - DNA, 20 bp, Artificial Sequence
  Description of Artificial Sequence: Synthetic oligonucleotide
  Target: DMPK; (+) strand; PAM type: YTN; PAM sequence: CTG
ggccacagctgggcgggggc

SEQ ID NO: 18482 - DNA, 20 bp, Artificial Sequence
  Description of Artificial Sequence: Synthetic oligonucleotide
  Target: DMPK; (+) strand; PAM type: YTN; PAM sequence: CTG
ggcgggggcggtgcctccgg

SEQ ID NO: 18483 - DNA, 20 bp, Artificial Sequence
  Description of Artificial Sequence: Synthetic oligonucleotide
  Target: DMPK; (+) strand; PAM type: YTN; PAM sequence: CTC
cgggtggcccgctcgccctc

SEQ ID NO: 18484 - DNA, 20 bp, Artificial Sequence
  Description of Artificial Sequence: Synthetic oligonucleotide
  Target: DMPK; (+) strand; PAM type: YTN; PAM sequence: CTC
gccctcctattggccggacg

SEQ ID NO: 18485 - DNA, 20 bp, Artificial Sequence
  Description of Artificial Sequence: Synthetic oligonucleotide
  Target: DMPK; (+) strand; PAM type: YTN; PAM sequence: CTC
ctattggccggacgccaaag

SEQ ID NO: 18486 - DNA, 20 bp, Artificial Sequence
  Description of Artificial Sequence: Synthetic oligonucleotide
  Target: DMPK; (+) strand; PAM type: YTN; PAM sequence: CTA
ttggccggacgccaaagccc

SEQ ID NO: 18487 - DNA, 20 bp, Artificial Sequence
  Description of Artificial Sequence: Synthetic oligonucleotide
  Target: DMPK; (+) strand; PAM type: YTN; PAM sequence: TTG
gccggacgccaaagccccgc

SEQ ID NO: 18488 - DNA, 20 bp, Artificial Sequence
  Description of Artificial Sequence: Synthetic oligonucleotide
  Target: DMPK; (+) strand; PAM type: YTN; PAM sequence: CTT
ttcctcccccaaccctgatt

SEQ ID NO: 18489 - DNA, 20 bp, Artificial Sequence
  Description of Artificial Sequence: Synthetic oligonucleotide
  Target: DMPK; (+) strand; PAM type: YTN; PAM sequence: TTT
tcctcccccaaccctgattc

SEQ ID NO: 18490 - DNA, 20 bp, Artificial Sequence
  Description of Artificial Sequence: Synthetic oligonucleotide
  Target: DMPK; (+) strand; PAM type: YTN; PAM sequence: TTT
cctcccccaaccctgattcg

SEQ ID NO: 18491 - DNA, 20 bp, Artificial Sequence
  Description of Artificial Sequence: Synthetic oligonucleotide
  Target: DMPK; (+) strand; PAM type: YTN; PAM sequence: TTC
ctcccccaaccctgattcgg

SEQ ID NO: 18492 - DNA, 20 bp, Artificial Sequence
  Description of Artificial Sequence: Synthetic oligonucleotide
  Target: DMPK; (+) strand; PAM type: YTN; PAM sequence: CTC
ccccaaccctgattcggccg

SEQ ID NO: 18493 - DNA, 20 bp, Artificial Sequence
  Description of Artificial Sequence: Synthetic oligonucleotide
  Target: DMPK; (+) strand; PAM type: YTN; PAM sequence: CTG
attcggccgcttcgcatccc

SEQ ID NO: 18494 - DNA, 20 bp, Artificial Sequence
  Description of Artificial Sequence: Synthetic oligonucleotide
  Target: DMPK; (+) strand; PAM type: YTN; PAM sequence: TTC
ggccgcttcgcatcccgcta

SEQ ID NO: 18495 - DNA, 20 bp, Artificial Sequence
  Description of Artificial Sequence: Synthetic oligonucleotide
  Target: DMPK; (+) strand; PAM type: YTN; PAM sequence: CTT
cgcatcccgctagctcctcc

SEQ ID NO: 18496 - DNA, 20 bp, Artificial Sequence
  Description of Artificial Sequence: Synthetic oligonucleotide
  Target: DMPK; (+) strand; PAM type: YTN; PAM sequence: TTC
gcatcccgctagctcctccc

SEQ ID NO: 18497 - DNA, 20 bp, Artificial Sequence
  Description of Artificial Sequence: Synthetic oligonucleotide
  Target: DMPK; (+) strand; PAM type: YTN; PAM sequence: CTA
gctcctcccagaccttcggc

SEQ ID NO: 18498 - DNA, 20 bp, Artificial Sequence
  Description of Artificial Sequence: Synthetic oligonucleotide
  Target: DMPK; (+) strand; PAM type: YTN; PAM sequence: CTC
ctcccagaccttcggccgcc

SEQ ID NO: 18499 - DNA, 20 bp, Artificial Sequence
  Description of Artificial Sequence: Synthetic oligonucleotide
  Target: DMPK; (+) strand; PAM type: YTN; PAM sequence: CTC
ccagaccttcggccgcctcc

SEQ ID NO: 18500 - DNA, 20 bp, Artificial Sequence
  Description of Artificial Sequence: Synthetic oligonucleotide
  Target: DMPK; (+) strand; PAM type: YTN; PAM sequence: CTT
cggccgcctccacacgcctc

SEQ ID NO: 18501 - DNA, 20 bp, Artificial Sequence
  Description of Artificial Sequence: Synthetic oligonucleotide
  Target: DMPK; (+) strand; PAM type: YTN; PAM sequence: TTC
ggccgcctccacacgcctcc

SEQ ID NO: 18502 - DNA, 20 bp, Artificial Sequence
  Description of Artificial Sequence: Synthetic oligonucleotide
  Target: DMPK; (+) strand; PAM type: YTN; PAM sequence: CTC
cacacgcctccggattggcc

SEQ ID NO: 18503 - DNA, 20 bp, Artificial Sequence
  Description of Artificial Sequence: Synthetic oligonucleotide
  Target: DMPK; (+) strand; PAM type: YTN; PAM sequence: CTC
cggattggcccgctgcggag

SEQ ID NO: 18504 - DNA, 20 bp, Artificial Sequence
  Description of Artificial Sequence: Synthetic oligonucleotide
  Target: DMPK; (+) strand; PAM type: YTN; PAM sequence: TTG
gcccgctgcggagcctccgg

SEQ ID NO: 18505 - DNA, 20 bp, Artificial Sequence
  Description of Artificial Sequence: Synthetic oligonucleotide
  Target: DMPK; (+) strand; PAM type: YTN; PAM sequence: CTG
cggagcctccggcccacaac

SEQ ID NO: 18506 - DNA, 20 bp, Artificial Sequence
  Description of Artificial Sequence: Synthetic oligonucleotide
  Target: DMPK; (+) strand; PAM type: YTN; PAM sequence: CTC
cggcccacaacgcaaaccgc

SEQ ID NO: 18507 - DNA, 20 bp, Artificial Sequence
  Description of Artificial Sequence: Synthetic oligonucleotide
  Target: DMPK; (+) strand; PAM type: YTN; PAM sequence: CTG
tggagtccagagctttgggc

SEQ ID NO: 18508 - DNA, 20 bp, Artificial Sequence
  Description of Artificial Sequence: Synthetic oligonucleotide
  Target: DMPK; (+) strand; PAM type: YTN; PAM sequence: CTT
tgggcagatggagggccttt

SEQ ID NO: 18509 - DNA, 20 bp, Artificial Sequence
  Description of Artificial Sequence: Synthetic oligonucleotide
  Target: DMPK; (+) strand; PAM type: YTN; PAM sequence: TTT
gggcagatggagggcctttt

SEQ ID NO: 18510 - DNA, 20 bp, Artificial Sequence
  Description of Artificial Sequence: Synthetic oligonucleotide
  Target: DMPK; (+) strand; PAM type: YTN; PAM sequence: TTG
ggcagatggagggcctttta

SEQ ID NO: 18511 - DNA, 20 bp, Artificial Sequence
  Description of Artificial Sequence: Synthetic oligonucleotide
  Target: DMPK; (+) strand; PAM type: YTN; PAM sequence: CTT
ttattcgcgagggtcggggg

SEQ ID NO: 18512 - DNA, 20 bp, Artificial Sequence
  Description of Artificial Sequence: Synthetic oligonucleotide
  Target: DMPK; (+) strand; PAM type: YTN; PAM sequence: TTT
tattcgcgagggtcgggggt

SEQ ID NO: 18513 - DNA, 20 bp, Artificial Sequence
  Description of Artificial Sequence: Synthetic oligonucleotide
  Target: DMPK; (+) strand; PAM type: YTN; PAM sequence: TTT
attcgcgagggtcgggggtg

SEQ ID NO: 18514 - DNA, 20 bp, Artificial Sequence
  Description of Artificial Sequence: Synthetic oligonucleotide
  Target: DMPK; (+) strand; PAM type: YTN; PAM sequence: TTA
ttcgcgagggtcgggggtgg

SEQ ID NO: 18515 - DNA, 20 bp, Artificial Sequence
  Description of Artificial Sequence: Synthetic oligonucleotide
  Target: DMPK; (+) strand; PAM type: YTN; PAM sequence: TTC
gcgagggtcgggggtggggg

SEQ ID NO: 18516 - DNA, 20 bp, Artificial Sequence
  Description of Artificial Sequence: Synthetic oligonucleotide
  Target: DMPK; (+) strand; PAM type: YTN; PAM sequence: CTA
ggtggggacagacaataaat

SEQ ID NO: 18517 - DNA, 20 bp, Artificial Sequence
  Description of Artificial Sequence: Synthetic oligonucleotide
  Target: DMPK; (+) strand; PAM type: YTN; PAM sequence: CTC
agtgcatccaaaacgtggat

SEQ ID NO: 18518 - DNA, 20 bp, Artificial Sequence
  Description of Artificial Sequence: Synthetic oligonucleotide
  Target: DMPK; (+) strand; PAM type: YTN; PAM sequence: TTG
gggttgttgggggtcctgta

SEQ ID NO: 18519 - DNA, 20 bp, Artificial Sequence
  Description of Artificial Sequence: Synthetic oligonucleotide
  Target: DMPK; (+) strand; PAM type: YTN; PAM sequence: TTG
ttgggggtcctgtagcctgt

SEQ ID NO: 18520 - DNA, 20 bp, Artificial Sequence
  Description of Artificial Sequence: Synthetic oligonucleotide
  Target: DMPK; (+) strand; PAM type: YTN; PAM sequence: TTG
ggggtcctgtagcctgtcag

SEQ ID NO: 18521 - DNA, 20 bp, Artificial Sequence
  Description of Artificial Sequence: Synthetic oligonucleotide
  Target: DMPK; (+) strand; PAM type: YTN; PAM sequence: CTG
tagcctgtcagcgagtcgga

SEQ ID NO: 18522 - DNA, 20 bp, Artificial Sequence
  Description of Artificial Sequence: Synthetic oligonucleotide
  Target: DMPK; (+) strand; PAM type: YTN; PAM sequence: CTG
tcagcgagtcggaggacgag

SEQ ID NO: 18523 - DNA, 20 bp, Artificial Sequence
  Description of Artificial Sequence: Synthetic oligonucleotide
  Target: DMPK; (+) strand; PAM type: YTN; PAM sequence: CTG
gggctccgagagcagcgcaa

SEQ ID NO: 18524 - DNA, 20 bp, Artificial Sequence
  Description of Artificial Sequence: Synthetic oligonucleotide
  Target: DMPK; (+) strand; PAM type: YTN; PAM sequence: CTC
cgagagcagcgcaagtgagg

SEQ ID NO: 18525 - DNA, 20 bp, Artificial Sequence
  Description of Artificial Sequence: Synthetic oligonucleotide
  Target: DMPK; (+) strand; PAM type: YTN; PAM sequence: TTT
ggcaaaagcaaatttcccga

SEQ ID NO: 18526 - DNA, 20 bp, Artificial Sequence
  Description of Artificial Sequence: Synthetic oligonucleotide
  Target: DMPK; (+) strand; PAM type: YTN; PAM sequence: TTG
gcaaaagcaaatttcccgag

SEQ ID NO: 18527 - DNA, 20 bp, Artificial Sequence
  Description of Artificial Sequence: Synthetic oligonucleotide
  Target: DMPK; (+) strand; PAM type: YTN; PAM sequence: TTT
cccgagtaagcaggcagaga

SEQ ID NO: 18528 - DNA, 20 bp, Artificial Sequence
  Description of Artificial Sequence: Synthetic oligonucleotide
  Target: DMPK; (+) strand; PAM type: YTN; PAM sequence: TTC
ccgagtaagcaggcagagat

SEQ ID NO: 18529 - DNA, 20 bp, Artificial Sequence
  Description of Artificial Sequence: Synthetic oligonucleotide
  Target: DMPK; (+) strand; PAM type: YTN; PAM sequence: CTC
cccagagcagggcgtcatgc

SEQ ID NO: 18530 - DNA, 20 bp, Artificial Sequence
  Description of Artificial Sequence: Synthetic oligonucleotide
  Target: DMPK; (+) strand; PAM type: YTN; PAM sequence: CTT
tgcactttgcgaaccaacga

SEQ ID NO: 18531 - DNA, 20 bp, Artificial Sequence
  Description of Artificial Sequence: Synthetic oligonucleotide
  Target: DMPK; (+) strand; PAM type: YTN; PAM sequence: TTT
gcactttgcgaaccaacgat

SEQ ID NO: 18532 - DNA, 20 bp, Artificial Sequence
  Description of Artificial Sequence: Synthetic oligonucleotide
  Target: DMPK; (+) strand; PAM type: YTN; PAM sequence: TTG
cactttgcgaaccaacgata

SEQ ID NO: 18533 - DNA, 20 bp, Artificial Sequence
  Description of Artificial Sequence: Synthetic oligonucleotide
  Target: DMPK; (+) strand; PAM type: YTN; PAM sequence: CTT
tgcgaaccaacgataggtgg

SEQ ID NO: 18534 - DNA, 20 bp, Artificial Sequence
  Description of Artificial Sequence: Synthetic oligonucleotide
  Target: DMPK; (+) strand; PAM type: YTN; PAM sequence: TTT
gcgaaccaacgataggtggg

SEQ ID NO: 18535 - DNA, 20 bp, Artificial Sequence
  Description of Artificial Sequence: Synthetic oligonucleotide
  Target: DMPK; (+) strand; PAM type: YTN; PAM sequence: TTG
cgaaccaacgataggtgggg

SEQ ID NO: 18536 - DNA, 20 bp, Artificial Sequence
  Description of Artificial Sequence: Synthetic oligonucleotide
  Target: DMPK; (+) strand; PAM type: YTN; PAM sequence: CTT
gctgccttcccaggcctgca

SEQ ID NO: 18537 - DNA, 20 bp, Artificial Sequence
  Description of Artificial Sequence: Synthetic oligonucleotide
  Target: DMPK; (+) strand; PAM type: YTN; PAM sequence: TTG
ctgccttcccaggcctgcag

SEQ ID NO: 18538 - DNA, 20 bp, Artificial Sequence
  Description of Artificial Sequence: Synthetic oligonucleotide
  Target: DMPK; (+) strand; PAM type: YTN; PAM sequence: CTG
ccttcccaggcctgcagttt

SEQ ID NO: 18539 - DNA, 20 bp, Artificial Sequence
  Description of Artificial Sequence: Synthetic oligonucleotide
  Target: DMPK; (+) strand; PAM type: YTN; PAM sequence: CTT
cccaggcctgcagtttgccc

SEQ ID NO: 18540 - DNA, 20 bp, Artificial Sequence
  Description of Artificial Sequence: Synthetic oligonucleotide
  Target: DMPK; (+) strand; PAM type: YTN; PAM sequence: TTC
ccaggcctgcagtttgccca

SEQ ID NO: 18541 - DNA, 20 bp, Artificial Sequence
  Description of Artificial Sequence: Synthetic oligonucleotide
  Target: DMPK; (+) strand; PAM type: YTN; PAM sequence: CTG
cagtttgcccatccacgtca

SEQ ID NO: 18542 - DNA, 20 bp, Artificial Sequence
  Description of Artificial Sequence: Synthetic oligonucleotide
  Target: DMPK; (+) strand; PAM type: YTN; PAM sequence: TTT
gcccatccacgtcagggcct

SEQ ID NO: 18543 - DNA, 20 bp, Artificial Sequence
  Description of Artificial Sequence: Synthetic oligonucleotide
  Target: DMPK; (+) strand; PAM type: YTN; PAM sequence: TTG
cccatccacgtcagggcctc

SEQ ID NO: 18544 - DNA, 20 bp, Artificial Sequence
  Description of Artificial Sequence: Synthetic oligonucleotide
  Target: DMPK; (+) strand; PAM type: YTN; PAM sequence: CTC
agcctggccgaaagaaagaa

SEQ ID NO: 18545 - DNA, 20 bp, Artificial Sequence
  Description of Artificial Sequence: Synthetic oligonucleotide
  Target: DMPK; (+) strand; PAM type: YTN; PAM sequence: CTG
gccgaaagaaagaaatggtc

SEQ ID NO: 18546 - DNA, 20 bp, Artificial Sequence
  Description of Artificial Sequence: Synthetic oligonucleotide
  Target: DMPK; (+) strand; PAM type: YTN; PAM sequence: CTG
tgatccccccagcagcagca

SEQ ID NO: 18547 - DNA, 20 bp, Artificial Sequence
  Description of Artificial Sequence: Synthetic oligonucleotide
  Target: DMPK; (+) strand; PAM type: YTN; PAM sequence: TTC
ccggctacaaggacccttcg

SEQ ID NO: 18548 - DNA, 20 bp, Artificial Sequence
  Description of Artificial Sequence: Synthetic oligonucleotide
  Target: DMPK; (+) strand; PAM type: YTN; PAM sequence: CTA
caaggacccttcgagccccg

SEQ ID NO: 18549 - DNA, 20 bp, Artificial Sequence
  Description of Artificial Sequence: Synthetic oligonucleotide
  Target: DMPK; (+) strand; PAM type: YTN; PAM sequence: CTT
cgagccccgttcgccggccg

SEQ ID NO: 18550 - DNA, 20 bp, Artificial Sequence
  Description of Artificial Sequence: Synthetic oligonucleotide
  Target: DMPK; (+) strand; PAM type: YTN; PAM sequence: TTC
gagccccgttcgccggccgc

SEQ ID NO: 18551 - DNA, 20 bp, Artificial Sequence
  Description of Artificial Sequence: Synthetic oligonucleotide
  Target: DMPK; (+) strand; PAM type: YTN; PAM sequence: TTC
gccggccgcggacccggccc

SEQ ID NO: 18552 - DNA, 20 bp, Artificial Sequence
  Description of Artificial Sequence: Synthetic oligonucleotide
  Target: DMPK; (+) strand; PAM type: YTN; PAM sequence: CTC
cctccccggccgctaggggg

SEQ ID NO: 18553 - DNA, 20 bp, Artificial Sequence
  Description of Artificial Sequence: Synthetic oligonucleotide
  Target: DMPK; (+) strand; PAM type: YTN; PAM sequence: CTC
cccggccgctagggggcggg

SEQ ID NO: 18554 - DNA, 20 bp, Artificial Sequence
  Description of Artificial Sequence: Synthetic oligonucleotide
  Target: DMPK; (+) strand; PAM type: YTN; PAM sequence: CTA
gggggcgggcccggatcaca

SEQ ID NO: 18555 - DNA, 20 bp, Artificial Sequence
  Description of Artificial Sequence: Synthetic oligonucleotide
  Target: DMPK; (+) strand; PAM type: YTN; PAM sequence: CTG
gagctgggcggagacccacg

SEQ ID NO: 18556 - DNA, 20 bp, Artificial Sequence
  Description of Artificial Sequence: Synthetic oligonucleotide
  Target: DMPK; (+) strand; PAM type: YTN; PAM sequence: CTG
ggcggagacccacgctcgga

SEQ ID NO: 18557 - DNA, 20 bp, Artificial Sequence
  Description of Artificial Sequence: Synthetic oligonucleotide
  Target: DMPK; (+) strand; PAM type: YTN; PAM sequence: CTC
ggagcggttgtgaactggca

SEQ ID NO: 18558 - DNA, 20 bp, Artificial Sequence
  Description of Artificial Sequence: Synthetic oligonucleotide
  Target: DMPK; (+) strand; PAM type: YTN; PAM sequence: TTG
tgaactggcaggcggtgggc

SEQ ID NO: 18559 - DNA, 20 bp, Artificial Sequence
  Description of Artificial Sequence: Synthetic oligonucleotide
  Target: DMPK; (+) strand; PAM type: YTN; PAM sequence: CTG
gcaggcggtgggcgcggctt

SEQ ID NO: 18560 - DNA, 20 bp, Artificial Sequence
  Description of Artificial Sequence: Synthetic oligonucleotide
  Target: DMPK; (+) strand; PAM type: YTN; PAM sequence: CTT
ctgtgccgtgccccgggcac

SEQ ID NO: 18561 - DNA, 20 bp, Artificial Sequence
  Description of Artificial Sequence: Synthetic oligonucleotide
  Target: DMPK; (+) strand; PAM type: YTN; PAM sequence: TTC
tgtgccgtgccccgggcact

SEQ ID NO: 18562 - DNA, 20 bp, Artificial Sequence
  Description of Artificial Sequence: Synthetic oligonucleotide
  Target: DMPK; (+) strand; PAM type: YTN; PAM sequence: CTG
tgccgtgccccgggcactca

SEQ ID NO: 18563 - DNA, 20 bp, Artificial Sequence
  Description of Artificial Sequence: Synthetic oligonucleotide
  Target: DMPK; (+) strand; PAM type: YTN; PAM sequence: CTC
agtcttccaacggggccccg

SEQ ID NO: 18564 - DNA, 20 bp, Artificial Sequence
  Description of Artificial Sequence: Synthetic oligonucleotide
  Target: DMPK; (+) strand; PAM type: YTN; PAM sequence: CTT
ccaacggggccccggagtcg

SEQ ID NO: 18565 - DNA, 20 bp, Artificial Sequence
  Description of Artificial Sequence: Synthetic oligonucleotide
  Target: DMPK; (+) strand; PAM type: YTN; PAM sequence: TTC
caacggggccccggagtcga

SEQ ID NO: 18566 - DNA, 20 bp, Artificial Sequence
  Description of Artificial Sequence: Synthetic oligonucleotide
  Target: DMPK; (+) strand; PAM type: YTN; PAM sequence: TTC
tagggttcagggagcgcggg

SEQ ID NO: 18567 - DNA, 20 bp, Artificial Sequence
  Description of Artificial Sequence: Synthetic oligonucleotide
  Target: DMPK; (+) strand; PAM type: YTN; PAM sequence: CTA
gggttcagggagcgcgggcg

SEQ ID NO: 18568 - DNA, 20 bp, Artificial Sequence
  Description of Artificial Sequence: Synthetic oligonucleotide
  Target: DMPK; (+) strand; PAM type: YTN; PAM sequence: TTC
agggagcgcgggcggctcct

SEQ ID NO: 18569 - DNA, 20 bp, Artificial Sequence
  Description of Artificial Sequence: Synthetic oligonucleotide
  Target: DMPK; (+) strand; PAM type: YTN; PAM sequence: CTC
ctgggcggcgccagactgcg

SEQ ID NO: 18570 - DNA, 20 bp, Artificial Sequence
  Description of Artificial Sequence: Synthetic oligonucleotide
  Target: DMPK; (+) strand; PAM type: YTN; PAM sequence: CTG
ggcggcgccagactgcggtg

SEQ ID NO: 18571 - DNA, 20 bp, Artificial Sequence
  Description of Artificial Sequence: Synthetic oligonucleotide
  Target: DMPK; (+) strand; PAM type: YTN; PAM sequence: CTG
cggtgagttggccggcgtgg

SEQ ID NO: 18572 - DNA, 20 bp, Artificial Sequence
  Description of Artificial Sequence: Synthetic oligonucleotide
  Target: DMPK; (+) strand; PAM type: YTN; PAM sequence: TTG
gccggcgtgggccaccaacc

SEQ ID NO: 18573 - DNA, 20 bp, Artificial Sequence
  Description of Artificial Sequence: Synthetic oligonucleotide
  Target: DMPK; (+) strand; PAM type: YTN; PAM sequence: CTC
cgataggccaggcctaggga

SEQ ID NO: 18574 - DNA, 20 bp, Artificial Sequence
  Description of Artificial Sequence: Synthetic oligonucleotide
  Target: DMPK; (+) strand; PAM type: YTN; PAM sequence: CTA
gggacctgcggggagagggc

SEQ ID NO: 18575 - DNA, 20 bp, Artificial Sequence
  Description of Artificial Sequence: Synthetic oligonucleotide
  Target: DMPK; (+) strand; PAM type: YTN; PAM sequence: CTG
cggggagagggcgaggtcaa

SEQ ID NO: 18576 - DNA, 20 bp, Artificial Sequence
  Description of Artificial Sequence: Synthetic oligonucleotide
  Target: DMPK; (+) strand; PAM type: YTN; PAM sequence: CTC
tgattggctcctgggactcg

SEQ ID NO: 18577 - DNA, 20 bp, Artificial Sequence
  Description of Artificial Sequence: Synthetic oligonucleotide
  Target: DMPK; (+) strand; PAM type: YTN; PAM sequence: CTG
attggctcctgggactcgcc

SEQ ID NO: 18578 - DNA, 20 bp, Artificial Sequence
  Description of Artificial Sequence: Synthetic oligonucleotide
  Target: DMPK; (+) strand; PAM type: YTN; PAM sequence: TTG
gctcctgggactcgccccgc

SEQ ID NO: 18579 - DNA, 20 bp, Artificial Sequence
  Description of Artificial Sequence: Synthetic oligonucleotide
  Target: DMPK; (+) strand; PAM type: YTN; PAM sequence: CTC
ctgggactcgccccgcctac

SEQ ID NO: 18580 - DNA, 20 bp, Artificial Sequence
  Description of Artificial Sequence: Synthetic oligonucleotide
  Target: DMPK; (+) strand; PAM type: YTN; PAM sequence: CTG
ggactcgccccgcctacgcc

SEQ ID NO: 18581 - DNA, 20 bp, Artificial Sequence
  Description of Artificial Sequence: Synthetic oligonucleotide
  Target: DMPK; (+) strand; PAM type: YTN; PAM sequence: CTC
gccccgcctacgcccatagg

SEQ ID NO: 18582 - DNA, 20 bp, Artificial Sequence
  Description of Artificial Sequence: Synthetic oligonucleotide
  Target: DMPK; (+) strand; PAM type: YTN; PAM sequence: CTA
cgcccataggtgggcccgca

SEQ ID NO: 18583 - DNA, 20 bp, Artificial Sequence
  Description of Artificial Sequence: Synthetic oligonucleotide
  Target: DMPK; (+) strand; PAM type: YTN; PAM sequence: CTC
ttccctgcgccccgcccccg

SEQ ID NO: 18584 - DNA, 20 bp, Artificial Sequence
  Description of Artificial Sequence: Synthetic oligonucleotide
  Target: DMPK; (+) strand; PAM type: YTN; PAM sequence: CTT
ccctgcgccccgcccccgcc

SEQ ID NO: 18585 - DNA, 20 bp, Artificial Sequence
  Description of Artificial Sequence: Synthetic oligonucleotide
  Target: DMPK; (+) strand; PAM type: YTN; PAM sequence: TTC
cctgcgccccgcccccgccc

SEQ ID NO: 18586 - DNA, 20 bp, Artificial Sequence
  Description of Artificial Sequence: Synthetic oligonucleotide
  Target: DMPK; (+) strand; PAM type: YTN; PAM sequence: CTG
cgccccgcccccgccccaac

SEQ ID NO: 18587 - DNA, 20 bp, Artificial Sequence
  Description of Artificial Sequence: Synthetic oligonucleotide
  Target: DMPK; (+) strand; PAM type: YTN; PAM sequence: CTA
cagctgttgttagtccactc

SEQ ID NO: 18588 - DNA, 20 bp, Artificial Sequence
  Description of Artificial Sequence: Synthetic oligonucleotide
  Target: DMPK; (+) strand; PAM type: YTN; PAM sequence: CTG
ttgttagtccactcgcacgc

SEQ ID NO: 18589 - DNA, 20 bp, Artificial Sequence
  Description of Artificial Sequence: Synthetic oligonucleotide
  Target: DMPK; (+) strand; PAM type: YTN; PAM sequence: TTG
ttagtccactcgcacgcctc

SEQ ID NO: 18590 - DNA, 20 bp, Artificial Sequence
  Description of Artificial Sequence: Synthetic oligonucleotide
  Target: DMPK; (+) strand; PAM type: YTN; PAM sequence: TTA
gtccactcgcacgcctcgaa

SEQ ID NO: 18591 - DNA, 20 bp, Artificial Sequence
  Description of Artificial Sequence: Synthetic oligonucleotide
  Target: DMPK; (+) strand; PAM type: YTN; PAM sequence: CTC
gcacgcctcgaatcccgtcc

SEQ ID NO: 18592 - DNA, 20 bp, Artificial Sequence
  Description of Artificial Sequence: Synthetic oligonucleotide
  Target: DMPK; (+) strand; PAM type: YTN; PAM sequence: CTC
gaatcccgtccgaactcgtc

SEQ ID NO: 18593 - DNA, 20 bp, Artificial Sequence
  Description of Artificial Sequence: Synthetic oligonucleotide
  Target: DMPK; (+) strand; PAM type: YTN; PAM sequence: CTC
gtcattggctgcttcctagc

SEQ ID NO: 18594 - DNA, 20 bp, Artificial Sequence
  Description of Artificial Sequence: Synthetic oligonucleotide
  Target: DMPK; (+) strand; PAM type: YTN; PAM sequence: TTG
gctgcttcctagcggcctgt

SEQ ID NO: 18595 - DNA, 20 bp, Artificial Sequence
  Description of Artificial Sequence: Synthetic oligonucleotide
  Target: DMPK; (+) strand; PAM type: YTN; PAM sequence: CTG
cttcctagcggcctgtgttg

SEQ ID NO: 18596 - DNA, 20 bp, Artificial Sequence
  Description of Artificial Sequence: Synthetic oligonucleotide
  Target: DMPK; (+) strand; PAM type: YTN; PAM sequence: CTT
cctagcggcctgtgttgatt

SEQ ID NO: 18597 - DNA, 20 bp, Artificial Sequence
  Description of Artificial Sequence: Synthetic oligonucleotide
  Target: DMPK; (+) strand; PAM type: YTN; PAM sequence: TTC
ctagcggcctgtgttgattg

SEQ ID NO: 18598 - DNA, 20 bp, Artificial Sequence
  Description of Artificial Sequence: Synthetic oligonucleotide
  Target: DMPK; (+) strand; PAM type: YTN; PAM sequence: CTA
gcggcctgtgttgattggct

SEQ ID NO: 18599 - DNA, 20 bp, Artificial Sequence
  Description of Artificial Sequence: Synthetic oligonucleotide
  Target: DMPK; (+) strand; PAM type: YTN; PAM sequence: CTG
tgttgattggctgcccgaag

SEQ ID NO: 18600 - DNA, 20 bp, Artificial Sequence
  Description of Artificial Sequence: Synthetic oligonucleotide
  Target: DMPK; (+) strand; PAM type: YTN; PAM sequence: TTG
attggctgcccgaagatccg

SEQ ID NO: 18601 - DNA, 20 bp, Artificial Sequence
  Description of Artificial Sequence: Synthetic oligonucleotide
  Target: DMPK; (+) strand; PAM type: YTN; PAM sequence: TTG
gctgcccgaagatccgccct

SEQ ID NO: 18602 - DNA, 20 bp, Artificial Sequence
  Description of Artificial Sequence: Synthetic oligonucleotide
  Target: DMPK; (+) strand; PAM type: YTN; PAM sequence: CTG
cccgaagatccgccctcctg

SEQ ID NO: 18603 - DNA, 20 bp, Artificial Sequence
  Description of Artificial Sequence: Synthetic oligonucleotide
  Target: DMPK; (+) strand; PAM type: YTN; PAM sequence: CTC
ctgccgtgggcccagccccg

SEQ ID NO: 18604 - DNA, 20 bp, Artificial Sequence
  Description of Artificial Sequence: Synthetic oligonucleotide
  Target: DMPK; (+) strand; PAM type: YTN; PAM sequence: CTG
ccgtgggcccagccccgcaa

SEQ ID NO: 18605 - DNA, 20 bp, Artificial Sequence
  Description of Artificial Sequence: Synthetic oligonucleotide
  Target: DMPK; (+) strand; PAM type: YTN; PAM sequence: CTA
agcgggtggcaaggggcggg

SEQ ID NO: 18606 - DNA, 20 bp, Artificial Sequence
  Description of Artificial Sequence: Synthetic oligonucleotide
  Target: DMPK; (+) strand; PAM type: YTN; PAM sequence: CTG
gcagggagcagcaggtggcg

SEQ ID NO: 18607 - DNA, 20 bp, Artificial Sequence
  Description of Artificial Sequence: Synthetic oligonucleotide
  Target: DMPK; (+) strand; PAM type: YTN; PAM sequence: CTG
gccccaccagcgggcactgg

SEQ ID NO: 18608 - DNA, 20 bp, Artificial Sequence
  Description of Artificial Sequence: Synthetic oligonucleotide
  Target: DMPK; (+) strand; PAM type: YTN; PAM sequence: CTG
gcccacagccacggccgggg

SEQ ID NO: 18609 - DNA, 20 bp, Artificial Sequence
  Description of Artificial Sequence: Synthetic oligonucleotide
  Target: DMPK; (+) strand; PAM type: YTN; PAM sequence: CTA
gctggagagagaagggacag

SEQ ID NO: 18610 - DNA, 20 bp, Artificial Sequence
  Description of Artificial Sequence: Synthetic oligonucleotide
  Target: DMPK; (+) strand; PAM type: YTN; PAM sequence: CTG
gagagagaagggacaggtga

SEQ ID NO: 18611 - DNA, 20 bp, Artificial Sequence
  Description of Artificial Sequence: Synthetic oligonucleotide
  Target: DMPK; (+) strand; PAM type: YTN; PAM sequence: CTC
agcggtggggcgagagacag

SEQ ID NO: 18612 - DNA, 20 bp, Artificial Sequence
  Description of Artificial Sequence: Synthetic oligonucleotide
  Target: DMPK; (+) strand; PAM type: YTN; PAM sequence: TTG
gggaggttatctagggagat

SEQ ID NO: 18613 - DNA, 20 bp, Artificial Sequence
  Description of Artificial Sequence: Synthetic oligonucleotide
  Target: DMPK; (+) strand; PAM type: YTN; PAM sequence: TTA
tctagggagatcccggaggg

SEQ ID NO: 18614 - DNA, 20 bp, Artificial Sequence
  Description of Artificial Sequence: Synthetic oligonucleotide
  Target: DMPK; (+) strand; PAM type: YTN; PAM sequence: CTA
gggagatcccggagggaatc

SEQ ID NO: 18615 - DNA, 20 bp, Artificial Sequence
  Description of Artificial Sequence: Synthetic oligonucleotide
  Target: DMPK; (+) strand; PAM type: YTN; PAM sequence: CTG
gtgaggcctgaacggaggga

SEQ ID NO: 18616 - DNA, 20 bp, Artificial Sequence
  Description of Artificial Sequence: Synthetic oligonucleotide
  Target: DMPK; (+) strand; PAM type: YTN; PAM sequence: CTG
aacggagggagatctggggc

SEQ ID NO: 18617 - DNA, 20 bp, Artificial Sequence
  Description of Artificial Sequence: Synthetic oligonucleotide
  Target: DMPK; (+) strand; PAM type: YTN; PAM sequence: CTG
gggctgaataaagggcttct

SEQ ID NO: 18618 - DNA, 20 bp, Artificial Sequence
  Description of Artificial Sequence: Synthetic oligonucleotide
  Target: DMPK; (+) strand; PAM type: YTN; PAM sequence: CTG
aataaagggcttctgccctc

SEQ ID NO: 18619 - DNA, 20 bp, Artificial Sequence
  Description of Artificial Sequence: Synthetic oligonucleotide
  Target: DMPK; (+) strand; PAM type: YTN; PAM sequence: CTT
ctgccctctaaagtcgcaaa

SEQ ID NO: 18620 - DNA, 20 bp, Artificial Sequence
  Description of Artificial Sequence: Synthetic oligonucleotide
  Target: DMPK; (+) strand; PAM type: YTN; PAM sequence: TTC
tgccctctaaagtcgcaaag

SEQ ID NO: 18621 - DNA, 20 bp, Artificial Sequence
  Description of Artificial Sequence: Synthetic oligonucleotide
  Target: DMPK; (+) strand; PAM type: YTN; PAM sequence: CTG
ccctctaaagtcgcaaagac

SEQ ID NO: 18622 - DNA, 20 bp, Artificial Sequence
  Description of Artificial Sequence: Synthetic oligonucleotide
  Target: DMPK; (+) strand; PAM type: YTN; PAM sequence: CTC
taaagtcgcaaagacgtagg

SEQ ID NO: 18623 - DNA, 20 bp, Artificial Sequence
  Description of Artificial Sequence: Synthetic oligonucleotide
  Target: DMPK; (+) strand; PAM type: YTN; PAM sequence: CTA
aagtcgcaaagacgtagggt

SEQ ID NO: 18624 - DNA, 20 bp, Artificial Sequence
  Description of Artificial Sequence: Synthetic oligonucleotide
  Target: DMPK; (+) strand; PAM type: YTN; PAM sequence: CTA
tatctggacggggagaccag

SEQ ID NO: 18625 - DNA, 20 bp, Artificial Sequence
  Description of Artificial Sequence: Synthetic oligonucleotide
  Target: DMPK; (+) strand; PAM type: YTN; PAM sequence: CTG
gacggggagaccaggagcca

SEQ ID NO: 18626 - DNA, 20 bp, Artificial Sequence
  Description of Artificial Sequence: Synthetic oligonucleotide
  Target: DMPK; (+) strand; PAM type: YTN; PAM sequence: CTG
cagaatgggcagcaggtctg

SEQ ID NO: 18627 - DNA, 20 bp, Artificial Sequence
  Description of Artificial Sequence: Synthetic oligonucleotide
  Target: DMPK; (+) strand; PAM type: YTN; PAM sequence: CTG
aggcaggggaaagagagggg

SEQ ID NO: 18628 - DNA, 20 bp, Artificial Sequence
  Description of Artificial Sequence: Synthetic oligonucleotide
  Target: DMPK; (+) strand; PAM type: YTN; PAM sequence: CTT
acatgggaaggtggatccgt

SEQ ID NO: 18629 - DNA, 20 bp, Artificial Sequence
  Description of Artificial Sequence: Synthetic oligonucleotide
  Target: DMPK; (+) strand; PAM type: YTN; PAM sequence: TTA
catgggaaggtggatccgtg

SEQ ID NO: 18630 - DNA, 20 bp, Artificial Sequence
  Description of Artificial Sequence: Synthetic oligonucleotide
  Target: DMPK; (+) strand; PAM type: YTN; PAM sequence: CTG
gggacccccgtgacagctgg

SEQ ID NO: 18631 - DNA, 20 bp, Artificial Sequence
  Description of Artificial Sequence: Synthetic oligonucleotide
  Target: DMPK; (+) strand; PAM type: YTN; PAM sequence: CTG
gaaggagaagaaagaggcat

SEQ ID NO: 18632 - DNA, 20 bp, Artificial Sequence
  Description of Artificial Sequence: Synthetic oligonucleotide
  Target: DMPK; (+) strand; PAM type: YTN; PAM sequence: CTT
ccctcctccaggtgtctata

SEQ ID NO: 18633 - DNA, 20 bp, Artificial Sequence
  Description of Artificial Sequence: Synthetic oligonucleotide
  Target: DMPK; (+) strand; PAM type: YTN; PAM sequence: TTC
cctcctccaggtgtctatac

SEQ ID NO: 18634 - DNA, 20 bp, Artificial Sequence
  Description of Artificial Sequence: Synthetic oligonucleotide
  Target: DMPK; (+) strand; PAM type: YTN; PAM sequence: CTC
ctccaggtgtctatacacgc

SEQ ID NO: 18635 - DNA, 20 bp, Artificial Sequence
  Description of Artificial Sequence: Synthetic oligonucleotide
  Target: DMPK; (+) strand; PAM type: YTN; PAM sequence: CTC
caggtgtctatacacgcccc

SEQ ID NO: 18636 - DNA, 20 bp, Artificial Sequence
  Description of Artificial Sequence: Synthetic oligonucleotide
  Target: DMPK; (+) strand; PAM type: YTN; PAM sequence: CTA
tacacgccccgcggagcaga

SEQ ID NO: 18637 - DNA, 20 bp, Artificial Sequence
  Description of Artificial Sequence: Synthetic oligonucleotide
  Target: DMPK; (+) strand; PAM type: YTN; PAM sequence: CTC
ctcccggtcctccggggaag

SEQ ID NO: 18638 - DNA, 20 bp, Artificial Sequence
  Description of Artificial Sequence: Synthetic oligonucleotide
  Target: DMPK; (+) strand; PAM type: YTN; PAM sequence: CTC
ccggtcctccggggaagggg

SEQ ID NO: 18639 - DNA, 20 bp, Artificial Sequence
  Description of Artificial Sequence: Synthetic oligonucleotide
  Target: DMPK; (+) strand; PAM type: YTN; PAM sequence: CTC
cggggaaggggacacatgag

SEQ ID NO: 18640 - DNA, 20 bp, Artificial Sequence
  Description of Artificial Sequence: Synthetic oligonucleotide
  Target: DMPK; (+) strand; PAM type: YTN; PAM sequence: CTC
acctgtggctccctctgcct

SEQ ID NO: 18641 - DNA, 20 bp, Artificial Sequence
  Description of Artificial Sequence: Synthetic oligonucleotide
  Target: DMPK; (+) strand; PAM type: YTN; PAM sequence: CTG
tggctccctctgcctgcagc

SEQ ID NO: 18642 - DNA, 20 bp, Artificial Sequence
  Description of Artificial Sequence: Synthetic oligonucleotide
  Target: DMPK; (+) strand; PAM type: YTN; PAM sequence: CTC
cctctgcctgcagcaactcc

SEQ ID NO: 18643 - DNA, 20 bp, Artificial Sequence
  Description of Artificial Sequence: Synthetic oligonucleotide
  Target: DMPK; (+) strand; PAM type: YTN; PAM sequence: CTC
tgcctgcagcaactccatcc

SEQ ID NO: 18644 - DNA, 20 bp, Artificial Sequence
  Description of Artificial Sequence: Synthetic oligonucleotide
  Target: DMPK; (+) strand; PAM type: YTN; PAM sequence: CTG
cctgcagcaactccatccgc

SEQ ID NO: 18645 - DNA, 20 bp, Artificial Sequence
  Description of Artificial Sequence: Synthetic oligonucleotide
  Target: DMPK; (+) strand; PAM type: YTN; PAM sequence: CTG
cagcaactccatccgctcct

SEQ ID NO: 18646 - DNA, 20 bp, Artificial Sequence
  Description of Artificial Sequence: Synthetic oligonucleotide
  Target: DMPK; (+) strand; PAM type: YTN; PAM sequence: CTC
catccgctcctgcaactgcc

SEQ ID NO: 18647 - DNA, 20 bp, Artificial Sequence
  Description of Artificial Sequence: Synthetic oligonucleotide
  Target: DMPK; (+) strand; PAM type: YTN; PAM sequence: CTC
ctgcaactgccggacgtgtg

SEQ ID NO: 18648 - DNA, 20 bp, Artificial Sequence
  Description of Artificial Sequence: Synthetic oligonucleotide
  Target: DMPK; (+) strand; PAM type: YTN; PAM sequence: CTG
caactgccggacgtgtgcct

SEQ ID NO: 18649 - DNA, 20 bp, Artificial Sequence
  Description of Artificial Sequence: Synthetic oligonucleotide
  Target: DMPK; (+) strand; PAM type: YTN; PAM sequence: CTG
ccggacgtgtgcctctaggt

SEQ ID NO: 18650 - DNA, 20 bp, Artificial Sequence
  Description of Artificial Sequence: Synthetic oligonucleotide
  Target: DMPK; (+) strand; PAM type: YTN; PAM sequence: CTC
taggtcccggttccgagcct

SEQ ID NO: 18651 - DNA, 20 bp, Artificial Sequence
  Description of Artificial Sequence: Synthetic oligonucleotide
  Target: DMPK; (+) strand; PAM type: YTN; PAM sequence: CTA
ggtcccggttccgagcctct

SEQ ID NO: 18652 - DNA, 20 bp, Artificial Sequence
  Description of Artificial Sequence: Synthetic oligonucleotide
  Target: DMPK; (+) strand; PAM type: YTN; PAM sequence: TTC
cgagcctctgcctcgcgtag

SEQ ID NO: 18653 - DNA, 20 bp, Artificial Sequence
  Description of Artificial Sequence: Synthetic oligonucleotide
  Target: DMPK; (+) strand; PAM type: YTN; PAM sequence: CTC
tgcctcgcgtagttgactgt

SEQ ID NO: 18654 - DNA, 20 bp, Artificial Sequence
  Description of Artificial Sequence: Synthetic oligonucleotide
  Target: DMPK; (+) strand; PAM type: YTN; PAM sequence: CTG
cctcgcgtagttgactgtgg

SEQ ID NO: 18655 - DNA, 20 bp, Artificial Sequence
  Description of Artificial Sequence: Synthetic oligonucleotide
  Target: DMPK; (+) strand; PAM type: YTN; PAM sequence: CTC
gcgtagttgactgtggggag

SEQ ID NO: 18656 - DNA, 20 bp, Artificial Sequence
  Description of Artificial Sequence: Synthetic oligonucleotide
  Target: DMPK; (+) strand; PAM type: YTN; PAM sequence: TTG
actgtggggaggtaaggacg

SEQ ID NO: 18657 - DNA, 20 bp, Artificial Sequence
  Description of Artificial Sequence: Synthetic oligonucleotide
  Target: DMPK; (+) strand; PAM type: YTN; PAM sequence: CTG
tggggaggtaaggacggtga

SEQ ID NO: 18658 - DNA, 20 bp, Artificial Sequence
  Description of Artificial Sequence: Synthetic oligonucleotide
  Target: DMPK; (+) strand; PAM type: YTN; PAM sequence: TTG
ccaccggcccgcatcccggc

SEQ ID NO: 18659 - DNA, 20 bp, Artificial Sequence
  Description of Artificial Sequence: Synthetic oligonucleotide
  Target: DMPK; (+) strand; PAM type: YTN; PAM sequence: CTG
gcgaagttctggttgtccgt

SEQ ID NO: 18660 - DNA, 20 bp, Artificial Sequence
  Description of Artificial Sequence: Synthetic oligonucleotide
  Target: DMPK; (+) strand; PAM type: YTN; PAM sequence: TTC
tggttgtccgtgcggatggc

SEQ ID NO: 18661 - DNA, 20 bp, Artificial Sequence
  Description of Artificial Sequence: Synthetic oligonucleotide
  Target: DMPK; (+) strand; PAM type: YTN; PAM sequence: CTG
gttgtccgtgcggatggcct

SEQ ID NO: 18662 - DNA, 20 bp, Artificial Sequence
  Description of Artificial Sequence: Synthetic oligonucleotide
  Target: DMPK; (+) strand; PAM type: YTN; PAM sequence: TTG
tccgtgcggatggcctccat

SEQ ID NO: 18663 - DNA, 20 bp, Artificial Sequence
  Description of Artificial Sequence: Synthetic oligonucleotide
  Target: DMPK; (+) strand; PAM type: YTN; PAM sequence: CTC
catctcccggctcaggctct

SEQ ID NO: 18664 - DNA, 20 bp, Artificial Sequence
  Description of Artificial Sequence: Synthetic oligonucleotide
  Target: DMPK; (+) strand; PAM type: YTN; PAM sequence: CTC
ccggctcaggctctgccggg

SEQ ID NO: 18665 - DNA, 20 bp, Artificial Sequence
  Description of Artificial Sequence: Synthetic oligonucleotide
  Target: DMPK; (+) strand; PAM type: YTN; PAM sequence: CTC
aggctctgccgggtgagcac

SEQ ID NO: 18666 - DNA, 20 bp, Artificial Sequence
  Description of Artificial Sequence: Synthetic oligonucleotide
  Target: DMPK; (+) strand; PAM type: YTN; PAM sequence: CTC
tgccgggtgagcacctcctc

SEQ ID NO: 18667 - DNA, 20 bp, Artificial Sequence
  Description of Artificial Sequence: Synthetic oligonucleotide
  Target: DMPK; (+) strand; PAM type: YTN; PAM sequence: CTG
ccgggtgagcacctcctcct

SEQ ID NO: 18668 - DNA, 20 bp, Artificial Sequence
  Description of Artificial Sequence: Synthetic oligonucleotide
  Target: DMPK; (+) strand; PAM type: YTN; PAM sequence: CTC
ctcctccagggcttcctgga

SEQ ID NO: 18669 - DNA, 20 bp, Artificial Sequence
  Description of Artificial Sequence: Synthetic oligonucleotide
  Target: DMPK; (+) strand; PAM type: YTN; PAM sequence: CTC
ctccagggcttcctggagct

SEQ ID NO: 18670 - DNA, 20 bp, Artificial Sequence
  Description of Artificial Sequence: Synthetic oligonucleotide
  Target: DMPK; (+) strand; PAM type: YTN; PAM sequence: CTC
cagggcttcctggagctccc

SEQ ID NO: 18671 - DNA, 20 bp, Artificial Sequence
  Description of Artificial Sequence: Synthetic oligonucleotide
  Target: DMPK; (+) strand; PAM type: YTN; PAM sequence: CTT
cctggagctcccgcagcgtc

SEQ ID NO: 18672 - DNA, 20 bp, Artificial Sequence
  Description of Artificial Sequence: Synthetic oligonucleotide
  Target: DMPK; (+) strand; PAM type: YTN; PAM sequence: TTC
ctggagctcccgcagcgtca

SEQ ID NO: 18673 - DNA, 20 bp, Artificial Sequence
  Description of Artificial Sequence: Synthetic oligonucleotide
  Target: DMPK; (+) strand; PAM type: YTN; PAM sequence: CTG
gagctcccgcagcgtcacct

SEQ ID NO: 18674 - DNA, 20 bp, Artificial Sequence
  Description of Artificial Sequence: Synthetic oligonucleotide
  Target: DMPK; (+) strand; PAM type: YTN; PAM sequence: CTC
ccgcagcgtcacctcggcct

SEQ ID NO: 18675 - DNA, 20 bp, Artificial Sequence
  Description of Artificial Sequence: Synthetic oligonucleotide
  Target: DMPK; (+) strand; PAM type: YTN; PAM sequence: CTC
ggcctcagcctctgccgcag

SEQ ID NO: 18676 - DNA, 20 bp, Artificial Sequence
  Description of Artificial Sequence: Synthetic oligonucleotide
  Target: DMPK; (+) strand; PAM type: YTN; PAM sequence: CTC
agcctctgccgcagggacag

SEQ ID NO: 18677 - DNA, 20 bp, Artificial Sequence
  Description of Artificial Sequence: Synthetic oligonucleotide
  Target: DMPK; (+) strand; PAM type: YTN; PAM sequence: CTC
tgccgcagggacagccgctg

SEQ ID NO: 18678 - DNA, 20 bp, Artificial Sequence
  Description of Artificial Sequence: Synthetic oligonucleotide
  Target: DMPK; (+) strand; PAM type: YTN; PAM sequence: CTG
ccgcagggacagccgctgga

SEQ ID NO: 18679 - DNA, 20 bp, Artificial Sequence
  Description of Artificial Sequence: Synthetic oligonucleotide
  Target: DMPK; (+) strand; PAM type: YTN; PAM sequence: CTG
gaactgccacttcagcctgt

SEQ ID NO: 18680 - DNA, 20 bp, Artificial Sequence
  Description of Artificial Sequence: Synthetic oligonucleotide
  Target: DMPK; (+) strand; PAM type: YTN; PAM sequence: CTG
ccacttcagcctgtgtatgg

SEQ ID NO: 18681 - DNA, 20 bp, Artificial Sequence
  Description of Artificial Sequence: Synthetic oligonucleotide
  Target: DMPK; (+) strand; PAM type: YTN; PAM sequence: CTT
cagcctgtgtatggggacca

SEQ ID NO: 18682 - DNA, 20 bp, Artificial Sequence
  Description of Artificial Sequence: Synthetic oligonucleotide
  Target: DMPK; (+) strand; PAM type: YTN; PAM sequence: TTC
agcctgtgtatggggaccag

SEQ ID NO: 18683 - DNA, 20 bp, Artificial Sequence
  Description of Artificial Sequence: Synthetic oligonucleotide
  Target: DMPK; (+) strand; PAM type: YTN; PAM sequence: CTG
tgtatggggaccaggcttaa

SEQ ID NO: 18684 - DNA, 20 bp, Artificial Sequence
  Description of Artificial Sequence: Synthetic oligonucleotide
  Target: DMPK; (+) strand; PAM type: YTN; PAM sequence: CTT
aaggctgcctgtggctcctg

SEQ ID NO: 18685 - DNA, 20 bp, Artificial Sequence
  Description of Artificial Sequence: Synthetic oligonucleotide
  Target: DMPK; (+) strand; PAM type: YTN; PAM sequence: TTA
aggctgcctgtggctcctgg

SEQ ID NO: 18686 - DNA, 20 bp, Artificial Sequence
  Description of Artificial Sequence: Synthetic oligonucleotide
  Target: DMPK; (+) strand; PAM type: YTN; PAM sequence: CTG
cctgtggctcctggaagact

SEQ ID NO: 18687 - DNA, 20 bp, Artificial Sequence
  Description of Artificial Sequence: Synthetic oligonucleotide
  Target: DMPK; (+) strand; PAM type: YTN; PAM sequence: CTG
tggctcctggaagactcagg

SEQ ID NO: 18688 - DNA, 20 bp, Artificial Sequence
  Description of Artificial Sequence: Synthetic oligonucleotide
  Target: DMPK; (+) strand; PAM type: YTN; PAM sequence: CTC
ctggaagactcaggacttgg

SEQ ID NO: 18689 - DNA, 20 bp, Artificial Sequence
  Description of Artificial Sequence: Synthetic oligonucleotide
  Target: DMPK; (+) strand; PAM type: YTN; PAM sequence: CTG
gaagactcaggacttgggca

SEQ ID NO: 18690 - DNA, 20 bp, Artificial Sequence
  Description of Artificial Sequence: Synthetic oligonucleotide
  Target: DMPK; (+) strand; PAM type: YTN; PAM sequence: CTC
aggacttgggcactggttcc

SEQ ID NO: 18691 - DNA, 20 bp, Artificial Sequence
  Description of Artificial Sequence: Synthetic oligonucleotide
  Target: DMPK; (+) strand; PAM type: YTN; PAM sequence: CTT
gggcactggttccaggctag

SEQ ID NO: 18692 - DNA, 20 bp, Artificial Sequence
  Description of Artificial Sequence: Synthetic oligonucleotide
  Target: DMPK; (+) strand; PAM type: YTN; PAM sequence: TTG
ggcactggttccaggctagg

SEQ ID NO: 18693 - DNA, 20 bp, Artificial Sequence
  Description of Artificial Sequence: Synthetic oligonucleotide
  Target: DMPK; (+) strand; PAM type: YTN; PAM sequence: CTG
gttccaggctaggaatcctt

SEQ ID NO: 18694 - DNA, 20 bp, Artificial Sequence
  Description of Artificial Sequence: Synthetic oligonucleotide
  Target: DMPK; (+) strand; PAM type: YTN; PAM sequence: TTC
caggctaggaatccttgttt

SEQ ID NO: 18695 - DNA, 20 bp, Artificial Sequence
  Description of Artificial Sequence: Synthetic oligonucleotide
  Target: DMPK; (+) strand; PAM type: YTN; PAM sequence: CTA
ggaatccttgtttatcccct

SEQ ID NO: 18696 - DNA, 20 bp, Artificial Sequence
  Description of Artificial Sequence: Synthetic oligonucleotide
  Target: DMPK; (+) strand; PAM type: YTN; PAM sequence: CTT
gtttatcccctactcctccg

SEQ ID NO: 18697 - DNA, 20 bp, Artificial Sequence
  Description of Artificial Sequence: Synthetic oligonucleotide
  Target: DMPK; (+) strand; PAM type: YTN; PAM sequence: TTG
tttatcccctactcctccgt

SEQ ID NO: 18698 - DNA, 20 bp, Artificial Sequence
  Description of Artificial Sequence: Synthetic oligonucleotide
  Target: DMPK; (+) strand; PAM type: YTN; PAM sequence: TTT
atcccctactcctccgtccc

SEQ ID NO: 18699 - DNA, 20 bp, Artificial Sequence
  Description of Artificial Sequence: Synthetic oligonucleotide
  Target: DMPK; (+) strand; PAM type: YTN; PAM sequence: TTA
tcccctactcctccgtcccc

SEQ ID NO: 18700 - DNA, 20 bp, Artificial Sequence
  Description of Artificial Sequence: Synthetic oligonucleotide
  Target: DMPK; (+) strand; PAM type: YTN; PAM sequence: CTA
ctcctccgtcccctcaacat

SEQ ID NO: 18701 - DNA, 20 bp, Artificial Sequence
  Description of Artificial Sequence: Synthetic oligonucleotide
  Target: DMPK; (+) strand; PAM type: YTN; PAM sequence: CTC
ctccgtcccctcaacatttc

SEQ ID NO: 18702 - DNA, 20 bp, Artificial Sequence
  Description of Artificial Sequence: Synthetic oligonucleotide
  Target: DMPK; (+) strand; PAM type: YTN; PAM sequence: CTC
cgtcccctcaacatttctgg

SEQ ID NO: 18703 - DNA, 20 bp, Artificial Sequence
  Description of Artificial Sequence: Synthetic oligonucleotide
  Target: DMPK; (+) strand; PAM type: YTN; PAM sequence: CTC
aacatttctggaatccccat

SEQ ID NO: 18704 - DNA, 20 bp, Artificial Sequence
  Description of Artificial Sequence: Synthetic oligonucleotide
  Target: DMPK; (+) strand; PAM type: YTN; PAM sequence: TTT
ctggaatccccatagctcct

SEQ ID NO: 18705 - DNA, 20 bp, Artificial Sequence
  Description of Artificial Sequence: Synthetic oligonucleotide
  Target: DMPK; (+) strand; PAM type: YTN; PAM sequence: TTC
tggaatccccatagctcctg

SEQ ID NO: 18706 - DNA, 20 bp, Artificial Sequence
  Description of Artificial Sequence: Synthetic oligonucleotide
  Target: DMPK; (+) strand; PAM type: YTN; PAM sequence: CTG
gaatccccatagctcctgca

SEQ ID NO: 18707 - DNA, 20 bp, Artificial Sequence
  Description of Artificial Sequence: Synthetic oligonucleotide
  Target: DMPK; (+) strand; PAM type: YTN; PAM sequence: CTC
ctgcaatgatccaagccccc

SEQ ID NO: 18708 - DNA, 20 bp, Artificial Sequence
  Description of Artificial Sequence: Synthetic oligonucleotide
  Target: DMPK; (+) strand; PAM type: YTN; PAM sequence: CTG
caatgatccaagccccctcc

SEQ ID NO: 18709 - DNA, 20 bp, Artificial Sequence
  Description of Artificial Sequence: Synthetic oligonucleotide
  Target: DMPK; (+) strand; PAM type: YTN; PAM sequence: CTC
ccttccctacctccctcagc

SEQ ID NO: 18710 - DNA, 20 bp, Artificial Sequence
  Description of Artificial Sequence: Synthetic oligonucleotide
  Target: DMPK; (+) strand; PAM type: YTN; PAM sequence: CTT
ccctacctccctcagcccca

SEQ ID NO: 18711 - DNA, 20 bp, Artificial Sequence
  Description of Artificial Sequence: Synthetic oligonucleotide
  Target: DMPK; (+) strand; PAM type: YTN; PAM sequence: TTC
cctacctccctcagccccat

SEQ ID NO: 18712 - DNA, 20 bp, Artificial Sequence
  Description of Artificial Sequence: Synthetic oligonucleotide
  Target: DMPK; (+) strand; PAM type: YTN; PAM sequence: CTA
cctccctcagccccatccct

SEQ ID NO: 18713 - DNA, 20 bp, Artificial Sequence
  Description of Artificial Sequence: Synthetic oligonucleotide
  Target: DMPK; (+) strand; PAM type: YTN; PAM sequence: CTC
cctcagccccatccctgagt

SEQ ID NO: 18714 - DNA, 20 bp, Artificial Sequence
  Description of Artificial Sequence: Synthetic oligonucleotide
  Target: DMPK; (+) strand; PAM type: YTN; PAM sequence: CTC
agccccatccctgagtctgg

SEQ ID NO: 18715 - DNA, 20 bp, Artificial Sequence
  Description of Artificial Sequence: Synthetic oligonucleotide
  Target: DMPK; (+) strand; PAM type: YTN; PAM sequence: CTG
agtctggtcctctaaatcta

SEQ ID NO: 18716 - DNA, 20 bp, Artificial Sequence
  Description of Artificial Sequence: Synthetic oligonucleotide
  Target: DMPK; (+) strand; PAM type: YTN; PAM sequence: CTG
gtcctctaaatctacacagg

SEQ ID NO: 18717 - DNA, 20 bp, Artificial Sequence
  Description of Artificial Sequence: Synthetic oligonucleotide
  Target: DMPK; (+) strand; PAM type: YTN; PAM sequence: CTC
taaatctacacagggaccag

SEQ ID NO: 18718 - DNA, 20 bp, Artificial Sequence
  Description of Artificial Sequence: Synthetic oligonucleotide
  Target: DMPK; (+) strand; PAM type: YTN; PAM sequence: CTA
aatctacacagggaccagag

SEQ ID NO: 18719 - DNA, 20 bp, Artificial Sequence
  Description of Artificial Sequence: Synthetic oligonucleotide
  Target: DMPK; (+) strand; PAM type: YTN; PAM sequence: CTA
cacagggaccagagggctgg

SEQ ID NO: 18720 - DNA, 20 bp, Artificial Sequence
  Description of Artificial Sequence: Synthetic oligonucleotide
  Target: DMPK; (+) strand; PAM type: YTN; PAM sequence: CTG
gtgctcaaacactaacacaa

SEQ ID NO: 18721 - DNA, 20 bp, Artificial Sequence
  Description of Artificial Sequence: Synthetic oligonucleotide
  Target: DMPK; (+) strand; PAM type: YTN; PAM sequence: CTC
aaacactaacacaacctatg

SEQ ID NO: 18722 - DNA, 20 bp, Artificial Sequence
  Description of Artificial Sequence: Synthetic oligonucleotide
  Target: DMPK; (+) strand; PAM type: YTN; PAM sequence: CTA
acacaacctatgtccctctg

SEQ ID NO: 18723 - DNA, 20 bp, Artificial Sequence
  Description of Artificial Sequence: Synthetic oligonucleotide
  Target: DMPK; (+) strand; PAM type: YTN; PAM sequence: CTA
tgtccctctgctgctcaaaa

SEQ ID NO: 18724 - DNA, 20 bp, Artificial Sequence
  Description of Artificial Sequence: Synthetic oligonucleotide
  Target: DMPK; (+) strand; PAM type: YTN; PAM sequence: CTC
tgctgctcaaaatccctcca

SEQ ID NO: 18725 - DNA, 20 bp, Artificial Sequence
  Description of Artificial Sequence: Synthetic oligonucleotide
  Target: DMPK; (+) strand; PAM type: YTN; PAM sequence: CTG
ctgctcaaaatccctccagc

SEQ ID NO: 18726 - DNA, 20 bp, Artificial Sequence
  Description of Artificial Sequence: Synthetic oligonucleotide
  Target: DMPK; (+) strand; PAM type: YTN; PAM sequence: CTG
ctcaaaatccctccagctcc

SEQ ID NO: 18727 - DNA, 20 bp, Artificial Sequence
  Description of Artificial Sequence: Synthetic oligonucleotide
  Target: DMPK; (+) strand; PAM type: YTN; PAM sequence: CTC
aaaatccctccagctcccta

SEQ ID NO: 18728 - DNA, 20 bp, Artificial Sequence
  Description of Artificial Sequence: Synthetic oligonucleotide
  Target: DMPK; (+) strand; PAM type: YTN; PAM sequence: CTC
cagctccctaatgccctcac

SEQ ID NO: 18729 - DNA, 20 bp, Artificial Sequence
  Description of Artificial Sequence: Synthetic oligonucleotide
  Target: DMPK; (+) strand; PAM type: YTN; PAM sequence: CTC
cctaatgccctcacgacaaa

SEQ ID NO: 18730 - DNA, 20 bp, Artificial Sequence
  Description of Artificial Sequence: Synthetic oligonucleotide
  Target: DMPK; (+) strand; PAM type: YTN; PAM sequence: CTA
atgccctcacgacaaaaggc

SEQ ID NO: 18731 - DNA, 20 bp, Artificial Sequence
  Description of Artificial Sequence: Synthetic oligonucleotide
  Target: DMPK; (+) strand; PAM type: YTN; PAM sequence: CTC
acgacaaaaggccttgctgg

SEQ ID NO: 18732 - DNA, 20 bp, Artificial Sequence
  Description of Artificial Sequence: Synthetic oligonucleotide
  Target: DMPK; (+) strand; PAM type: YTN; PAM sequence: CTT
gctgggttttgtttcctgct

SEQ ID NO: 18733 - DNA, 20 bp, Artificial Sequence
  Description of Artificial Sequence: Synthetic oligonucleotide
  Target: DMPK; (+) strand; PAM type: YTN; PAM sequence: TTG
ctgggttttgtttcctgctg

SEQ ID NO: 18734 - DNA, 20 bp, Artificial Sequence
  Description of Artificial Sequence: Synthetic oligonucleotide
  Target: DMPK; (+) strand; PAM type: YTN; PAM sequence: CTG
ggttttgtttcctgctggcc

SEQ ID NO: 18735 - DNA, 20 bp, Artificial Sequence
  Description of Artificial Sequence: Synthetic oligonucleotide
  Target: DMPK; (+) strand; PAM type: YTN; PAM sequence: TTT
tgtttcctgctggcctctcc

SEQ ID NO: 18736 - DNA, 20 bp, Artificial Sequence
  Description of Artificial Sequence: Synthetic oligonucleotide
  Target: DMPK; (+) strand; PAM type: YTN; PAM sequence: TTT
gtttcctgctggcctctcca

SEQ ID NO: 18737 - DNA, 20 bp, Artificial Sequence
  Description of Artificial Sequence: Synthetic oligonucleotide
  Target: DMPK; (+) strand; PAM type: YTN; PAM sequence: TTG
tttcctgctggcctctccag

SEQ ID NO: 18738 - DNA, 20 bp, Artificial Sequence
  Description of Artificial Sequence: Synthetic oligonucleotide
  Target: DMPK; (+) strand; PAM type: YTN; PAM sequence: TTT
cctgctggcctctccagcct

SEQ ID NO: 18739 - DNA, 20 bp, Artificial Sequence
  Description of Artificial Sequence: Synthetic oligonucleotide
  Target: DMPK; (+) strand; PAM type: YTN; PAM sequence: TTC
ctgctggcctctccagcctt

SEQ ID NO: 18740 - DNA, 20 bp, Artificial Sequence
  Description of Artificial Sequence: Synthetic oligonucleotide
  Target: DMPK; (+) strand; PAM type: YTN; PAM sequence: CTG
ctggcctctccagccttctc

SEQ ID NO: 18741 - DNA, 20 bp, Artificial Sequence
  Description of Artificial Sequence: Synthetic oligonucleotide
  Target: DMPK; (+) strand; PAM type: YTN; PAM sequence: CTG
gcctctccagccttctcagg

SEQ ID NO: 18742 - DNA, 20 bp, Artificial Sequence
  Description of Artificial Sequence: Synthetic oligonucleotide
  Target: DMPK; (+) strand; PAM type: YTN; PAM sequence: CTC
tccagccttctcaggaatga

SEQ ID NO: 18743 - DNA, 20 bp, Artificial Sequence
  Description of Artificial Sequence: Synthetic oligonucleotide
  Target: DMPK; (+) strand; PAM type: YTN; PAM sequence: CTC
cagccttctcaggaatgatt

SEQ ID NO: 18744 - DNA, 20 bp, Artificial Sequence
  Description of Artificial Sequence: Synthetic oligonucleotide
  Target: DMPK; (+) strand; PAM type: YTN; PAM sequence: CTT
ctcaggaatgattcagccaa

SEQ ID NO: 18745 - DNA, 20 bp, Artificial Sequence
  Description of Artificial Sequence: Synthetic oligonucleotide
  Target: DMPK; (+) strand; PAM type: YTN; PAM sequence: TTC
tcaggaatgattcagccaaa

SEQ ID NO: 18746 - DNA, 20 bp, Artificial Sequence
  Description of Artificial Sequence: Synthetic oligonucleotide
  Target: DMPK; (+) strand; PAM type: YTN; PAM sequence: CTC
aggaatgattcagccaaact

SEQ ID NO: 18747 - DNA, 20 bp, Artificial Sequence
  Description of Artificial Sequence: Synthetic oligonucleotide
  Target: DMPK; (+) strand; PAM type: YTN; PAM sequence: TTC
agccaaactacctttcagga

SEQ ID NO: 18748 - DNA, 20 bp, Artificial Sequence
  Description of Artificial Sequence: Synthetic oligonucleotide
  Target: DMPK; (+) strand; PAM type: YTN; PAM sequence: CTA
cctttcaggaacaaatcagg

SEQ ID NO: 18749 - DNA, 20 bp, Artificial Sequence
  Description of Artificial Sequence: Synthetic oligonucleotide
  Target: DMPK; (+) strand; PAM type: YTN; PAM sequence: CTT
tcaggaacaaatcaggattc

SEQ ID NO: 18750 - DNA, 20 bp, Artificial Sequence
  Description of Artificial Sequence: Synthetic oligonucleotide
  Target: DMPK; (+) strand; PAM type: YTN; PAM sequence: TTT
caggaacaaatcaggattcc

SEQ ID NO: 18751 - DNA, 20 bp, Artificial Sequence
  Description of Artificial Sequence: Synthetic oligonucleotide
  Target: DMPK; (+) strand; PAM type: YTN; PAM sequence: TTC
aggaacaaatcaggattccc

SEQ ID NO: 18752 - DNA, 20 bp, Artificial Sequence
  Description of Artificial Sequence: Synthetic oligonucleotide
  Target: DMPK; (+) strand; PAM type: YTN; PAM sequence: TTC
ccacctgcccaaggcctttg

SEQ ID NO: 18753 - DNA, 20 bp, Artificial Sequence
  Description of Artificial Sequence: Synthetic oligonucleotide
  Target: DMPK; (+) strand; PAM type: YTN; PAM sequence: CTG
cccaaggcctttgccctgga

SEQ ID NO: 18754 - DNA, 20 bp, Artificial Sequence
  Description of Artificial Sequence: Synthetic oligonucleotide
  Target: DMPK; (+) strand; PAM type: YTN; PAM sequence: CTT
tgccctggaggctctcgcct

SEQ ID NO: 18755 - DNA, 20 bp, Artificial Sequence
  Description of Artificial Sequence: Synthetic oligonucleotide
  Target: DMPK; (+) strand; PAM type: YTN; PAM sequence: TTT
gccctggaggctctcgcctg

SEQ ID NO: 18756 - DNA, 20 bp, Artificial Sequence
  Description of Artificial Sequence: Synthetic oligonucleotide
  Target: DMPK; (+) strand; PAM type: YTN; PAM sequence: TTG
ccctggaggctctcgcctga

SEQ ID NO: 18757 - DNA, 20 bp, Artificial Sequence
  Description of Artificial Sequence: Synthetic oligonucleotide
  Target: DMPK; (+) strand; PAM type: YTN; PAM sequence: CTG
gaggctctcgcctgaccact

SEQ ID NO: 18758 - DNA, 20 bp, Artificial Sequence
  Description of Artificial Sequence: Synthetic oligonucleotide
  Target: DMPK; (+) strand; PAM type: YTN; PAM sequence: CTC
tcgcctgaccacttggcacc

SEQ ID NO: 18759 - DNA, 20 bp, Artificial Sequence
  Description of Artificial Sequence: Synthetic oligonucleotide
  Target: DMPK; (+) strand; PAM type: YTN; PAM sequence: CTC
gcctgaccacttggcacctt

SEQ ID NO: 18760 - DNA, 20 bp, Artificial Sequence
  Description of Artificial Sequence: Synthetic oligonucleotide
  Target: DMPK; (+) strand; PAM type: YTN; PAM sequence: CTG
accacttggcacctttcctt

SEQ ID NO: 18761 - DNA, 20 bp, Artificial Sequence
  Description of Artificial Sequence: Synthetic oligonucleotide
  Target: DMPK; (+) strand; PAM type: YTN; PAM sequence: CTT
ggcacctttccttccatggc

SEQ ID NO: 18762 - DNA, 20 bp, Artificial Sequence
  Description of Artificial Sequence: Synthetic oligonucleotide
  Target: DMPK; (+) strand; PAM type: YTN; PAM sequence: TTG
gcacctttccttccatggct

SEQ ID NO: 18763 - DNA, 20 bp, Artificial Sequence
  Description of Artificial Sequence: Synthetic oligonucleotide
  Target: DMPK; (+) strand; PAM type: YTN; PAM sequence: CTT
tccttccatggcttgtttct

SEQ ID NO: 18764 - DNA, 20 bp, Artificial Sequence
  Description of Artificial Sequence: Synthetic oligonucleotide
  Target: DMPK; (+) strand; PAM type: YTN; PAM sequence: TTT
ccttccatggcttgtttctc

SEQ ID NO: 18765 - DNA, 20 bp, Artificial Sequence
  Description of Artificial Sequence: Synthetic oligonucleotide
  Target: DMPK; (+) strand; PAM type: YTN; PAM sequence: TTC
cttccatggcttgtttctcc

SEQ ID NO: 18766 - DNA, 20 bp, Artificial Sequence
  Description of Artificial Sequence: Synthetic oligonucleotide
  Target: DMPK; (+) strand; PAM type: YTN; PAM sequence: CTT
ccatggcttgtttctccttc

SEQ ID NO: 18767 - DNA, 20 bp, Artificial Sequence
  Description of Artificial Sequence: Synthetic oligonucleotide
  Target: DMPK; (+) strand; PAM type: YTN; PAM sequence: TTC
catggcttgtttctccttca

SEQ ID NO: 18768 - DNA, 20 bp, Artificial Sequence
  Description of Artificial Sequence: Synthetic oligonucleotide
  Target: DMPK; (+) strand; PAM type: YTN; PAM sequence: CTT
gtttctccttcaccagcgct

SEQ ID NO: 18769 - DNA, 20 bp, Artificial Sequence
  Description of Artificial Sequence: Synthetic oligonucleotide
  Target: DMPK; (+) strand; PAM type: YTN; PAM sequence: TTG
tttctccttcaccagcgctc

SEQ ID NO: 18770 - DNA, 20 bp, Artificial Sequence
  Description of Artificial Sequence: Synthetic oligonucleotide
  Target: DMPK; (+) strand; PAM type: YTN; PAM sequence: TTT
ctccttcaccagcgctcagc

SEQ ID NO: 18771 - DNA, 20 bp, Artificial Sequence
  Description of Artificial Sequence: Synthetic oligonucleotide
  Target: DMPK; (+) strand; PAM type: YTN; PAM sequence: TTC
tccttcaccagcgctcagct

SEQ ID NO: 18772 - DNA, 20 bp, Artificial Sequence
  Description of Artificial Sequence: Synthetic oligonucleotide
  Target: DMPK; (+) strand; PAM type: YTN; PAM sequence: CTC
cttcaccagcgctcagctca

SEQ ID NO: 18773 - DNA, 20 bp, Artificial Sequence
  Description of Artificial Sequence: Synthetic oligonucleotide
  Target: DMPK; (+) strand; PAM type: YTN; PAM sequence: CTT
caccagcgctcagctcaaag

SEQ ID NO: 18774 - DNA, 20 bp, Artificial Sequence
  Description of Artificial Sequence: Synthetic oligonucleotide
  Target: DMPK; (+) strand; PAM type: YTN; PAM sequence: TTC
accagcgctcagctcaaaga

SEQ ID NO: 18775 - DNA, 20 bp, Artificial Sequence
  Description of Artificial Sequence: Synthetic oligonucleotide
  Target: DMPK; (+) strand; PAM type: YTN; PAM sequence: CTC
agctcaaagatcgacttctc

SEQ ID NO: 18776 - DNA, 20 bp, Artificial Sequence
  Description of Artificial Sequence: Synthetic oligonucleotide
  Target: DMPK; (+) strand; PAM type: YTN; PAM sequence: CTC
aaagatcgacttctcagatc

SEQ ID NO: 18777 - DNA, 20 bp, Artificial Sequence
  Description of Artificial Sequence: Synthetic oligonucleotide
  Target: DMPK; (+) strand; PAM type: YTN; PAM sequence: CTT
ctcagatccccagcaacaca

SEQ ID NO: 18778 - DNA, 20 bp, Artificial Sequence
  Description of Artificial Sequence: Synthetic oligonucleotide
  Target: DMPK; (+) strand; PAM type: YTN; PAM sequence: TTC
tcagatccccagcaacacac

SEQ ID NO: 18779 - DNA, 20 bp, Artificial Sequence
  Description of Artificial Sequence: Synthetic oligonucleotide
  Target: DMPK; (+) strand; PAM type: YTN; PAM sequence: CTC
agatccccagcaacacacac

SEQ ID NO: 18780 - DNA, 20 bp, Artificial Sequence
  Description of Artificial Sequence: Synthetic oligonucleotide
  Target: DMPK; (+) strand; PAM type: YTN; PAM sequence: CTT
acttaatgccccactgtaac

SEQ ID NO: 18781 - DNA, 20 bp, Artificial Sequence
  Description of Artificial Sequence: Synthetic oligonucleotide
  Target: DMPK; (+) strand; PAM type: YTN; PAM sequence: TTA
cttaatgccccactgtaact

SEQ ID NO: 18782 - DNA, 20 bp, Artificial Sequence
  Description of Artificial Sequence: Synthetic oligonucleotide
  Target: DMPK; (+) strand; PAM type: YTN; PAM sequence: CTT
aatgccccactgtaactaca

SEQ ID NO: 18783 - DNA, 20 bp, Artificial Sequence
  Description of Artificial Sequence: Synthetic oligonucleotide
  Target: DMPK; (+) strand; PAM type: YTN; PAM sequence: TTA
atgccccactgtaactacag

SEQ ID NO: 18784 - DNA, 20 bp, Artificial Sequence
  Description of Artificial Sequence: Synthetic oligonucleotide
  Target: DMPK; (+) strand; PAM type: YTN; PAM sequence: CTG
taactacagagaccgtccca

SEQ ID NO: 18785 - DNA, 20 bp, Artificial Sequence
  Description of Artificial Sequence: Synthetic oligonucleotide
  Target: DMPK; (+) strand; PAM type: YTN; PAM sequence: CTA
cagagaccgtcccatgtctg

SEQ ID NO: 18786 - DNA, 20 bp, Artificial Sequence
  Description of Artificial Sequence: Synthetic oligonucleotide
  Target: DMPK; (+) strand; PAM type: YTN; PAM sequence: CTG
aagtaacctcgtctctccgt

SEQ ID NO: 18787 - DNA, 20 bp, Artificial Sequence
  Description of Artificial Sequence: Synthetic oligonucleotide
  Target: DMPK; (+) strand; PAM type: YTN; PAM sequence: CTC
gtctctccgtggtttctgtc

SEQ ID NO: 18788 - DNA, 20 bp, Artificial Sequence
  Description of Artificial Sequence: Synthetic oligonucleotide
  Target: DMPK; (+) strand; PAM type: YTN; PAM sequence: CTC
tccgtggtttctgtctgctt

SEQ ID NO: 18789 - DNA, 20 bp, Artificial Sequence
  Description of Artificial Sequence: Synthetic oligonucleotide
  Target: DMPK; (+) strand; PAM type: YTN; PAM sequence: CTC
cgtggtttctgtctgcttct

SEQ ID NO: 18790 - DNA, 20 bp, Artificial Sequence
  Description of Artificial Sequence: Synthetic oligonucleotide
  Target: DMPK; (+) strand; PAM type: YTN; PAM sequence: TTT
ctgtctgcttctgttcagga

SEQ ID NO: 18791 - DNA, 20 bp, Artificial Sequence
  Description of Artificial Sequence: Synthetic oligonucleotide
  Target: DMPK; (+) strand; PAM type: YTN; PAM sequence: TTC
tgtctgcttctgttcaggaa

SEQ ID NO: 18792 - DNA, 20 bp, Artificial Sequence
  Description of Artificial Sequence: Synthetic oligonucleotide
  Target: DMPK; (+) strand; PAM type: YTN; PAM sequence: CTG
tctgcttctgttcaggaagt

SEQ ID NO: 18793 - DNA, 20 bp, Artificial Sequence
  Description of Artificial Sequence: Synthetic oligonucleotide
  Target: DMPK; (+) strand; PAM type: YTN; PAM sequence: CTG
cttctgttcaggaagtccct

SEQ ID NO: 18794 - DNA, 20 bp, Artificial Sequence
  Description of Artificial Sequence: Synthetic oligonucleotide
  Target: DMPK; (+) strand; PAM type: YTN; PAM sequence: CTT
ctgttcaggaagtccctaga

SEQ ID NO: 18795 - DNA, 20 bp, Artificial Sequence
  Description of Artificial Sequence: Synthetic oligonucleotide
  Target: DMPK; (+) strand; PAM type: YTN; PAM sequence: TTC
tgttcaggaagtccctagag

SEQ ID NO: 18796 - DNA, 20 bp, Artificial Sequence
  Description of Artificial Sequence: Synthetic oligonucleotide
  Target: DMPK; (+) strand; PAM type: YTN; PAM sequence: CTG
ttcaggaagtccctagaggg

SEQ ID NO: 18797 - DNA, 20 bp, Artificial Sequence
  Description of Artificial Sequence: Synthetic oligonucleotide
  Target: DMPK; (+) strand; PAM type: YTN; PAM sequence: TTC
aggaagtccctagagggctc

SEQ ID NO: 18798 - DNA, 20 bp, Artificial Sequence
  Description of Artificial Sequence: Synthetic oligonucleotide
  Target: DMPK; (+) strand; PAM type: YTN; PAM sequence: CTA
gagggctctacagtgcacgc

SEQ ID NO: 18799 - DNA, 20 bp, Artificial Sequence
  Description of Artificial Sequence: Synthetic oligonucleotide
  Target: DMPK; (+) strand; PAM type: YTN; PAM sequence: CTC
tacagtgcacgccacccggg

SEQ ID NO: 18800 - DNA, 20 bp, Artificial Sequence
  Description of Artificial Sequence: Synthetic oligonucleotide
  Target: DMPK; (+) strand; PAM type: YTN; PAM sequence: CTA
cagtgcacgccacccgggaa

SEQ ID NO: 18801 - DNA, 20 bp, Artificial Sequence
  Description of Artificial Sequence: Synthetic oligonucleotide
  Target: DMPK; (+) strand; PAM type: YTN; PAM sequence: CTC
accttttctctcccaattgt

SEQ ID NO: 18802 - DNA, 20 bp, Artificial Sequence
  Description of Artificial Sequence: Synthetic oligonucleotide
  Target: DMPK; (+) strand; PAM type: YTN; PAM sequence: CTT
ttctctcccaattgtccctg

SEQ ID NO: 18803 - DNA, 20 bp, Artificial Sequence
  Description of Artificial Sequence: Synthetic oligonucleotide
  Target: DMPK; (+) strand; PAM type: YTN; PAM sequence: TTT
tctctcccaattgtccctga

SEQ ID NO: 18804 - DNA, 20 bp, Artificial Sequence
  Description of Artificial Sequence: Synthetic oligonucleotide
  Target: DMPK; (+) strand; PAM type: YTN; PAM sequence: TTT
ctctcccaattgtccctgac

SEQ ID NO: 18805 - DNA, 20 bp, Artificial Sequence
  Description of Artificial Sequence: Synthetic oligonucleotide
  Target: DMPK; (+) strand; PAM type: YTN; PAM sequence: TTC
tctcccaattgtccctgacg

SEQ ID NO: 18806 - DNA, 20 bp, Artificial Sequence
  Description of Artificial Sequence: Synthetic oligonucleotide
  Target: DMPK; (+) strand; PAM type: YTN; PAM sequence: CTC
tcccaattgtccctgacgga

SEQ ID NO: 18807 - DNA, 20 bp, Artificial Sequence
  Description of Artificial Sequence: Synthetic oligonucleotide
  Target: DMPK; (+) strand; PAM type: YTN; PAM sequence: CTC
ccaattgtccctgacggacc

SEQ ID NO: 18808 - DNA, 20 bp, Artificial Sequence
  Description of Artificial Sequence: Synthetic oligonucleotide
  Target: DMPK; (+) strand; PAM type: YTN; PAM sequence: TTG
tccctgacggaccccctccc

SEQ ID NO: 18809 - DNA, 20 bp, Artificial Sequence
  Description of Artificial Sequence: Synthetic oligonucleotide
  Target: DMPK; (+) strand; PAM type: YTN; PAM sequence: CTG
acggaccccctcccctccac

SEQ ID NO: 18810 - DNA, 20 bp, Artificial Sequence
  Description of Artificial Sequence: Synthetic oligonucleotide
  Target: DMPK; (+) strand; PAM type: YTN; PAM sequence: CTC
ccctccaccaacttactgtt

SEQ ID NO: 18811 - DNA, 20 bp, Artificial Sequence
  Description of Artificial Sequence: Synthetic oligonucleotide
  Target: DMPK; (+) strand; PAM type: YTN; PAM sequence: CTC
caccaacttactgtttcatc

SEQ ID NO: 18812 - DNA, 20 bp, Artificial Sequence
  Description of Artificial Sequence: Synthetic oligonucleotide
  Target: DMPK; (+) strand; PAM type: YTN; PAM sequence: CTT
actgtttcatcctgtgggga

SEQ ID NO: 18813 - DNA, 20 bp, Artificial Sequence
  Description of Artificial Sequence: Synthetic oligonucleotide
  Target: DMPK; (+) strand; PAM type: YTN; PAM sequence: TTA
ctgtttcatcctgtggggac

SEQ ID NO: 18814 - DNA, 20 bp, Artificial Sequence
  Description of Artificial Sequence: Synthetic oligonucleotide
  Target: DMPK; (+) strand; PAM type: YTN; PAM sequence: CTG
tttcatcctgtggggacacc

SEQ ID NO: 18815 - DNA, 20 bp, Artificial Sequence
  Description of Artificial Sequence: Synthetic oligonucleotide
  Target: DMPK; (+) strand; PAM type: YTN; PAM sequence: TTT
catcctgtggggacaccgag

SEQ ID NO: 18816 - DNA, 20 bp, Artificial Sequence
  Description of Artificial Sequence: Synthetic oligonucleotide
  Target: DMPK; (+) strand; PAM type: YTN; PAM sequence: TTC
atcctgtggggacaccgagg

SEQ ID NO: 18817 - DNA, 20 bp, Artificial Sequence
  Description of Artificial Sequence: Synthetic oligonucleotide
  Target: DMPK; (+) strand; PAM type: YTN; PAM sequence: CTG
tggggacaccgagggctcca

SEQ ID NO: 18818 - DNA, 20 bp, Artificial Sequence
  Description of Artificial Sequence: Synthetic oligonucleotide
  Target: DMPK; (+) strand; PAM type: YTN; PAM sequence: CTC
caggctgggcgcttgcacgt

SEQ ID NO: 18819 - DNA, 20 bp, Artificial Sequence
  Description of Artificial Sequence: Synthetic oligonucleotide
  Target: DMPK; (+) strand; PAM type: YTN; PAM sequence: CTG
ggcgcttgcacgtgtggctc

SEQ ID NO: 18820 - DNA, 20 bp, Artificial Sequence
  Description of Artificial Sequence: Synthetic oligonucleotide
  Target: DMPK; (+) strand; PAM type: YTN; PAM sequence: CTT
gcacgtgtggctcaagcagc

SEQ ID NO: 18821 - DNA, 20 bp, Artificial Sequence
  Description of Artificial Sequence: Synthetic oligonucleotide
  Target: DMPK; (+) strand; PAM type: YTN; PAM sequence: TTG
cacgtgtggctcaagcagct

SEQ ID NO: 18822 - DNA, 20 bp, Artificial Sequence
  Description of Artificial Sequence: Synthetic oligonucleotide
  Target: DMPK; (+) strand; PAM type: YTN; PAM sequence: CTC
aagcagctgctcggcctcca

SEQ ID NO: 18823 - DNA, 20 bp, Artificial Sequence
  Description of Artificial Sequence: Synthetic oligonucleotide
  Target: DMPK; (+) strand; PAM type: YTN; PAM sequence: CTG
ctcggcctccagttccatgg

SEQ ID NO: 18824 - DNA, 20 bp, Artificial Sequence
  Description of Artificial Sequence: Synthetic oligonucleotide
  Target: DMPK; (+) strand; PAM type: YTN; PAM sequence: CTC
ggcctccagttccatgggtg

SEQ ID NO: 18825 - DNA, 20 bp, Artificial Sequence
  Description of Artificial Sequence: Synthetic oligonucleotide
  Target: DMPK; (+) strand; PAM type: YTN; PAM sequence: CTC
cagttccatgggtgtggggc

SEQ ID NO: 18826 - DNA, 20 bp, Artificial Sequence
  Description of Artificial Sequence: Synthetic oligonucleotide
  Target: DMPK; (+) strand; PAM type: YTN; PAM sequence: TTC
catgggtgtggggcctggga

SEQ ID NO: 18827 - DNA, 20 bp, Artificial Sequence
  Description of Artificial Sequence: Synthetic oligonucleotide
  Target: DMPK; (+) strand; PAM type: YTN; PAM sequence: CTG
ggacctcactgtccctgggg

SEQ ID NO: 18828 - DNA, 20 bp, Artificial Sequence
  Description of Artificial Sequence: Synthetic oligonucleotide
  Target: DMPK; (+) strand; PAM type: YTN; PAM sequence: CTC
actgtccctggggagaggag

SEQ ID NO: 18829 - DNA, 20 bp, Artificial Sequence
  Description of Artificial Sequence: Synthetic oligonucleotide
  Target: DMPK; (+) strand; PAM type: YTN; PAM sequence: CTG
tccctggggagaggaggagg

SEQ ID NO: 18830 - DNA, 20 bp, Artificial Sequence
  Description of Artificial Sequence: Synthetic oligonucleotide
  Target: DMPK; (+) strand; PAM type: YTN; PAM sequence: CTG
gggagaggaggagggagtgg

SEQ ID NO: 18831 - DNA, 20 bp, Artificial Sequence
  Description of Artificial Sequence: Synthetic oligonucleotide
  Target: DMPK; (+) strand; PAM type: YTN; PAM sequence: CTG
attctctggtggagaaccag

SEQ ID NO: 18832 - DNA, 20 bp, Artificial Sequence
  Description of Artificial Sequence: Synthetic oligonucleotide
  Target: DMPK; (+) strand; PAM type: YTN; PAM sequence: TTC
tctggtggagaaccagaact

SEQ ID NO: 18833 - DNA, 20 bp, Artificial Sequence
  Description of Artificial Sequence: Synthetic oligonucleotide
  Target: DMPK; (+) strand; PAM type: YTN; PAM sequence: CTC
tggtggagaaccagaacttc

SEQ ID NO: 18834 - DNA, 20 bp, Artificial Sequence
  Description of Artificial Sequence: Synthetic oligonucleotide
  Target: DMPK; (+) strand; PAM type: YTN; PAM sequence: CTG
gtggagaaccagaacttctg

SEQ ID NO: 18835 - DNA, 20 bp, Artificial Sequence
  Description of Artificial Sequence: Synthetic oligonucleotide
  Target: DMPK; (+) strand; PAM type: YTN; PAM sequence: CTT
ctggcctgtgggtaggggca

SEQ ID NO: 18836 - DNA, 20 bp, Artificial Sequence
  Description of Artificial Sequence: Synthetic oligonucleotide
  Target: DMPK; (+) strand; PAM type: YTN; PAM sequence: TTC
tggcctgtgggtaggggcag

SEQ ID NO: 18837 - DNA, 20 bp, Artificial Sequence
  Description of Artificial Sequence: Synthetic oligonucleotide
  Target: DMPK; (+) strand; PAM type: YTN; PAM sequence: CTG
gcctgtgggtaggggcagct

SEQ ID NO: 18838 - DNA, 20 bp, Artificial Sequence
  Description of Artificial Sequence: Synthetic oligonucleotide
  Target: DMPK; (+) strand; PAM type: YTN; PAM sequence: CTG
tgggtaggggcagctgcttc

SEQ ID NO: 18839 - DNA, 20 bp, Artificial Sequence
  Description of Artificial Sequence: Synthetic oligonucleotide
  Target: DMPK; (+) strand; PAM type: YTN; PAM sequence: CTG
cttccaagacctcctgattt

SEQ ID NO: 18840 - DNA, 20 bp, Artificial Sequence
  Description of Artificial Sequence: Synthetic oligonucleotide
  Target: DMPK; (+) strand; PAM type: YTN; PAM sequence: CTT
ccaagacctcctgatttgag

SEQ ID NO: 18841 - DNA, 20 bp, Artificial Sequence
  Description of Artificial Sequence: Synthetic oligonucleotide
  Target: DMPK; (+) strand; PAM type: YTN; PAM sequence: TTC
caagacctcctgatttgagg

SEQ ID NO: 18842 - DNA, 20 bp, Artificial Sequence
  Description of Artificial Sequence: Synthetic oligonucleotide
  Target: DMPK; (+) strand; PAM type: YTN; PAM sequence: CTC
ctgatttgaggaaggggagc

SEQ ID NO: 18843 - DNA, 20 bp, Artificial Sequence
  Description of Artificial Sequence: Synthetic oligonucleotide
  Target: DMPK; (+) strand; PAM type: YTN; PAM sequence: CTG
atttgaggaaggggagcagc

SEQ ID NO: 18844 - DNA, 20 bp, Artificial Sequence
  Description of Artificial Sequence: Synthetic oligonucleotide
  Target: DMPK; (+) strand; PAM type: YTN; PAM sequence: TTT
gaggaaggggagcagcagag

SEQ ID NO: 18845 - DNA, 20 bp, Artificial Sequence
  Description of Artificial Sequence: Synthetic oligonucleotide
  Target: DMPK; (+) strand; PAM type: YTN; PAM sequence: TTG
aggaaggggagcagcagagc

SEQ ID NO: 18846 - DNA, 20 bp, Artificial Sequence
  Description of Artificial Sequence: Synthetic oligonucleotide
  Target: DMPK; (+) strand; PAM type: YTN; PAM sequence: CTC
ctctgcttaggaaaagccct

SEQ ID NO: 18847 - DNA, 20 bp, Artificial Sequence
  Description of Artificial Sequence: Synthetic oligonucleotide
  Target: DMPK; (+) strand; PAM type: YTN; PAM sequence: CTC
tgcttaggaaaagccctgcc

SEQ ID NO: 18848 - DNA, 20 bp, Artificial Sequence
  Description of Artificial Sequence: Synthetic oligonucleotide
  Target: DMPK; (+) strand; PAM type: YTN; PAM sequence: CTG
cttaggaaaagccctgcccc

SEQ ID NO: 18849 - DNA, 20 bp, Artificial Sequence
  Description of Artificial Sequence: Synthetic oligonucleotide
  Target: DMPK; (+) strand; PAM type: YTN; PAM sequence: CTT
aggaaaagccctgcccctct

SEQ ID NO: 18850 - DNA, 20 bp, Artificial Sequence
  Description of Artificial Sequence: Synthetic oligonucleotide
  Target: DMPK; (+) strand; PAM type: YTN; PAM sequence: TTA
ggaaaagccctgcccctctc

SEQ ID NO: 18851 - DNA, 20 bp, Artificial Sequence
  Description of Artificial Sequence: Synthetic oligonucleotide
  Target: DMPK; (+) strand; PAM type: YTN; PAM sequence: CTG
cccctctcctggccttgggc

SEQ ID NO: 18852 - DNA, 20 bp, Artificial Sequence
  Description of Artificial Sequence: Synthetic oligonucleotide
  Target: DMPK; (+) strand; PAM type: YTN; PAM sequence: CTC
tcctggccttgggcccctgg

SEQ ID NO: 18853 - DNA, 20 bp, Artificial Sequence
  Description of Artificial Sequence: Synthetic oligonucleotide
  Target: DMPK; (+) strand; PAM type: YTN; PAM sequence: CTC
ctggccttgggcccctggga

SEQ ID NO: 18854 - DNA, 20 bp, Artificial Sequence
  Description of Artificial Sequence: Synthetic oligonucleotide
  Target: DMPK; (+) strand; PAM type: YTN; PAM sequence: CTG
gccttgggcccctgggagct

SEQ ID NO: 18855 - DNA, 20 bp, Artificial Sequence
  Description of Artificial Sequence: Synthetic oligonucleotide
  Target: DMPK; (+) strand; PAM type: YTN; PAM sequence: CTT
gggcccctgggagctgctct

SEQ ID NO: 18856 - DNA, 20 bp, Artificial Sequence
  Description of Artificial Sequence: Synthetic oligonucleotide
  Target: DMPK; (+) strand; PAM type: YTN; PAM sequence: TTG
ggcccctgggagctgctctt

SEQ ID NO: 18857 - DNA, 20 bp, Artificial Sequence
  Description of Artificial Sequence: Synthetic oligonucleotide
  Target: DMPK; (+) strand; PAM type: YTN; PAM sequence: CTG
ggagctgctctttctaaacc

SEQ ID NO: 18858 - DNA, 20 bp, Artificial Sequence
  Description of Artificial Sequence: Synthetic oligonucleotide
  Target: DMPK; (+) strand; PAM type: YTN; PAM sequence: CTG
ctctttctaaaccttctgca

SEQ ID NO: 18859 - DNA, 20 bp, Artificial Sequence
  Description of Artificial Sequence: Synthetic oligonucleotide
  Target: DMPK; (+) strand; PAM type: YTN; PAM sequence: CTC
tttctaaaccttctgcaggg

SEQ ID NO: 18860 - DNA, 20 bp, Artificial Sequence
  Description of Artificial Sequence: Synthetic oligonucleotide
  Target: DMPK; (+) strand; PAM type: YTN; PAM sequence: CTT
tctaaaccttctgcagggac

SEQ ID NO: 18861 - DNA, 20 bp, Artificial Sequence
  Description of Artificial Sequence: Synthetic oligonucleotide
  Target: DMPK; (+) strand; PAM type: YTN; PAM sequence: TTT
ctaaaccttctgcagggact

SEQ ID NO: 18862 - DNA, 20 bp, Artificial Sequence
  Description of Artificial Sequence: Synthetic oligonucleotide
  Target: DMPK; (+) strand; PAM type: YTN; PAM sequence: TTC
taaaccttctgcagggactt

SEQ ID NO: 18863 - DNA, 20 bp, Artificial Sequence
  Description of Artificial Sequence: Synthetic oligonucleotide
  Target: DMPK; (+) strand; PAM type: YTN; PAM sequence: CTA
aaccttctgcagggacttgg

SEQ ID NO: 18864 - DNA, 20 bp, Artificial Sequence
  Description of Artificial Sequence: Synthetic oligonucleotide
  Target: DMPK; (+) strand; PAM type: YTN; PAM sequence: CTT
ctgcagggacttggggtcca

SEQ ID NO: 18865 - DNA, 20 bp, Artificial Sequence
  Description of Artificial Sequence: Synthetic oligonucleotide
  Target: DMPK; (+) strand; PAM type: YTN; PAM sequence: TTC
tgcagggacttggggtccag

SEQ ID NO: 18866 - DNA, 20 bp, Artificial Sequence
  Description of Artificial Sequence: Synthetic oligonucleotide
  Target: DMPK; (+) strand; PAM type: YTN; PAM sequence: CTG
cagggacttggggtccagac

SEQ ID NO: 18867 - DNA, 20 bp, Artificial Sequence
  Description of Artificial Sequence: Synthetic oligonucleotide
  Target: DMPK; (+) strand; PAM type: YTN; PAM sequence: CTT
ggggtccagacccccatgtt

SEQ ID NO: 18868 - DNA, 20 bp, Artificial Sequence
  Description of Artificial Sequence: Synthetic oligonucleotide
  Target: DMPK; (+) strand; PAM type: YTN; PAM sequence: TTG
gggtccagacccccatgttc

SEQ ID NO: 18869 - DNA, 20 bp, Artificial Sequence
  Description of Artificial Sequence: Synthetic oligonucleotide
  Target: DMPK; (+) strand; PAM type: YTN; PAM sequence: TTC
tagggtcagctcatctcctc

SEQ ID NO: 18870 - DNA, 20 bp, Artificial Sequence
  Description of Artificial Sequence: Synthetic oligonucleotide
  Target: DMPK; (+) strand; PAM type: YTN; PAM sequence: CTA
gggtcagctcatctcctccc

SEQ ID NO: 18871 - DNA, 20 bp, Artificial Sequence
  Description of Artificial Sequence: Synthetic oligonucleotide
  Target: DMPK; (+) strand; PAM type: YTN; PAM sequence: CTC
atctcctcccttgacatgtg

SEQ ID NO: 18872 - DNA, 20 bp, Artificial Sequence
  Description of Artificial Sequence: Synthetic oligonucleotide
  Target: DMPK; (+) strand; PAM type: YTN; PAM sequence: CTC
ctcccttgacatgtgaccgc

SEQ ID NO: 18873 - DNA, 20 bp, Artificial Sequence
  Description of Artificial Sequence: Synthetic oligonucleotide
  Target: DMPK; (+) strand; PAM type: YTN; PAM sequence: CTC
ccttgacatgtgaccgctgc

SEQ ID NO: 18874 - DNA, 20 bp, Artificial Sequence
  Description of Artificial Sequence: Synthetic oligonucleotide
  Target: DMPK; (+) strand; PAM type: YTN; PAM sequence: CTT
gacatgtgaccgctgcagac

SEQ ID NO: 18875 - DNA, 20 bp, Artificial Sequence
  Description of Artificial Sequence: Synthetic oligonucleotide
  Target: DMPK; (+) strand; PAM type: YTN; PAM sequence: TTG
acatgtgaccgctgcagacc

SEQ ID NO: 18876 - DNA, 20 bp, Artificial Sequence
  Description of Artificial Sequence: Synthetic oligonucleotide
  Target: DMPK; (+) strand; PAM type: YTN; PAM sequence: CTG
cagacccctcttctcagggc

SEQ ID NO: 18877 - DNA, 20 bp, Artificial Sequence
  Description of Artificial Sequence: Synthetic oligonucleotide
  Target: DMPK; (+) strand; PAM type: YTN; PAM sequence: CTC
ttctcagggcctcaggacag

SEQ ID NO: 18878 - DNA, 20 bp, Artificial Sequence
  Description of Artificial Sequence: Synthetic oligonucleotide
  Target: DMPK; (+) strand; PAM type: YTN; PAM sequence: CTT
ctcagggcctcaggacaggg

SEQ ID NO: 18879 - DNA, 20 bp, Artificial Sequence
  Description of Artificial Sequence: Synthetic oligonucleotide
  Target: DMPK; (+) strand; PAM type: YTN; PAM sequence: TTC
tcagggcctcaggacaggga

SEQ ID NO: 18880 - DNA, 20 bp, Artificial Sequence
  Description of Artificial Sequence: Synthetic oligonucleotide
  Target: DMPK; (+) strand; PAM type: YTN; PAM sequence: CTC
agggcctcaggacagggagg

SEQ ID NO: 18881 - DNA, 20 bp, Artificial Sequence
  Description of Artificial Sequence: Synthetic oligonucleotide
  Target: DMPK; (+) strand; PAM type: YTN; PAM sequence: CTC
aggacagggaggccgacctg

SEQ ID NO: 18882 - DNA, 20 bp, Artificial Sequence
  Description of Artificial Sequence: Synthetic oligonucleotide
  Target: DMPK; (+) strand; PAM type: YTN; PAM sequence: CTG
atggggagactgcttggctc

SEQ ID NO: 18883 - DNA, 20 bp, Artificial Sequence
  Description of Artificial Sequence: Synthetic oligonucleotide
  Target: DMPK; (+) strand; PAM type: YTN; PAM sequence: CTG
cttggctctggccacctcca

SEQ ID NO: 18884 - DNA, 20 bp, Artificial Sequence
  Description of Artificial Sequence: Synthetic oligonucleotide
  Target: DMPK; (+) strand; PAM type: YTN; PAM sequence: CTT
ggctctggccacctccacag

SEQ ID NO: 18885 - DNA, 20 bp, Artificial Sequence
  Description of Artificial Sequence: Synthetic oligonucleotide
  Target: DMPK; (+) strand; PAM type: YTN; PAM sequence: TTG
gctctggccacctccacaga

SEQ ID NO: 18886 - DNA, 20 bp, Artificial Sequence
  Description of Artificial Sequence: Synthetic oligonucleotide
  Target: DMPK; (+) strand; PAM type: YTN; PAM sequence: CTC
tggccacctccacagatgtg

SEQ ID NO: 18887 - DNA, 20 bp, Artificial Sequence
  Description of Artificial Sequence: Synthetic oligonucleotide
  Target: DMPK; (+) strand; PAM type: YTN; PAM sequence: CTG
gccacctccacagatgtggt

SEQ ID NO: 18888 - DNA, 20 bp, Artificial Sequence
  Description of Artificial Sequence: Synthetic oligonucleotide
  Target: DMPK; (+) strand; PAM type: YTN; PAM sequence: CTC
cacagatgtggtcctaagac

SEQ ID NO: 18889 - DNA, 20 bp, Artificial Sequence
  Description of Artificial Sequence: Synthetic oligonucleotide
  Target: DMPK; (+) strand; PAM type: YTN; PAM sequence: CTA
agactgggcatgggacccca

SEQ ID NO: 18890 - DNA, 20 bp, Artificial Sequence
  Description of Artificial Sequence: Synthetic oligonucleotide
  Target: DMPK; (+) strand; PAM type: YTN; PAM sequence: CTG
ggcatgggaccccaagatgg

SEQ ID NO: 18891 - DNA, 20 bp, Artificial Sequence
  Description of Artificial Sequence: Synthetic oligonucleotide
  Target: DMPK; (+) strand; PAM type: YTN; PAM sequence: CTT
gaggtcagcacaccccactc

SEQ ID NO: 18892 - DNA, 20 bp, Artificial Sequence
  Description of Artificial Sequence: Synthetic oligonucleotide
  Target: DMPK; (+) strand; PAM type: YTN; PAM sequence: TTG
aggtcagcacaccccactca

SEQ ID NO: 18893 - DNA, 20 bp, Artificial Sequence
  Description of Artificial Sequence: Synthetic oligonucleotide
  Target: DMPK; (+) strand; PAM type: YTN; PAM sequence: CTC
agctgtgggaaggggacagc

SEQ ID NO: 18894 - DNA, 20 bp, Artificial Sequence
  Description of Artificial Sequence: Synthetic oligonucleotide
  Target: DMPK; (+) strand; PAM type: YTN; PAM sequence: CTG
tgggaaggggacagctcctc

SEQ ID NO: 18895 - DNA, 20 bp, Artificial Sequence
  Description of Artificial Sequence: Synthetic oligonucleotide
  Target: DMPK; (+) strand; PAM type: YTN; PAM sequence: CTC
ctccctggggtatgaagtgg

SEQ ID NO: 18896 - DNA, 20 bp, Artificial Sequence
  Description of Artificial Sequence: Synthetic oligonucleotide
  Target: DMPK; (+) strand; PAM type: YTN; PAM sequence: CTC
cctggggtatgaagtggctg

SEQ ID NO: 18897 - DNA, 20 bp, Artificial Sequence
  Description of Artificial Sequence: Synthetic oligonucleotide
  Target: DMPK; (+) strand; PAM type: YTN; PAM sequence: CTG
gggtatgaagtggctgtccc

SEQ ID NO: 18898 - DNA, 20 bp, Artificial Sequence
  Description of Artificial Sequence: Synthetic oligonucleotide
  Target: DMPK; (+) strand; PAM type: YTN; PAM sequence: CTG
tcccctccaacccagcagtc

SEQ ID NO: 18899 - DNA, 20 bp, Artificial Sequence
  Description of Artificial Sequence: Synthetic oligonucleotide
  Target: DMPK; (+) strand; PAM type: YTN; PAM sequence: CTC
caacccagcagtccctcctg

SEQ ID NO: 18900 - DNA, 20 bp, Artificial Sequence
  Description of Artificial Sequence: Synthetic oligonucleotide
  Target: DMPK; (+) strand; PAM type: YTN; PAM sequence: CTC
ctgtgggaacacggctcagg

SEQ ID NO: 18901 - DNA, 20 bp, Artificial Sequence
  Description of Artificial Sequence: Synthetic oligonucleotide
  Target: DMPK; (+) strand; PAM type: YTN; PAM sequence: CTG
tgggaacacggctcaggacc

SEQ ID NO: 18902 - DNA, 20 bp, Artificial Sequence
  Description of Artificial Sequence: Synthetic oligonucleotide
  Target: DMPK; (+) strand; PAM type: YTN; PAM sequence: CTC
aggacctagctatcctggac

SEQ ID NO: 18903 - DNA, 20 bp, Artificial Sequence
  Description of Artificial Sequence: Synthetic oligonucleotide
  Target: DMPK; (+) strand; PAM type: YTN; PAM sequence: CTA
gctatcctggacatgcgcct

SEQ ID NO: 18904 - DNA, 20 bp, Artificial Sequence
  Description of Artificial Sequence: Synthetic oligonucleotide
  Target: DMPK; (+) strand; PAM type: YTN; PAM sequence: CTA
tcctggacatgcgcctgggt

SEQ ID NO: 18905 - DNA, 20 bp, Artificial Sequence
  Description of Artificial Sequence: Synthetic oligonucleotide
  Target: DMPK; (+) strand; PAM type: YTN; PAM sequence: CTG
gacatgcgcctgggttctaa

SEQ ID NO: 18906 - DNA, 20 bp, Artificial Sequence
  Description of Artificial Sequence: Synthetic oligonucleotide
  Target: DMPK; (+) strand; PAM type: YTN; PAM sequence: CTG
ggttctaatagaggatgggt

SEQ ID NO: 18907 - DNA, 20 bp, Artificial Sequence
  Description of Artificial Sequence: Synthetic oligonucleotide
  Target: DMPK; (+) strand; PAM type: YTN; PAM sequence: TTC
taatagaggatgggttcaat

SEQ ID NO: 18908 - DNA, 20 bp, Artificial Sequence
  Description of Artificial Sequence: Synthetic oligonucleotide
  Target: DMPK; (+) strand; PAM type: YTN; PAM sequence: CTA
atagaggatgggttcaatcc

SEQ ID NO: 18909 - DNA, 20 bp, Artificial Sequence
  Description of Artificial Sequence: Synthetic oligonucleotide
  Target: DMPK; (+) strand; PAM type: YTN; PAM sequence: TTC
aatcctgacccaccgttcag

SEQ ID NO: 18910 - DNA, 20 bp, Artificial Sequence
  Description of Artificial Sequence: Synthetic oligonucleotide
  Target: DMPK; (+) strand; PAM type: YTN; PAM sequence: CTG
acccaccgttcaggccccgc

SEQ ID NO: 18911 - DNA, 20 bp, Artificial Sequence
  Description of Artificial Sequence: Synthetic oligonucleotide
  Target: DMPK; (+) strand; PAM type: YTN; PAM sequence: TTC
aggccccgcagcggttcaga

SEQ ID NO: 18912 - DNA, 20 bp, Artificial Sequence
  Description of Artificial Sequence: Synthetic oligonucleotide
  Target: DMPK; (+) strand; PAM type: YTN; PAM sequence: TTC
agaatcaagctggagttcat

SEQ ID NO: 18913 - DNA, 20 bp, Artificial Sequence
  Description of Artificial Sequence: Synthetic oligonucleotide
  Target: DMPK; (+) strand; PAM type: YTN; PAM sequence: CTG
gagttcattaatgataaggt

SEQ ID NO: 18914 - DNA, 20 bp, Artificial Sequence
  Description of Artificial Sequence: Synthetic oligonucleotide
  Target: DMPK; (+) strand; PAM type: YTN; PAM sequence: TTC
attaatgataaggtatagta

SEQ ID NO: 18915 - DNA, 20 bp, Artificial Sequence
  Description of Artificial Sequence: Synthetic oligonucleotide
  Target: DMPK; (+) strand; PAM type: YTN; PAM sequence: TTA
atgataaggtatagtatgtg

SEQ ID NO: 18916 - DNA, 20 bp, Artificial Sequence
  Description of Artificial Sequence: Synthetic oligonucleotide
  Target: DMPK; (+) strand; PAM type: YTN; PAM sequence: TTG
tccagtaataaaagctgact

SEQ ID NO: 18917 - DNA, 20 bp, Artificial Sequence
  Description of Artificial Sequence: Synthetic oligonucleotide
  Target: DMPK; (+) strand; PAM type: YTN; PAM sequence: CTG
actagaaaaccaactgttct

SEQ ID NO: 18918 - DNA, 20 bp, Artificial Sequence
  Description of Artificial Sequence: Synthetic oligonucleotide
  Target: DMPK; (+) strand; PAM type: YTN; PAM sequence: CTA
gaaaaccaactgttctctta

SEQ ID NO: 18919 - DNA, 20 bp, Artificial Sequence
  Description of Artificial Sequence: Synthetic oligonucleotide
  Target: DMPK; (+) strand; PAM type: YTN; PAM sequence: CTG
ttctcttagacaaagtagca

SEQ ID NO: 18920 - DNA, 20 bp, Artificial Sequence
  Description of Artificial Sequence: Synthetic oligonucleotide
  Target: DMPK; (+) strand; PAM type: YTN; PAM sequence: TTC
tcttagacaaagtagcatga

SEQ ID NO: 18921 - DNA, 20 bp, Artificial Sequence
  Description of Artificial Sequence: Synthetic oligonucleotide
  Target: DMPK; (+) strand; PAM type: YTN; PAM sequence: CTC
ttagacaaagtagcatgagg

SEQ ID NO: 18922 - DNA, 20 bp, Artificial Sequence
  Description of Artificial Sequence: Synthetic oligonucleotide
  Target: DMPK; (+) strand; PAM type: YTN; PAM sequence: CTT
agacaaagtagcatgaggaa

SEQ ID NO: 18923 - DNA, 20 bp, Artificial Sequence
  Description of Artificial Sequence: Synthetic oligonucleotide
  Target: DMPK; (+) strand; PAM type: YTN; PAM sequence: TTA
gacaaagtagcatgaggaag

SEQ ID NO: 18924 - DNA, 20 bp, Artificial Sequence
  Description of Artificial Sequence: Synthetic oligonucleotide
  Target: DMPK; (+) strand; PAM type: YTN; PAM sequence: CTG
ttctccactatttaaacatg

SEQ ID NO: 18925 - DNA, 20 bp, Artificial Sequence
  Description of Artificial Sequence: Synthetic oligonucleotide
  Target: DMPK; (+) strand; PAM type: YTN; PAM sequence: TTC
tccactatttaaacatgtgt

SEQ ID NO: 18926 - DNA, 20 bp, Artificial Sequence
  Description of Artificial Sequence: Synthetic oligonucleotide
  Target: DMPK; (+) strand; PAM type: YTN; PAM sequence: CTC
cactatttaaacatgtgtca

SEQ ID NO: 18927 - DNA, 20 bp, Artificial Sequence
  Description of Artificial Sequence: Synthetic oligonucleotide
  Target: DMPK; (+) strand; PAM type: YTN; PAM sequence: CTA
tttaaacatgtgtcagtaca

SEQ ID NO: 18928 - DNA, 20 bp, Artificial Sequence
  Description of Artificial Sequence: Synthetic oligonucleotide
  Target: DMPK; (+) strand; PAM type: YTN; PAM sequence: TTT
aaacatgtgtcagtacacgt

SEQ ID NO: 18929 - DNA, 20 bp, Artificial Sequence
  Description of Artificial Sequence: Synthetic oligonucleotide
  Target: DMPK; (+) strand; PAM type: YTN; PAM sequence: TTA
aacatgtgtcagtacacgtg

SEQ ID NO: 18930 - DNA, 20 bp, Artificial Sequence
  Description of Artificial Sequence: Synthetic oligonucleotide
  Target: DMPK; (+) strand; PAM type: YTN; PAM sequence: CTG
ccatctggtgagctcacgag

SEQ ID NO: 18931 - DNA, 20 bp, Artificial Sequence
  Description of Artificial Sequence: Synthetic oligonucleotide
  Target: DMPK; (+) strand; PAM type: YTN; PAM sequence: CTG
gtgagctcacgagatatcaa

SEQ ID NO: 18932 - DNA, 20 bp, Artificial Sequence
  Description of Artificial Sequence: Synthetic oligonucleotide
  Target: DMPK; (+) strand; PAM type: YTN; PAM sequence: CTC
acgagatatcaacttccttt

SEQ ID NO: 18933 - DNA, 20 bp, Artificial Sequence
  Description of Artificial Sequence: Synthetic oligonucleotide
  Target: DMPK; (+) strand; PAM type: YTN; PAM sequence: CTT
ccttttccttatctgtattt

SEQ ID NO: 18934 - DNA, 20 bp, Artificial Sequence
  Description of Artificial Sequence: Synthetic oligonucleotide
  Target: DMPK; (+) strand; PAM type: YTN; PAM sequence: TTC
cttttccttatctgtatttt

SEQ ID NO: 18935 - DNA, 20 bp, Artificial Sequence
  Description of Artificial Sequence: Synthetic oligonucleotide
  Target: DMPK; (+) strand; PAM type: YTN; PAM sequence: CTT
ttccttatctgtattttcta

SEQ ID NO: 18936 - DNA, 20 bp, Artificial Sequence
  Description of Artificial Sequence: Synthetic oligonucleotide
  Target: DMPK; (+) strand; PAM type: YTN; PAM sequence: TTT
tccttatctgtattttctaa

SEQ ID NO: 18937 - DNA, 20 bp, Artificial Sequence
  Description of Artificial Sequence: Synthetic oligonucleotide
  Target: DMPK; (+) strand; PAM type: YTN; PAM sequence: TTT
ccttatctgtattttctaat

SEQ ID NO: 18938 - DNA, 20 bp, Artificial Sequence
  Description of Artificial Sequence: Synthetic oligonucleotide
  Target: DMPK; (+) strand; PAM type: YTN; PAM sequence: TTC
cttatctgtattttctaatt

SEQ ID NO: 18939 - DNA, 20 bp, Artificial Sequence
  Description of Artificial Sequence: Synthetic oligonucleotide
  Target: DMPK; (+) strand; PAM type: YTN; PAM sequence: CTT
atctgtattttctaatttac

SEQ ID NO: 18940 - DNA, 20 bp, Artificial Sequence
  Description of Artificial Sequence: Synthetic oligonucleotide
  Target: DMPK; (+) strand; PAM type: YTN; PAM sequence: TTA
tctgtattttctaatttact

SEQ ID NO: 18941 - DNA, 20 bp, Artificial Sequence
  Description of Artificial Sequence: Synthetic oligonucleotide
  Target: DMPK; (+) strand; PAM type: YTN; PAM sequence: CTG
tattttctaatttacttgtg

SEQ ID NO: 18942 - DNA, 20 bp, Artificial Sequence
  Description of Artificial Sequence: Synthetic oligonucleotide
  Target: DMPK; (+) strand; PAM type: YTN; PAM sequence: TTT
tctaatttacttgtgataag

SEQ ID NO: 18943 - DNA, 20 bp, Artificial Sequence
  Description of Artificial Sequence: Synthetic oligonucleotide
  Target: DMPK; (+) strand; PAM type: YTN; PAM sequence: TTT
ctaatttacttgtgataagc

SEQ ID NO: 18944 - DNA, 20 bp, Artificial Sequence
  Description of Artificial Sequence: Synthetic oligonucleotide
  Target: DMPK; (+) strand; PAM type: YTN; PAM sequence: TTC
taatttacttgtgataagca

SEQ ID NO: 18945 - DNA, 20 bp, Artificial Sequence
  Description of Artificial Sequence: Synthetic oligonucleotide
  Target: DMPK; (+) strand; PAM type: YTN; PAM sequence: CTA
atttacttgtgataagcaat

SEQ ID NO: 18946 - DNA, 20 bp, Artificial Sequence
  Description of Artificial Sequence: Synthetic oligonucleotide
  Target: DMPK; (+) strand; PAM type: YTN; PAM sequence: TTT
acttgtgataagcaatgcat

SEQ ID NO: 18947 - DNA, 20 bp, Artificial Sequence
  Description of Artificial Sequence: Synthetic oligonucleotide
  Target: DMPK; (+) strand; PAM type: YTN; PAM sequence: TTA
cttgtgataagcaatgcatt

SEQ ID NO: 18948 - DNA, 20 bp, Artificial Sequence
  Description of Artificial Sequence: Synthetic oligonucleotide
  Target: DMPK; (+) strand; PAM type: YTN; PAM sequence: CTT
gtgataagcaatgcattatt

SEQ ID NO: 18949 - DNA, 20 bp, Artificial Sequence
  Description of Artificial Sequence: Synthetic oligonucleotide
  Target: DMPK; (+) strand; PAM type: YTN; PAM sequence: TTG
tgataagcaatgcattattt

SEQ ID NO: 18950 - DNA, 20 bp, Artificial Sequence
  Description of Artificial Sequence: Synthetic oligonucleotide
  Target: DMPK; (+) strand; PAM type: YTN; PAM sequence: TTA
tttgtgtaattaatactttt

SEQ ID NO: 18951 - DNA, 20 bp, Artificial Sequence
  Description of Artificial Sequence: Synthetic oligonucleotide
  Target: DMPK; (+) strand; PAM type: YTN; PAM sequence: TTT
gtgtaattaatacttttgtt

SEQ ID NO: 18952 - DNA, 20 bp, Artificial Sequence
  Description of Artificial Sequence: Synthetic oligonucleotide
  Target: DMPK; (+) strand; PAM type: YTN; PAM sequence: TTG
tgtaattaatacttttgttg

SEQ ID NO: 18953 - DNA, 20 bp, Artificial Sequence
  Description of Artificial Sequence: Synthetic oligonucleotide
  Target: DMPK; (+) strand; PAM type: YTN; PAM sequence: TTA
atacttttgttgagaccagg

SEQ ID NO: 18954 - DNA, 20 bp, Artificial Sequence
  Description of Artificial Sequence: Synthetic oligonucleotide
  Target: DMPK; (+) strand; PAM type: YTN; PAM sequence: CTT
ttgttgagaccaggtctcac

SEQ ID NO: 18955 - DNA, 20 bp, Artificial Sequence
  Description of Artificial Sequence: Synthetic oligonucleotide
  Target: DMPK; (+) strand; PAM type: YTN; PAM sequence: TTT
tgttgagaccaggtctcact

SEQ ID NO: 18956 - DNA, 20 bp, Artificial Sequence
  Description of Artificial Sequence: Synthetic oligonucleotide
  Target: DMPK; (+) strand; PAM type: YTN; PAM sequence: TTT
gttgagaccaggtctcactt

SEQ ID NO: 18957 - DNA, 20 bp, Artificial Sequence
  Description of Artificial Sequence: Synthetic oligonucleotide
  Target: DMPK; (+) strand; PAM type: YTN; PAM sequence: TTG
ttgagaccaggtctcacttt

SEQ ID NO: 18958 - DNA, 20 bp, Artificial Sequence
  Description of Artificial Sequence: Synthetic oligonucleotide
  Target: DMPK; (+) strand; PAM type: YTN; PAM sequence: TTG
agaccaggtctcactttgtt

SEQ ID NO: 18959 - DNA, 20 bp, Artificial Sequence
  Description of Artificial Sequence: Synthetic oligonucleotide
  Target: DMPK; (+) strand; PAM type: YTN; PAM sequence: CTC
actttgttgcctaggctgga

SEQ ID NO: 18960 - DNA, 20 bp, Artificial Sequence
  Description of Artificial Sequence: Synthetic oligonucleotide
  Target: DMPK; (+) strand; PAM type: YTN; PAM sequence: CTT
tgttgcctaggctggaatct

SEQ ID NO: 18961 - DNA, 20 bp, Artificial Sequence
  Description of Artificial Sequence: Synthetic oligonucleotide
  Target: DMPK; (+) strand; PAM type: YTN; PAM sequence: TTT
gttgcctaggctggaatcta

SEQ ID NO: 18962 - DNA, 20 bp, Artificial Sequence
  Description of Artificial Sequence: Synthetic oligonucleotide
  Target: DMPK; (+) strand; PAM type: YTN; PAM sequence: TTG
ttgcctaggctggaatctat

SEQ ID NO: 18963 - DNA, 20 bp, Artificial Sequence
  Description of Artificial Sequence: Synthetic oligonucleotide
  Target: DMPK; (+) strand; PAM type: YTN; PAM sequence: TTG
cctaggctggaatctatcat

SEQ ID NO: 18964 - DNA, 20 bp, Artificial Sequence
  Description of Artificial Sequence: Synthetic oligonucleotide
  Target: DMPK; (+) strand; PAM type: YTN; PAM sequence: CTA
ggctggaatctatcatggct

SEQ ID NO: 18965 - DNA, 20 bp, Artificial Sequence
  Description of Artificial Sequence: Synthetic oligonucleotide
  Target: DMPK; (+) strand; PAM type: YTN; PAM sequence: CTG
gaatctatcatggctcactg

SEQ ID NO: 18966 - DNA, 20 bp, Artificial Sequence
  Description of Artificial Sequence: Synthetic oligonucleotide
  Target: DMPK; (+) strand; PAM type: YTN; PAM sequence: CTA
tcatggctcactgaagcctc

SEQ ID NO: 18967 - DNA, 20 bp, Artificial Sequence
  Description of Artificial Sequence: Synthetic oligonucleotide
  Target: DMPK; (+) strand; PAM type: YTN; PAM sequence: CTC
actgaagcctcaaactccag

SEQ ID NO: 18968 - DNA, 20 bp, Artificial Sequence
  Description of Artificial Sequence: Synthetic oligonucleotide
  Target: DMPK; (+) strand; PAM type: YTN; PAM sequence: CTG
aagcctcaaactccaggctc

SEQ ID NO: 18969 - DNA, 20 bp, Artificial Sequence
  Description of Artificial Sequence: Synthetic oligonucleotide
  Target: DMPK; (+) strand; PAM type: YTN; PAM sequence: CTC
aaactccaggctcaagtgat

SEQ ID NO: 18970 - DNA, 20 bp, Artificial Sequence
  Description of Artificial Sequence: Synthetic oligonucleotide
  Target: DMPK; (+) strand; PAM type: YTN; PAM sequence: CTC
caggctcaagtgattctcct

SEQ ID NO: 18971 - DNA, 20 bp, Artificial Sequence
  Description of Artificial Sequence: Synthetic oligonucleotide
  Target: DMPK; (+) strand; PAM type: YTN; PAM sequence: CTC
aagtgattctcctacttcag

SEQ ID NO: 18972 - DNA, 20 bp, Artificial Sequence
  Description of Artificial Sequence: Synthetic oligonucleotide
  Target: DMPK; (+) strand; PAM type: YTN; PAM sequence: TTC
tcctacttcagactcctgag

SEQ ID NO: 18973 - DNA, 20 bp, Artificial Sequence
  Description of Artificial Sequence: Synthetic oligonucleotide
  Target: DMPK; (+) strand; PAM type: YTN; PAM sequence: CTC
ctacttcagactcctgagta

SEQ ID NO: 18974 - DNA, 20 bp, Artificial Sequence
  Description of Artificial Sequence: Synthetic oligonucleotide
  Target: DMPK; (+) strand; PAM type: YTN; PAM sequence: CTA
cttcagactcctgagtagct

SEQ ID NO: 18975 - DNA, 20 bp, Artificial Sequence
  Description of Artificial Sequence: Synthetic oligonucleotide
  Target: DMPK; (+) strand; PAM type: YTN; PAM sequence: CTT
cagactcctgagtagctagg

SEQ ID NO: 18976 - DNA, 20 bp, Artificial Sequence
  Description of Artificial Sequence: Synthetic oligonucleotide
  Target: DMPK; (+) strand; PAM type: YTN; PAM sequence: TTC
agactcctgagtagctagga

SEQ ID NO: 18977 - DNA, 20 bp, Artificial Sequence
  Description of Artificial Sequence: Synthetic oligonucleotide
  Target: DMPK; (+) strand; PAM type: YTN; PAM sequence: CTC
ctgagtagctaggactgcag

SEQ ID NO: 18978 - DNA, 20 bp, Artificial Sequence
  Description of Artificial Sequence: Synthetic oligonucleotide
  Target: DMPK; (+) strand; PAM type: YTN; PAM sequence: CTG
agtagctaggactgcaggca

SEQ ID NO: 18979 - DNA, 20 bp, Artificial Sequence
  Description of Artificial Sequence: Synthetic oligonucleotide
  Target: DMPK; (+) strand; PAM type: YTN; PAM sequence: CTA
ggactgcaggcacagaccac

SEQ ID NO: 18980 - DNA, 20 bp, Artificial Sequence
  Description of Artificial Sequence: Synthetic oligonucleotide
  Target: DMPK; (+) strand; PAM type: YTN; PAM sequence: CTG
caggcacagaccaccatgcc

SEQ ID NO: 18981 - DNA, 20 bp, Artificial Sequence
  Description of Artificial Sequence: Synthetic oligonucleotide
  Target: DMPK; (+) strand; PAM type: YTN; PAM sequence: CTG
gcacgattttttcaattttt

SEQ ID NO: 18982 - DNA, 20 bp, Artificial Sequence
  Description of Artificial Sequence: Synthetic oligonucleotide
  Target: DMPK; (+) strand; PAM type: YTN; PAM sequence: TTT
tttcaattttttgtagagac

SEQ ID NO: 18983 - DNA, 20 bp, Artificial Sequence
  Description of Artificial Sequence: Synthetic oligonucleotide
  Target: DMPK; (+) strand; PAM type: YTN; PAM sequence: TTT
ttcaattttttgtagagaca

SEQ ID NO: 18984 - DNA, 20 bp, Artificial Sequence
  Description of Artificial Sequence: Synthetic oligonucleotide
  Target: DMPK; (+) strand; PAM type: YTN; PAM sequence: TTT
tcaattttttgtagagacag

SEQ ID NO: 18985 - DNA, 20 bp, Artificial Sequence
  Description of Artificial Sequence: Synthetic oligonucleotide
  Target: DMPK; (+) strand; PAM type: YTN; PAM sequence: TTT
caattttttgtagagacagg

SEQ ID NO: 18986 - DNA, 20 bp, Artificial Sequence
  Description of Artificial Sequence: Synthetic oligonucleotide
  Target: DMPK; (+) strand; PAM type: YTN; PAM sequence: TTC
aattttttgtagagacaggg

SEQ ID NO: 18987 - DNA, 20 bp, Artificial Sequence
  Description of Artificial Sequence: Synthetic oligonucleotide
  Target: DMPK; (+) strand; PAM type: YTN; PAM sequence: TTT
tttgtagagacagggtctca

SEQ ID NO: 18988 - DNA, 20 bp, Artificial Sequence
  Description of Artificial Sequence: Synthetic oligonucleotide
  Target: DMPK; (+) strand; PAM type: YTN; PAM sequence: TTT
ttgtagagacagggtctcat

SEQ ID NO: 18989 - DNA, 20 bp, Artificial Sequence
  Description of Artificial Sequence: Synthetic oligonucleotide
  Target: DMPK; (+) strand; PAM type: YTN; PAM sequence: TTT
tgtagagacagggtctcatt

SEQ ID NO: 18990 - DNA, 20 bp, Artificial Sequence
  Description of Artificial Sequence: Synthetic oligonucleotide
  Target: DMPK; (+) strand; PAM type: YTN; PAM sequence: TTT
gtagagacagggtctcatta

SEQ ID NO: 18991 - DNA, 20 bp, Artificial Sequence
  Description of Artificial Sequence: Synthetic oligonucleotide
  Target: DMPK; (+) strand; PAM type: YTN; PAM sequence: TTG
tagagacagggtctcattat

SEQ ID NO: 18992 - DNA, 20 bp, Artificial Sequence
  Description of Artificial Sequence: Synthetic oligonucleotide
  Target: DMPK; (+) strand; PAM type: YTN; PAM sequence: CTC
attatgttgctcaggctggt

SEQ ID NO: 18993 - DNA, 20 bp, Artificial Sequence
  Description of Artificial Sequence: Synthetic oligonucleotide
  Target: DMPK; (+) strand; PAM type: YTN; PAM sequence: TTA
tgttgctcaggctggtcttg

SEQ ID NO: 18994 - DNA, 20 bp, Artificial Sequence
  Description of Artificial Sequence: Synthetic oligonucleotide
  Target: DMPK; (+) strand; PAM type: YTN; PAM sequence: TTG
ctcaggctggtcttgaactc

SEQ ID NO: 18995 - DNA, 20 bp, Artificial Sequence
  Description of Artificial Sequence: Synthetic oligonucleotide
  Target: DMPK; (+) strand; PAM type: YTN; PAM sequence: CTC
aggctggtcttgaactcctg

SEQ ID NO: 18996 - DNA, 20 bp, Artificial Sequence
  Description of Artificial Sequence: Synthetic oligonucleotide
  Target: DMPK; (+) strand; PAM type: YTN; PAM sequence: CTG
gtcttgaactcctgggctga

SEQ ID NO: 18997 - DNA, 20 bp, Artificial Sequence
  Description of Artificial Sequence: Synthetic oligonucleotide
  Target: DMPK; (+) strand; PAM type: YTN; PAM sequence: CTT
gaactcctgggctgaagcaa

SEQ ID NO: 18998 - DNA, 20 bp, Artificial Sequence
  Description of Artificial Sequence: Synthetic oligonucleotide
  Target: DMPK; (+) strand; PAM type: YTN; PAM sequence: TTG
aactcctgggctgaagcaat

SEQ ID NO: 18999 - DNA, 20 bp, Artificial Sequence
  Description of Artificial Sequence: Synthetic oligonucleotide
  Target: DMPK; (+) strand; PAM type: YTN; PAM sequence: CTC
ctgggctgaagcaatccgtc

SEQ ID NO: 19000 - DNA, 20 bp, Artificial Sequence
  Description of Artificial Sequence: Synthetic oligonucleotide
  Target: DMPK; (+) strand; PAM type: YTN; PAM sequence: CTG
ggctgaagcaatccgtccac

SEQ ID NO: 19001 - DNA, 20 bp, Artificial Sequence
  Description of Artificial Sequence: Synthetic oligonucleotide
  Target: DMPK; (+) strand; PAM type: YTN; PAM sequence: CTG
aagcaatccgtccacttcag

SEQ ID NO: 19002 - DNA, 20 bp, Artificial Sequence
  Description of Artificial Sequence: Synthetic oligonucleotide
  Target: DMPK; (+) strand; PAM type: YTN; PAM sequence: CTT
cagcctcccaaagtgctggg

SEQ ID NO: 19003 - DNA, 20 bp, Artificial Sequence
  Description of Artificial Sequence: Synthetic oligonucleotide
  Target: DMPK; (+) strand; PAM type: YTN; PAM sequence: TTC
agcctcccaaagtgctggga

SEQ ID NO: 19004 - DNA, 20 bp, Artificial Sequence
  Description of Artificial Sequence: Synthetic oligonucleotide
  Target: DMPK; (+) strand; PAM type: YTN; PAM sequence: CTC
ccaaagtgctgggattccaa

SEQ ID NO: 19005 - DNA, 20 bp, Artificial Sequence
  Description of Artificial Sequence: Synthetic oligonucleotide
  Target: DMPK; (+) strand; PAM type: YTN; PAM sequence: CTG
ggattccaagcgtgagccac

SEQ ID NO: 19006 - DNA, 20 bp, Artificial Sequence
  Description of Artificial Sequence: Synthetic oligonucleotide
  Target: DMPK; (+) strand; PAM type: YTN; PAM sequence: TTC
caagcgtgagccaccatgcc

SEQ ID NO: 19007 - DNA, 20 bp, Artificial Sequence
  Description of Artificial Sequence: Synthetic oligonucleotide
  Target: DMPK; (+) strand; PAM type: YTN; PAM sequence: CTG
taaattagtacttttttttt

SEQ ID NO: 19008 - DNA, 20 bp, Artificial Sequence
  Description of Artificial Sequence: Synthetic oligonucleotide
  Target: DMPK; (+) strand; PAM type: YTN; PAM sequence: TTA
gtactttttttttttttttt

SEQ ID NO: 19009 - DNA, 20 bp, Artificial Sequence
  Description of Artificial Sequence: Synthetic oligonucleotide
  Target: DMPK; (+) strand; PAM type: YTN; PAM sequence: CTT
ttttttttttttttttgaga

SEQ ID NO: 19010 - DNA, 20 bp, Artificial Sequence
  Description of Artificial Sequence: Synthetic oligonucleotide
  Target: DMPK; (+) strand; PAM type: YTN; PAM sequence: TTT
tttttttttttttttgagat

SEQ ID NO: 19011 - DNA, 20 bp, Artificial Sequence
  Description of Artificial Sequence: Synthetic oligonucleotide
  Target: DMPK; (+) strand; PAM type: YTN; PAM sequence: TTT
ttttttttttttttgagatg

SEQ ID NO: 19012 - DNA, 20 bp, Artificial Sequence
  Description of Artificial Sequence: Synthetic oligonucleotide
  Target: DMPK; (+) strand; PAM type: YTN; PAM sequence: TTT
tttttttttttttgagatga

SEQ ID NO: 19013 - DNA, 20 bp, Artificial Sequence
  Description of Artificial Sequence: Synthetic oligonucleotide
  Target: DMPK; (+) strand; PAM type: YTN; PAM sequence: TTT
ttttttttttttgagatgaa

SEQ ID NO: 19014 - DNA, 20 bp, Artificial Sequence
  Description of Artificial Sequence: Synthetic oligonucleotide
  Target: DMPK; (+) strand; PAM type: YTN; PAM sequence: TTT
tttttttttttgagatgaag

SEQ ID NO: 19015 - DNA, 20 bp, Artificial Sequence
  Description of Artificial Sequence: Synthetic oligonucleotide
  Target: DMPK; (+) strand; PAM type: YTN; PAM sequence: TTT
ttttttttttgagatgaagt

SEQ ID NO: 19016 - DNA, 20 bp, Artificial Sequence
  Description of Artificial Sequence: Synthetic oligonucleotide
  Target: DMPK; (+) strand; PAM type: YTN; PAM sequence: TTT
tttttttttgagatgaagtt

SEQ ID NO: 19017 - DNA, 20 bp, Artificial Sequence
  Description of Artificial Sequence: Synthetic oligonucleotide
  Target: DMPK; (+) strand; PAM type: YTN; PAM sequence: TTT
ttttttttgagatgaagttt

SEQ ID NO: 19018 - DNA, 20 bp, Artificial Sequence
  Description of Artificial Sequence: Synthetic oligonucleotide
  Target: DMPK; (+) strand; PAM type: YTN; PAM sequence: TTT
tttttttgagatgaagtttc

SEQ ID NO: 19019 - DNA, 20 bp, Artificial Sequence
  Description of Artificial Sequence: Synthetic oligonucleotide
  Target: DMPK; (+) strand; PAM type: YTN; PAM sequence: TTT
ttttttgagatgaagtttca

SEQ ID NO: 19020 - DNA, 20 bp, Artificial Sequence
  Description of Artificial Sequence: Synthetic oligonucleotide
  Target: DMPK; (+) strand; PAM type: YTN; PAM sequence: TTT
tttttgagatgaagtttcac

SEQ ID NO: 19021 - DNA, 20 bp, Artificial Sequence
  Description of Artificial Sequence: Synthetic oligonucleotide
  Target: DMPK; (+) strand; PAM type: YTN; PAM sequence: TTT
ttttgagatgaagtttcact

SEQ ID NO: 19022 - DNA, 20 bp, Artificial Sequence
  Description of Artificial Sequence: Synthetic oligonucleotide
  Target: DMPK; (+) strand; PAM type: YTN; PAM sequence: TTT
tttgagatgaagtttcactc

SEQ ID NO: 19023 - DNA, 20 bp, Artificial Sequence
  Description of Artificial Sequence: Synthetic oligonucleotide
  Target: DMPK; (+) strand; PAM type: YTN; PAM sequence: TTT
ttgagatgaagtttcactct

SEQ ID NO: 19024 - DNA, 20 bp, Artificial Sequence
  Description of Artificial Sequence: Synthetic oligonucleotide
  Target: DMPK; (+) strand; PAM type: YTN; PAM sequence: TTT
tgagatgaagtttcactctt

SEQ ID NO: 19025 - DNA, 20 bp, Artificial Sequence
  Description of Artificial Sequence: Synthetic oligonucleotide
  Target: DMPK; (+) strand; PAM type: YTN; PAM sequence: TTT
gagatgaagtttcactcttg

SEQ ID NO: 19026 - DNA, 20 bp, Artificial Sequence
  Description of Artificial Sequence: Synthetic oligonucleotide
  Target: DMPK; (+) strand; PAM type: YTN; PAM sequence: TTG
agatgaagtttcactcttgt

SEQ ID NO: 19027 - DNA, 20 bp, Artificial Sequence
  Description of Artificial Sequence: Synthetic oligonucleotide
  Target: DMPK; (+) strand; PAM type: YTN; PAM sequence: TTT
cactcttgttgcccaggctg

SEQ ID NO: 19028 - DNA, 20 bp, Artificial Sequence
  Description of Artificial Sequence: Synthetic oligonucleotide
  Target: DMPK; (+) strand; PAM type: YTN; PAM sequence: TTC
actcttgttgcccaggctgg

SEQ ID NO: 19029 - DNA, 20 bp, Artificial Sequence
  Description of Artificial Sequence: Synthetic oligonucleotide
  Target: DMPK; (+) strand; PAM type: YTN; PAM sequence: CTC
ttgttgcccaggctggaatg

SEQ ID NO: 19030 - DNA, 20 bp, Artificial Sequence
  Description of Artificial Sequence: Synthetic oligonucleotide
  Target: DMPK; (+) strand; PAM type: YTN; PAM sequence: CTT
gttgcccaggctggaatgca

SEQ ID NO: 19031 - DNA, 20 bp, Artificial Sequence
  Description of Artificial Sequence: Synthetic oligonucleotide
  Target: DMPK; (+) strand; PAM type: YTN; PAM sequence: TTG
ttgcccaggctggaatgcaa

SEQ ID NO: 19032 - DNA, 20 bp, Artificial Sequence
  Description of Artificial Sequence: Synthetic oligonucleotide
  Target: DMPK; (+) strand; PAM type: YTN; PAM sequence: TTG
cccaggctggaatgcaatgg

SEQ ID NO: 19033 - DNA, 20 bp, Artificial Sequence
  Description of Artificial Sequence: Synthetic oligonucleotide
  Target: DMPK; (+) strand; PAM type: YTN; PAM sequence: CTG
gaatgcaatggcacgatctc

SEQ ID NO: 19034 - DNA, 20 bp, Artificial Sequence
  Description of Artificial Sequence: Synthetic oligonucleotide
  Target: DMPK; (+) strand; PAM type: YTN; PAM sequence: CTC
agctcaccacaacctccccc

SEQ ID NO: 19035 - DNA, 20 bp, Artificial Sequence
  Description of Artificial Sequence: Synthetic oligonucleotide
  Target: DMPK; (+) strand; PAM type: YTN; PAM sequence: CTC
accacaacctccccctcctg

SEQ ID NO: 19036 - DNA, 20 bp, Artificial Sequence
  Description of Artificial Sequence: Synthetic oligonucleotide
  Target: DMPK; (+) strand; PAM type: YTN; PAM sequence: CTC
cccctcctgggttctgattc

SEQ ID NO: 19037 - DNA, 20 bp, Artificial Sequence
  Description of Artificial Sequence: Synthetic oligonucleotide
  Target: DMPK; (+) strand; PAM type: YTN; PAM sequence: CTC
ctgggttctgattctcctgc

SEQ ID NO: 19038 - DNA, 20 bp, Artificial Sequence
  Description of Artificial Sequence: Synthetic oligonucleotide
  Target: DMPK; (+) strand; PAM type: YTN; PAM sequence: CTG
ggttctgattctcctgcctc

SEQ ID NO: 19039 - DNA, 20 bp, Artificial Sequence
  Description of Artificial Sequence: Synthetic oligonucleotide
  Target: DMPK; (+) strand; PAM type: YTN; PAM sequence: TTC
tgattctcctgcctcagcct

SEQ ID NO: 19040 - DNA, 20 bp, Artificial Sequence
  Description of Artificial Sequence: Synthetic oligonucleotide
  Target: DMPK; (+) strand; PAM type: YTN; PAM sequence: CTG
attctcctgcctcagcctcc

SEQ ID NO: 19041 - DNA, 20 bp, Artificial Sequence
  Description of Artificial Sequence: Synthetic oligonucleotide
  Target: DMPK; (+) strand; PAM type: YTN; PAM sequence: TTC
tcctgcctcagcctcctgag

SEQ ID NO: 19042 - DNA, 20 bp, Artificial Sequence
  Description of Artificial Sequence: Synthetic oligonucleotide
  Target: DMPK; (+) strand; PAM type: YTN; PAM sequence: CTC
ctgcctcagcctcctgagta

SEQ ID NO: 19043 - DNA, 20 bp, Artificial Sequence
  Description of Artificial Sequence: Synthetic oligonucleotide
  Target: DMPK; (+) strand; PAM type: YTN; PAM sequence: CTG
cctcagcctcctgagtagct

SEQ ID NO: 19044 - DNA, 20 bp, Artificial Sequence
  Description of Artificial Sequence: Synthetic oligonucleotide
  Target: DMPK; (+) strand; PAM type: YTN; PAM sequence: CTC
agcctcctgagtagctggga

SEQ ID NO: 19045 - DNA, 20 bp, Artificial Sequence
  Description of Artificial Sequence: Synthetic oligonucleotide
  Target: DMPK; (+) strand; PAM type: YTN; PAM sequence: CTC
ctgagtagctgggattacag

SEQ ID NO: 19046 - DNA, 20 bp, Artificial Sequence
  Description of Artificial Sequence: Synthetic oligonucleotide
  Target: DMPK; (+) strand; PAM type: YTN; PAM sequence: CTG
agtagctgggattacaggta

SEQ ID NO: 19047 - DNA, 20 bp, Artificial Sequence
  Description of Artificial Sequence: Synthetic oligonucleotide
  Target: DMPK; (+) strand; PAM type: YTN; PAM sequence: CTG
ggattacaggtatatgccac

SEQ ID NO: 19048 - DNA, 20 bp, Artificial Sequence
  Description of Artificial Sequence: Synthetic oligonucleotide
  Target: DMPK; (+) strand; PAM type: YTN; PAM sequence: TTA
caggtatatgccaccacgcc

SEQ ID NO: 19049 - DNA, 20 bp, Artificial Sequence
  Description of Artificial Sequence: Synthetic oligonucleotide
  Target: DMPK; (+) strand; PAM type: YTN; PAM sequence: CTG
gctaattttgttttttagta

SEQ ID NO: 19050 - DNA, 20 bp, Artificial Sequence
  Description of Artificial Sequence: Synthetic oligonucleotide
  Target: DMPK; (+) strand; PAM type: YTN; PAM sequence: CTA
attttgttttttagtagaga

SEQ ID NO: 19051 - DNA, 20 bp, Artificial Sequence
  Description of Artificial Sequence: Synthetic oligonucleotide
  Target: DMPK; (+) strand; PAM type: YTN; PAM sequence: TTT
tgttttttagtagagatgag

SEQ ID NO: 19052 - DNA, 20 bp, Artificial Sequence
  Description of Artificial Sequence: Synthetic oligonucleotide
  Target: DMPK; (+) strand; PAM type: YTN; PAM sequence: TTT
gttttttagtagagatgagg

SEQ ID NO: 19053 - DNA, 20 bp, Artificial Sequence
  Description of Artificial Sequence: Synthetic oligonucleotide
  Target: DMPK; (+) strand; PAM type: YTN; PAM sequence: TTG
ttttttagtagagatgaggt

SEQ ID NO: 19054 - DNA, 20 bp, Artificial Sequence
  Description of Artificial Sequence: Synthetic oligonucleotide
  Target: DMPK; (+) strand; PAM type: YTN; PAM sequence: TTT
tttagtagagatgaggtttc

SEQ ID NO: 19055 - DNA, 20 bp, Artificial Sequence
  Description of Artificial Sequence: Synthetic oligonucleotide
  Target: DMPK; (+) strand; PAM type: YTN; PAM sequence: TTT
ttagtagagatgaggtttct

SEQ ID NO: 19056 - DNA, 20 bp, Artificial Sequence
  Description of Artificial Sequence: Synthetic oligonucleotide
  Target: DMPK; (+) strand; PAM type: YTN; PAM sequence: TTT
tagtagagatgaggtttctc

SEQ ID NO: 19057 - DNA, 20 bp, Artificial Sequence
  Description of Artificial Sequence: Synthetic oligonucleotide
  Target: DMPK; (+) strand; PAM type: YTN; PAM sequence: TTT
agtagagatgaggtttctcc

SEQ ID NO: 19058 - DNA, 20 bp, Artificial Sequence
  Description of Artificial Sequence: Synthetic oligonucleotide
  Target: DMPK; (+) strand; PAM type: YTN; PAM sequence: TTA
gtagagatgaggtttctcca

SEQ ID NO: 19059 - DNA, 20 bp, Artificial Sequence
  Description of Artificial Sequence: Synthetic oligonucleotide
  Target: DMPK; (+) strand; PAM type: YTN; PAM sequence: TTT
ctccacgttggtcaggctgg

SEQ ID NO: 19060 - DNA, 20 bp, Artificial Sequence
  Description of Artificial Sequence: Synthetic oligonucleotide
  Target: DMPK; (+) strand; PAM type: YTN; PAM sequence: TTC
tccacgttggtcaggctggt

SEQ ID NO: 19061 - DNA, 20 bp, Artificial Sequence
  Description of Artificial Sequence: Synthetic oligonucleotide
  Target: DMPK; (+) strand; PAM type: YTN; PAM sequence: CTC
cacgttggtcaggctggtct

SEQ ID NO: 19062 - DNA, 20 bp, Artificial Sequence
  Description of Artificial Sequence: Synthetic oligonucleotide
  Target: DMPK; (+) strand; PAM type: YTN; PAM sequence: TTG
gtcaggctggtctcgaactc

SEQ ID NO: 19063 - DNA, 20 bp, Artificial Sequence
  Description of Artificial Sequence: Synthetic oligonucleotide
  Target: DMPK; (+) strand; PAM type: YTN; PAM sequence: CTG
gtctcgaactcctgacctca

SEQ ID NO: 19064 - DNA, 20 bp, Artificial Sequence
  Description of Artificial Sequence: Synthetic oligonucleotide
  Target: DMPK; (+) strand; PAM type: YTN; PAM sequence: CTC
gaactcctgacctcaggtga

SEQ ID NO: 19065 - DNA, 20 bp, Artificial Sequence
  Description of Artificial Sequence: Synthetic oligonucleotide
  Target: DMPK; (+) strand; PAM type: YTN; PAM sequence: CTC
ctgacctcaggtgatccacc

SEQ ID NO: 19066 - DNA, 20 bp, Artificial Sequence
  Description of Artificial Sequence: Synthetic oligonucleotide
  Target: DMPK; (+) strand; PAM type: YTN; PAM sequence: CTG
acctcaggtgatccacccac

SEQ ID NO: 19067 - DNA, 20 bp, Artificial Sequence
  Description of Artificial Sequence: Synthetic oligonucleotide
  Target: DMPK; (+) strand; PAM type: YTN; PAM sequence: CTC
aggtgatccacccacctcat

SEQ ID NO: 19068 - DNA, 20 bp, Artificial Sequence
  Description of Artificial Sequence: Synthetic oligonucleotide
  Target: DMPK; (+) strand; PAM type: YTN; PAM sequence: CTC
atcctcccaaagcactggaa

SEQ ID NO: 19069 - DNA, 20 bp, Artificial Sequence
  Description of Artificial Sequence: Synthetic oligonucleotide
  Target: DMPK; (+) strand; PAM type: YTN; PAM sequence: CTC
ccaaagcactggaattacag

SEQ ID NO: 19070 - DNA, 20 bp, Artificial Sequence
  Description of Artificial Sequence: Synthetic oligonucleotide
  Target: DMPK; (+) strand; PAM type: YTN; PAM sequence: CTG
gaattacaggcgtgagccac

SEQ ID NO: 19071 - DNA, 20 bp, Artificial Sequence
  Description of Artificial Sequence: Synthetic oligonucleotide
  Target: DMPK; (+) strand; PAM type: YTN; PAM sequence: TTA
caggcgtgagccaccacacc

SEQ ID NO: 19072 - DNA, 20 bp, Artificial Sequence
  Description of Artificial Sequence: Synthetic oligonucleotide
  Target: DMPK; (+) strand; PAM type: YTN; PAM sequence: CTA
aataaatacttttttttttt

SEQ ID NO: 19073 - DNA, 20 bp, Artificial Sequence
  Description of Artificial Sequence: Synthetic oligonucleotide
  Target: DMPK; (+) strand; PAM type: YTN; PAM sequence: CTT
ttttttttttttttttgaga

SEQ ID NO: 19074 - DNA, 20 bp, Artificial Sequence
  Description of Artificial Sequence: Synthetic oligonucleotide
  Target: DMPK; (+) strand; PAM type: YTN; PAM sequence: TTT
tttttttttttttttgagac

SEQ ID NO: 19075 - DNA, 20 bp, Artificial Sequence
  Description of Artificial Sequence: Synthetic oligonucleotide
  Target: DMPK; (+) strand; PAM type: YTN; PAM sequence: TTT
ttttttttttttttgagacg

SEQ ID NO: 19076 - DNA, 20 bp, Artificial Sequence
  Description of Artificial Sequence: Synthetic oligonucleotide
  Target: DMPK; (+) strand; PAM type: YTN; PAM sequence: TTT
tttttttttttttgagacgg

SEQ ID NO: 19077 - DNA, 20 bp, Artificial Sequence
  Description of Artificial Sequence: Synthetic oligonucleotide
  Target: DMPK; (+) strand; PAM type: YTN; PAM sequence: TTT
ttttttttttttgagacgga

SEQ ID NO: 19078 - DNA, 20 bp, Artificial Sequence
  Description of Artificial Sequence: Synthetic oligonucleotide
  Target: DMPK; (+) strand; PAM type: YTN; PAM sequence: TTT
tttttttttttgagacggag

SEQ ID NO: 19079 - DNA, 20 bp, Artificial Sequence
  Description of Artificial Sequence: Synthetic oligonucleotide
  Target: DMPK; (+) strand; PAM type: YTN; PAM sequence: TTT
ttttttttttgagacggagt

SEQ ID NO: 19080 - DNA, 20 bp, Artificial Sequence
  Description of Artificial Sequence: Synthetic oligonucleotide
  Target: DMPK; (+) strand; PAM type: YTN; PAM sequence: TTT
tttttttttgagacggagtc

SEQ ID NO: 19081 - DNA, 20 bp, Artificial Sequence
  Description of Artificial Sequence: Synthetic oligonucleotide
  Target: DMPK; (+) strand; PAM type: YTN; PAM sequence: TTT
ttttttttgagacggagtct

SEQ ID NO: 19082 - DNA, 20 bp, Artificial Sequence
  Description of Artificial Sequence: Synthetic oligonucleotide
  Target: DMPK; (+) strand; PAM type: YTN; PAM sequence: TTT
tttttttgagacggagtctt

SEQ ID NO: 19083 - DNA, 20 bp, Artificial Sequence
  Description of Artificial Sequence: Synthetic oligonucleotide
  Target: DMPK; (+) strand; PAM type: YTN; PAM sequence: TTT
ttttttgagacggagtcttg

SEQ ID NO: 19084 - DNA, 20 bp, Artificial Sequence
  Description of Artificial Sequence: Synthetic oligonucleotide
  Target: DMPK; (+) strand; PAM type: YTN; PAM sequence: TTT
tttttgagacggagtcttgc

SEQ ID NO: 19085 - DNA, 20 bp, Artificial Sequence
  Description of Artificial Sequence: Synthetic oligonucleotide
  Target: DMPK; (+) strand; PAM type: YTN; PAM sequence: TTT
ttttgagacggagtcttgct

SEQ ID NO: 19086 - DNA, 20 bp, Artificial Sequence
  Description of Artificial Sequence: Synthetic oligonucleotide
  Target: DMPK; (+) strand; PAM type: YTN; PAM sequence: TTT
tttgagacggagtcttgctc

SEQ ID NO: 19087 - DNA, 20 bp, Artificial Sequence
  Description of Artificial Sequence: Synthetic oligonucleotide
  Target: DMPK; (+) strand; PAM type: YTN; PAM sequence: TTT
ttgagacggagtcttgctct

SEQ ID NO: 19088 - DNA, 20 bp, Artificial Sequence
  Description of Artificial Sequence: Synthetic oligonucleotide
  Target: DMPK; (+) strand; PAM type: YTN; PAM sequence: TTT
tgagacggagtcttgctctg

SEQ ID NO: 19089 - DNA, 20 bp, Artificial Sequence
  Description of Artificial Sequence: Synthetic oligonucleotide
  Target: DMPK; (+) strand; PAM type: YTN; PAM sequence: TTT
gagacggagtcttgctctgt

SEQ ID NO: 19090 - DNA, 20 bp, Artificial Sequence
  Description of Artificial Sequence: Synthetic oligonucleotide
  Target: DMPK; (+) strand; PAM type: YTN; PAM sequence: TTG
agacggagtcttgctctgtc

SEQ ID NO: 19091 - DNA, 20 bp, Artificial Sequence
  Description of Artificial Sequence: Synthetic oligonucleotide
  Target: DMPK; (+) strand; PAM type: YTN; PAM sequence: CTT
gctctgtcgcccaggctgga

SEQ ID NO: 19092 - DNA, 20 bp, Artificial Sequence
  Description of Artificial Sequence: Synthetic oligonucleotide
  Target: DMPK; (+) strand; PAM type: YTN; PAM sequence: TTG
ctctgtcgcccaggctggag

SEQ ID NO: 19093 - DNA, 20 bp, Artificial Sequence
  Description of Artificial Sequence: Synthetic oligonucleotide
  Target: DMPK; (+) strand; PAM type: YTN; PAM sequence: CTC
tgtcgcccaggctggagtgc

SEQ ID NO: 19094 - DNA, 20 bp, Artificial Sequence
  Description of Artificial Sequence: Synthetic oligonucleotide
  Target: DMPK; (+) strand; PAM type: YTN; PAM sequence: CTG
tcgcccaggctggagtgcag

SEQ ID NO: 19095 - DNA, 20 bp, Artificial Sequence
  Description of Artificial Sequence: Synthetic oligonucleotide
  Target: DMPK; (+) strand; PAM type: YTN; PAM sequence: CTG
gagtgcagtggcatgatctc

SEQ ID NO: 19096 - DNA, 20 bp, Artificial Sequence
  Description of Artificial Sequence: Synthetic oligonucleotide
  Target: DMPK; (+) strand; PAM type: YTN; PAM sequence: CTC
ggctcactgcaagctccgcc

SEQ ID NO: 19097 - DNA, 20 bp, Artificial Sequence
  Description of Artificial Sequence: Synthetic oligonucleotide
  Target: DMPK; (+) strand; PAM type: YTN; PAM sequence: CTC
actgcaagctccgcctcccg

SEQ ID NO: 19098 - DNA, 20 bp, Artificial Sequence
  Description of Artificial Sequence: Synthetic oligonucleotide
  Target: DMPK; (+) strand; PAM type: YTN; PAM sequence: CTG
caagctccgcctcccgggtt

SEQ ID NO: 19099 - DNA, 20 bp, Artificial Sequence
  Description of Artificial Sequence: Synthetic oligonucleotide
  Target: DMPK; (+) strand; PAM type: YTN; PAM sequence: CTC
cgcctcccgggttcatgcca

SEQ ID NO: 19100 - DNA, 20 bp, Artificial Sequence
  Description of Artificial Sequence: Synthetic oligonucleotide
  Target: DMPK; (+) strand; PAM type: YTN; PAM sequence: CTC
ccgggttcatgccattctcc

SEQ ID NO: 19101 - DNA, 20 bp, Artificial Sequence
  Description of Artificial Sequence: Synthetic oligonucleotide
  Target: DMPK; (+) strand; PAM type: YTN; PAM sequence: TTC
atgccattctcctgcctcgc

SEQ ID NO: 19102 - DNA, 20 bp, Artificial Sequence
  Description of Artificial Sequence: Synthetic oligonucleotide
  Target: DMPK; (+) strand; PAM type: YTN; PAM sequence: TTC
tcctgcctcgcctcccaagt

SEQ ID NO: 19103 - DNA, 20 bp, Artificial Sequence
  Description of Artificial Sequence: Synthetic oligonucleotide
  Target: DMPK; (+) strand; PAM type: YTN; PAM sequence: CTC
ctgcctcgcctcccaagtag

SEQ ID NO: 19104 - DNA, 20 bp, Artificial Sequence
  Description of Artificial Sequence: Synthetic oligonucleotide
  Target: DMPK; (+) strand; PAM type: YTN; PAM sequence: CTG
cctcgcctcccaagtagctg

SEQ ID NO: 19105 - DNA, 20 bp, Artificial Sequence
  Description of Artificial Sequence: Synthetic oligonucleotide
  Target: DMPK; (+) strand; PAM type: YTN; PAM sequence: CTC
gcctcccaagtagctgggac

SEQ ID NO: 19106 - DNA, 20 bp, Artificial Sequence
  Description of Artificial Sequence: Synthetic oligonucleotide
  Target: DMPK; (+) strand; PAM type: YTN; PAM sequence: CTC
ccaagtagctgggaccgcaa

SEQ ID NO: 19107 - DNA, 20 bp, Artificial Sequence
  Description of Artificial Sequence: Synthetic oligonucleotide
  Target: DMPK; (+) strand; PAM type: YTN; PAM sequence: CTG
ggaccgcaagcgcccgccac

SEQ ID NO: 19108 - DNA, 20 bp, Artificial Sequence
  Description of Artificial Sequence: Synthetic oligonucleotide
  Target: DMPK; (+) strand; PAM type: YTN; PAM sequence: CTA
atttttttgtatttttagta

SEQ ID NO: 19109 - DNA, 20 bp, Artificial Sequence
  Description of Artificial Sequence: Synthetic oligonucleotide
  Target: DMPK; (+) strand; PAM type: YTN; PAM sequence: TTT
ttttgtatttttagtagaga

SEQ ID NO: 19110 - DNA, 20 bp, Artificial Sequence
  Description of Artificial Sequence: Synthetic oligonucleotide
  Target: DMPK; (+) strand; PAM type: YTN; PAM sequence: TTT
tttgtatttttagtagagac

SEQ ID NO: 19111 - DNA, 20 bp, Artificial Sequence
  Description of Artificial Sequence: Synthetic oligonucleotide
  Target: DMPK; (+) strand; PAM type: YTN; PAM sequence: TTT
ttgtatttttagtagagacg

SEQ ID NO: 19112 - DNA, 20 bp, Artificial Sequence
  Description of Artificial Sequence: Synthetic oligonucleotide
  Target: DMPK; (+) strand; PAM type: YTN; PAM sequence: TTT
tgtatttttagtagagacgg

SEQ ID NO: 19113 - DNA, 20 bp, Artificial Sequence
  Description of Artificial Sequence: Synthetic oligonucleotide
  Target: DMPK; (+) strand; PAM type: YTN; PAM sequence: TTT
gtatttttagtagagacggg

SEQ ID NO: 19114 - DNA, 20 bp, Artificial Sequence
  Description of Artificial Sequence: Synthetic oligonucleotide
  Target: DMPK; (+) strand; PAM type: YTN; PAM sequence: TTG
tatttttagtagagacgggg

SEQ ID NO: 19115 - DNA, 20 bp, Artificial Sequence
  Description of Artificial Sequence: Synthetic oligonucleotide
  Target: DMPK; (+) strand; PAM type: YTN; PAM sequence: TTT
ttagtagagacggggtttca

SEQ ID NO: 19116 - DNA, 20 bp, Artificial Sequence
  Description of Artificial Sequence: Synthetic oligonucleotide
  Target: DMPK; (+) strand; PAM type: YTN; PAM sequence: TTT
tagtagagacggggtttcac

SEQ ID NO: 19117 - DNA, 20 bp, Artificial Sequence
  Description of Artificial Sequence: Synthetic oligonucleotide
  Target: DMPK; (+) strand; PAM type: YTN; PAM sequence: TTT
agtagagacggggtttcacc

SEQ ID NO: 19118 - DNA, 20 bp, Artificial Sequence
  Description of Artificial Sequence: Synthetic oligonucleotide
  Target: DMPK; (+) strand; PAM type: YTN; PAM sequence: TTA
gtagagacggggtttcaccg

SEQ ID NO: 19119 - DNA, 20 bp, Artificial Sequence
  Description of Artificial Sequence: Synthetic oligonucleotide
  Target: DMPK; (+) strand; PAM type: YTN; PAM sequence: TTT
caccgtgttagccaggatgg

SEQ ID NO: 19120 - DNA, 20 bp, Artificial Sequence
  Description of Artificial Sequence: Synthetic oligonucleotide
  Target: DMPK; (+) strand; PAM type: YTN; PAM sequence: TTC
accgtgttagccaggatggt

SEQ ID NO: 19121 - DNA, 20 bp, Artificial Sequence
  Description of Artificial Sequence: Synthetic oligonucleotide
  Target: DMPK; (+) strand; PAM type: YTN; PAM sequence: TTA
gccaggatggtctcgatctc

SEQ ID NO: 19122 - DNA, 20 bp, Artificial Sequence
  Description of Artificial Sequence: Synthetic oligonucleotide
  Target: DMPK; (+) strand; PAM type: YTN; PAM sequence: CTC
gatctcctgacctcatgatc

SEQ ID NO: 19123 - DNA, 20 bp, Artificial Sequence
  Description of Artificial Sequence: Synthetic oligonucleotide
  Target: DMPK; (+) strand; PAM type: YTN; PAM sequence: CTC
ctgacctcatgatccacctg

SEQ ID NO: 19124 - DNA, 20 bp, Artificial Sequence
  Description of Artificial Sequence: Synthetic oligonucleotide
  Target: DMPK; (+) strand; PAM type: YTN; PAM sequence: CTG
acctcatgatccacctgcct

SEQ ID NO: 19125 - DNA, 20 bp, Artificial Sequence
  Description of Artificial Sequence: Synthetic oligonucleotide
  Target: DMPK; (+) strand; PAM type: YTN; PAM sequence: CTC
atgatccacctgccttggcc

SEQ ID NO: 19126 - DNA, 20 bp, Artificial Sequence
  Description of Artificial Sequence: Synthetic oligonucleotide
  Target: DMPK; (+) strand; PAM type: YTN; PAM sequence: CTG
ccttggcctcccaaagtgct

SEQ ID NO: 19127 - DNA, 20 bp, Artificial Sequence
  Description of Artificial Sequence: Synthetic oligonucleotide
  Target: DMPK; (+) strand; PAM type: YTN; PAM sequence: CTT
ggcctcccaaagtgctagga

SEQ ID NO: 19128 - DNA, 20 bp, Artificial Sequence
  Description of Artificial Sequence: Synthetic oligonucleotide
  Target: DMPK; (+) strand; PAM type: YTN; PAM sequence: TTG
gcctcccaaagtgctaggat

SEQ ID NO: 19129 - DNA, 20 bp, Artificial Sequence
  Description of Artificial Sequence: Synthetic oligonucleotide
  Target: DMPK; (+) strand; PAM type: YTN; PAM sequence: CTC
ccaaagtgctaggattacag

SEQ ID NO: 19130 - DNA, 20 bp, Artificial Sequence
  Description of Artificial Sequence: Synthetic oligonucleotide
  Target: DMPK; (+) strand; PAM type: YTN; PAM sequence: CTA
ggattacaggcgtgagccac

SEQ ID NO: 19131 - DNA, 20 bp, Artificial Sequence
  Description of Artificial Sequence: Synthetic oligonucleotide
  Target: DMPK; (+) strand; PAM type: YTN; PAM sequence: TTA
caggcgtgagccaccgcggc

SEQ ID NO: 19132 - DNA, 20 bp, Artificial Sequence
  Description of Artificial Sequence: Synthetic oligonucleotide
  Target: DMPK; (+) strand; PAM type: YTN; PAM sequence: CTA
aattaatacttttaaatggc

SEQ ID NO: 19133 - DNA, 20 bp, Artificial Sequence
  Description of Artificial Sequence: Synthetic oligonucleotide
  Target: DMPK; (+) strand; PAM type: YTN; PAM sequence: TTA
atacttttaaatggccttat

SEQ ID NO: 19134 - DNA, 20 bp, Artificial Sequence
  Description of Artificial Sequence: Synthetic oligonucleotide
  Target: DMPK; (+) strand; PAM type: YTN; PAM sequence: CTT
ttaaatggccttattgttat

SEQ ID NO: 19135 - DNA, 20 bp, Artificial Sequence
  Description of Artificial Sequence: Synthetic oligonucleotide
  Target: DMPK; (+) strand; PAM type: YTN; PAM sequence: TTT
taaatggccttattgttata

SEQ ID NO: 19136 - DNA, 20 bp, Artificial Sequence
  Description of Artificial Sequence: Synthetic oligonucleotide
  Target: DMPK; (+) strand; PAM type: YTN; PAM sequence: TTT
aaatggccttattgttatat

SEQ ID NO: 19137 - DNA, 20 bp, Artificial Sequence
  Description of Artificial Sequence: Synthetic oligonucleotide
  Target: DMPK; (+) strand; PAM type: YTN; PAM sequence: TTA
aatggccttattgttatatg

SEQ ID NO: 19138 - DNA, 20 bp, Artificial Sequence
  Description of Artificial Sequence: Synthetic oligonucleotide
  Target: DMPK; (+) strand; PAM type: YTN; PAM sequence: CTT
attgttatatggctgattca

SEQ ID NO: 19139 - DNA, 20 bp, Artificial Sequence
  Description of Artificial Sequence: Synthetic oligonucleotide
  Target: DMPK; (+) strand; PAM type: YTN; PAM sequence: TTA
ttgttatatggctgattcaa

SEQ ID NO: 19140 - DNA, 20 bp, Artificial Sequence
  Description of Artificial Sequence: Synthetic oligonucleotide
  Target: DMPK; (+) strand; PAM type: YTN; PAM sequence: TTG
ttatatggctgattcaaaga

SEQ ID NO: 19141 - DNA, 20 bp, Artificial Sequence
  Description of Artificial Sequence: Synthetic oligonucleotide
  Target: DMPK; (+) strand; PAM type: YTN; PAM sequence: TTA
tatggctgattcaaagaatt

SEQ ID NO: 19142 - DNA, 20 bp, Artificial Sequence
  Description of Artificial Sequence: Synthetic oligonucleotide
  Target: DMPK; (+) strand; PAM type: YTN; PAM sequence: CTG
attcaaagaatttgcattct

SEQ ID NO: 19143 - DNA, 20 bp, Artificial Sequence
  Description of Artificial Sequence: Synthetic oligonucleotide
  Target: DMPK; (+) strand; PAM type: YTN; PAM sequence: TTC
aaagaatttgcattctttta

SEQ ID NO: 19144 - DNA, 20 bp, Artificial Sequence
  Description of Artificial Sequence: Synthetic oligonucleotide
  Target: DMPK; (+) strand; PAM type: YTN; PAM sequence: TTT
gcattcttttacaactgatt

SEQ ID NO: 19145 - DNA, 20 bp, Artificial Sequence
  Description of Artificial Sequence: Synthetic oligonucleotide
  Target: DMPK; (+) strand; PAM type: YTN; PAM sequence: TTG
cattcttttacaactgattg

SEQ ID NO: 19146 - DNA, 20 bp, Artificial Sequence
  Description of Artificial Sequence: Synthetic oligonucleotide
  Target: DMPK; (+) strand; PAM type: YTN; PAM sequence: TTC
ttttacaactgattgtaaaa

SEQ ID NO: 19147 - DNA, 20 bp, Artificial Sequence
  Description of Artificial Sequence: Synthetic oligonucleotide
  Target: DMPK; (+) strand; PAM type: YTN; PAM sequence: CTT
ttacaactgattgtaaaagt

SEQ ID NO: 19148 - DNA, 20 bp, Artificial Sequence
  Description of Artificial Sequence: Synthetic oligonucleotide
  Target: DMPK; (+) strand; PAM type: YTN; PAM sequence: TTT
tacaactgattgtaaaagtc

SEQ ID NO: 19149 - DNA, 20 bp, Artificial Sequence
  Description of Artificial Sequence: Synthetic oligonucleotide
  Target: DMPK; (+) strand; PAM type: YTN; PAM sequence: TTT
acaactgattgtaaaagtct

SEQ ID NO: 19150 - DNA, 20 bp, Artificial Sequence
  Description of Artificial Sequence: Synthetic oligonucleotide
  Target: DMPK; (+) strand; PAM type: YTN; PAM sequence: TTA
caactgattgtaaaagtcta

SEQ ID NO: 19151 - DNA, 20 bp, Artificial Sequence
  Description of Artificial Sequence: Synthetic oligonucleotide
  Target: DMPK; (+) strand; PAM type: YTN; PAM sequence: CTG
attgtaaaagtctaaacttc

SEQ ID NO: 19152 - DNA, 20 bp, Artificial Sequence
  Description of Artificial Sequence: Synthetic oligonucleotide
  Target: DMPK; (+) strand; PAM type: YTN; PAM sequence: TTG
taaaagtctaaacttcatat

SEQ ID NO: 19153 - DNA, 20 bp, Artificial Sequence
  Description of Artificial Sequence: Synthetic oligonucleotide
  Target: DMPK; (+) strand; PAM type: YTN; PAM sequence: CTA
aacttcatattttccaagtt

SEQ ID NO: 19154 - DNA, 20 bp, Artificial Sequence
  Description of Artificial Sequence: Synthetic oligonucleotide
  Target: DMPK; (+) strand; PAM type: YTN; PAM sequence: CTT
catattttccaagttctgaa

SEQ ID NO: 19155 - DNA, 20 bp, Artificial Sequence
  Description of Artificial Sequence: Synthetic oligonucleotide
  Target: DMPK; (+) strand; PAM type: YTN; PAM sequence: TTC
atattttccaagttctgaag

SEQ ID NO: 19156 - DNA, 20 bp, Artificial Sequence
  Description of Artificial Sequence: Synthetic oligonucleotide
  Target: DMPK; (+) strand; PAM type: YTN; PAM sequence: TTT
tccaagttctgaagtcctgt

SEQ ID NO: 19157 - DNA, 20 bp, Artificial Sequence
  Description of Artificial Sequence: Synthetic oligonucleotide
  Target: DMPK; (+) strand; PAM type: YTN; PAM sequence: TTT
ccaagttctgaagtcctgtg

SEQ ID NO: 19158 - DNA, 20 bp, Artificial Sequence
  Description of Artificial Sequence: Synthetic oligonucleotide
  Target: DMPK; (+) strand; PAM type: YTN; PAM sequence: TTC
caagttctgaagtcctgtgg

SEQ ID NO: 19159 - DNA, 20 bp, Artificial Sequence
  Description of Artificial Sequence: Synthetic oligonucleotide
  Target: DMPK; (+) strand; PAM type: YTN; PAM sequence: TTC
tgaagtcctgtggctctgtg

SEQ ID NO: 19160 - DNA, 20 bp, Artificial Sequence
  Description of Artificial Sequence: Synthetic oligonucleotide
  Target: DMPK; (+) strand; PAM type: YTN; PAM sequence: CTG
aagtcctgtggctctgtgta

SEQ ID NO: 19161 - DNA, 20 bp, Artificial Sequence
  Description of Artificial Sequence: Synthetic oligonucleotide
  Target: DMPK; (+) strand; PAM type: YTN; PAM sequence: CTG
tggctctgtgtactacagac

SEQ ID NO: 19162 - DNA, 20 bp, Artificial Sequence
  Description of Artificial Sequence: Synthetic oligonucleotide
  Target: DMPK; (+) strand; PAM type: YTN; PAM sequence: CTC
tgtgtactacagacgtaaaa

SEQ ID NO: 19163 - DNA, 20 bp, Artificial Sequence
  Description of Artificial Sequence: Synthetic oligonucleotide
  Target: DMPK; (+) strand; PAM type: YTN; PAM sequence: CTG
tgtactacagacgtaaaagt

SEQ ID NO: 19164 - DNA, 20 bp, Artificial Sequence
  Description of Artificial Sequence: Synthetic oligonucleotide
  Target: DMPK; (+) strand; PAM type: YTN; PAM sequence: CTA
cagacgtaaaagttaatggt

SEQ ID NO: 19165 - DNA, 20 bp, Artificial Sequence
  Description of Artificial Sequence: Synthetic oligonucleotide
  Target: DMPK; (+) strand; PAM type: YTN; PAM sequence: TTA
atggttacaagattctggga

SEQ ID NO: 19166 - DNA, 20 bp, Artificial Sequence
  Description of Artificial Sequence: Synthetic oligonucleotide
  Target: DMPK; (+) strand; PAM type: YTN; PAM sequence: TTA
caagattctgggaagcccag

SEQ ID NO: 19167 - DNA, 20 bp, Artificial Sequence
  Description of Artificial Sequence: Synthetic oligonucleotide
  Target: DMPK; (+) strand; PAM type: YTN; PAM sequence: TTC
tgggaagcccagtctgtgac

SEQ ID NO: 19168 - DNA, 20 bp, Artificial Sequence
  Description of Artificial Sequence: Synthetic oligonucleotide
  Target: DMPK; (+) strand; PAM type: YTN; PAM sequence: CTG
ggaagcccagtctgtgactc

SEQ ID NO: 19169 - DNA, 20 bp, Artificial Sequence
  Description of Artificial Sequence: Synthetic oligonucleotide
  Target: DMPK; (+) strand; PAM type: YTN; PAM sequence: CTG
tgactctgaggttttaaaat

SEQ ID NO: 19170 - DNA, 20 bp, Artificial Sequence
  Description of Artificial Sequence: Synthetic oligonucleotide
  Target: DMPK; (+) strand; PAM type: YTN; PAM sequence: CTC
tgaggttttaaaattcaatc

SEQ ID NO: 19171 - DNA, 20 bp, Artificial Sequence
  Description of Artificial Sequence: Synthetic oligonucleotide
  Target: DMPK; (+) strand; PAM type: YTN; PAM sequence: CTG
aggttttaaaattcaatcta

SEQ ID NO: 19172 - DNA, 20 bp, Artificial Sequence
  Description of Artificial Sequence: Synthetic oligonucleotide
  Target: DMPK; (+) strand; PAM type: YTN; PAM sequence: TTT
taaaattcaatctaacattt

SEQ ID NO: 19173 - DNA, 20 bp, Artificial Sequence
  Description of Artificial Sequence: Synthetic oligonucleotide
  Target: DMPK; (+) strand; PAM type: YTN; PAM sequence: TTT
aaaattcaatctaacatttt

SEQ ID NO: 19174 - DNA, 20 bp, Artificial Sequence
  Description of Artificial Sequence: Synthetic oligonucleotide
  Target: DMPK; (+) strand; PAM type: YTN; PAM sequence: TTA
aaattcaatctaacattttg

SEQ ID NO: 19175 - DNA, 20 bp, Artificial Sequence
  Description of Artificial Sequence: Synthetic oligonucleotide
  Target: DMPK; (+) strand; PAM type: YTN; PAM sequence: TTC
aatctaacattttgaagtac

SEQ ID NO: 19176 - DNA, 20 bp, Artificial Sequence
  Description of Artificial Sequence: Synthetic oligonucleotide
  Target: DMPK; (+) strand; PAM type: YTN; PAM sequence: CTA
acattttgaagtacatagat

SEQ ID NO: 19177 - DNA, 20 bp, Artificial Sequence
  Description of Artificial Sequence: Synthetic oligonucleotide
  Target: DMPK; (+) strand; PAM type: YTN; PAM sequence: TTT
tgaagtacatagatctgaaa

SEQ ID NO: 19178 - DNA, 20 bp, Artificial Sequence
  Description of Artificial Sequence: Synthetic oligonucleotide
  Target: DMPK; (+) strand; PAM type: YTN; PAM sequence: TTT
gaagtacatagatctgaaaa

SEQ ID NO: 19179 - DNA, 20 bp, Artificial Sequence
  Description of Artificial Sequence: Synthetic oligonucleotide
  Target: DMPK; (+) strand; PAM type: YTN; PAM sequence: TTG
aagtacatagatctgaaaat

SEQ ID NO: 19180 - DNA, 20 bp, Artificial Sequence
  Description of Artificial Sequence: Synthetic oligonucleotide
  Target: DMPK; (+) strand; PAM type: YTN; PAM sequence: CTG
aaaatttaaggtcctccaac

SEQ ID NO: 19181 - DNA, 20 bp, Artificial Sequence
  Description of Artificial Sequence: Synthetic oligonucleotide
  Target: DMPK; (+) strand; PAM type: YTN; PAM sequence: TTT
aaggtcctccaactctggcc

SEQ ID NO: 19182 - DNA, 20 bp, Artificial Sequence
  Description of Artificial Sequence: Synthetic oligonucleotide
  Target: DMPK; (+) strand; PAM type: YTN; PAM sequence: TTA
aggtcctccaactctggcct

SEQ ID NO: 19183 - DNA, 20 bp, Artificial Sequence
  Description of Artificial Sequence: Synthetic oligonucleotide
  Target: DMPK; (+) strand; PAM type: YTN; PAM sequence: CTC
caactctggcctcttaggag

SEQ ID NO: 19184 - DNA, 20 bp, Artificial Sequence
  Description of Artificial Sequence: Synthetic oligonucleotide
  Target: DMPK; (+) strand; PAM type: YTN; PAM sequence: CTC
tggcctcttaggagtctttg

SEQ ID NO: 19185 - DNA, 20 bp, Artificial Sequence
  Description of Artificial Sequence: Synthetic oligonucleotide
  Target: DMPK; (+) strand; PAM type: YTN; PAM sequence: CTG
gcctcttaggagtctttggg

SEQ ID NO: 19186 - DNA, 20 bp, Artificial Sequence
  Description of Artificial Sequence: Synthetic oligonucleotide
  Target: DMPK; (+) strand; PAM type: YTN; PAM sequence: CTC
ttaggagtctttgggcccaa

SEQ ID NO: 19187 - DNA, 20 bp, Artificial Sequence
  Description of Artificial Sequence: Synthetic oligonucleotide
  Target: DMPK; (+) strand; PAM type: YTN; PAM sequence: CTT
aggagtctttgggcccaaaa

SEQ ID NO: 19188 - DNA, 20 bp, Artificial Sequence
  Description of Artificial Sequence: Synthetic oligonucleotide
  Target: DMPK; (+) strand; PAM type: YTN; PAM sequence: TTA
ggagtctttgggcccaaaac

SEQ ID NO: 19189 - DNA, 20 bp, Artificial Sequence
  Description of Artificial Sequence: Synthetic oligonucleotide
  Target: DMPK; (+) strand; PAM type: YTN; PAM sequence: CTT
tgggcccaaaacagtaaggt

SEQ ID NO: 19190 - DNA, 20 bp, Artificial Sequence
  Description of Artificial Sequence: Synthetic oligonucleotide
  Target: DMPK; (+) strand; PAM type: YTN; PAM sequence: TTT
gggcccaaaacagtaaggtt

SEQ ID NO: 19191 - DNA, 20 bp, Artificial Sequence
  Description of Artificial Sequence: Synthetic oligonucleotide
  Target: DMPK; (+) strand; PAM type: YTN; PAM sequence: TTG
ggcccaaaacagtaaggttc

SEQ ID NO: 19192 - DNA, 20 bp, Artificial Sequence
  Description of Artificial Sequence: Synthetic oligonucleotide
  Target: DMPK; (+) strand; PAM type: YTN; PAM sequence: TTC
caagactgatcctgcaactc

SEQ ID NO: 19193 - DNA, 20 bp, Artificial Sequence
  Description of Artificial Sequence: Synthetic oligonucleotide
  Target: DMPK; (+) strand; PAM type: YTN; PAM sequence: CTG
atcctgcaactccattggct

SEQ ID NO: 19194 - DNA, 20 bp, Artificial Sequence
  Description of Artificial Sequence: Synthetic oligonucleotide
  Target: DMPK; (+) strand; PAM type: YTN; PAM sequence: CTG
caactccattggctgccaag

SEQ ID NO: 19195 - DNA, 20 bp, Artificial Sequence
  Description of Artificial Sequence: Synthetic oligonucleotide
  Target: DMPK; (+) strand; PAM type: YTN; PAM sequence: CTC
cattggctgccaaggagcag

SEQ ID NO: 19196 - DNA, 20 bp, Artificial Sequence
  Description of Artificial Sequence: Synthetic oligonucleotide
  Target: DMPK; (+) strand; PAM type: YTN; PAM sequence: TTG
gctgccaaggagcaggaccc

SEQ ID NO: 19197 - DNA, 20 bp, Artificial Sequence
  Description of Artificial Sequence: Synthetic oligonucleotide
  Target: DMPK; (+) strand; PAM type: YTN; PAM sequence: CTG
ccaaggagcaggacccagga

SEQ ID NO: 19198 - DNA, 20 bp, Artificial Sequence
  Description of Artificial Sequence: Synthetic oligonucleotide
  Target: DMPK; (+) strand; PAM type: YTN; PAM sequence: CTC
aagcagcctcgtggcccctg

SEQ ID NO: 19199 - DNA, 20 bp, Artificial Sequence
  Description of Artificial Sequence: Synthetic oligonucleotide
  Target: DMPK; (+) strand; PAM type: YTN; PAM sequence: CTC
gtggcccctggaggccgtcc

SEQ ID NO: 19200 - DNA, 20 bp, Artificial Sequence
  Description of Artificial Sequence: Synthetic oligonucleotide
  Target: DMPK; (+) strand; PAM type: YTN; PAM sequence: CTG
gaggccgtccagggcagtgc

SEQ ID NO: 19201 - DNA, 20 bp, Artificial Sequence
  Description of Artificial Sequence: Synthetic oligonucleotide
  Target: DMPK; (+) strand; PAM type: YTN; PAM sequence: CTT
acctgagggccatgcaggag

SEQ ID NO: 19202 - DNA, 20 bp, Artificial Sequence
  Description of Artificial Sequence: Synthetic oligonucleotide
  Target: DMPK; (+) strand; PAM type: YTN; PAM sequence: TTA
cctgagggccatgcaggagt

SEQ ID NO: 19203 - DNA, 20 bp, Artificial Sequence
  Description of Artificial Sequence: Synthetic oligonucleotide
  Target: DMPK; (+) strand; PAM type: YTN; PAM sequence: CTG
agggccatgcaggagtagga

SEQ ID NO: 19204 - DNA, 20 bp, Artificial Sequence
  Description of Artificial Sequence: Synthetic oligonucleotide
  Target: DMPK; (+) strand; PAM type: YTN; PAM sequence: CTA
gcggcgcaccttcccgaatg

SEQ ID NO: 19205 - DNA, 20 bp, Artificial Sequence
  Description of Artificial Sequence: Synthetic oligonucleotide
  Target: DMPK; (+) strand; PAM type: YTN; PAM sequence: CTT
cccgaatgtccgacagtgtc

SEQ ID NO: 19206 - DNA, 20 bp, Artificial Sequence
  Description of Artificial Sequence: Synthetic oligonucleotide
  Target: DMPK; (+) strand; PAM type: YTN; PAM sequence: TTC
ccgaatgtccgacagtgtct

SEQ ID NO: 19207 - DNA, 20 bp, Artificial Sequence
  Description of Artificial Sequence: Synthetic oligonucleotide
  Target: DMPK; (+) strand; PAM type: YTN; PAM sequence: CTC
ctgcgcaagacacacagatg

SEQ ID NO: 19208 - DNA, 20 bp, Artificial Sequence
  Description of Artificial Sequence: Synthetic oligonucleotide
  Target: DMPK; (+) strand; PAM type: YTN; PAM sequence: CTG
cgcaagacacacagatgtga

SEQ ID NO: 19209 - DNA, 20 bp, Artificial Sequence
  Description of Artificial Sequence: Synthetic oligonucleotide
  Target: DMPK; (+) strand; PAM type: YTN; PAM sequence: CTC
actgctttttgatcttggct

SEQ ID NO: 19210 - DNA, 20 bp, Artificial Sequence
  Description of Artificial Sequence: Synthetic oligonucleotide
  Target: DMPK; (+) strand; PAM type: YTN; PAM sequence: CTG
ctttttgatcttggcttaca

SEQ ID NO: 19211 - DNA, 20 bp, Artificial Sequence
  Description of Artificial Sequence: Synthetic oligonucleotide
  Target: DMPK; (+) strand; PAM type: YTN; PAM sequence: CTT
tttgatcttggcttacatgt

SEQ ID NO: 19212 - DNA, 20 bp, Artificial Sequence
  Description of Artificial Sequence: Synthetic oligonucleotide
  Target: DMPK; (+) strand; PAM type: YTN; PAM sequence: TTT
ttgatcttggcttacatgtt

SEQ ID NO: 19213 - DNA, 20 bp, Artificial Sequence
  Description of Artificial Sequence: Synthetic oligonucleotide
  Target: DMPK; (+) strand; PAM type: YTN; PAM sequence: TTT
tgatcttggcttacatgttc

SEQ ID NO: 19214 - DNA, 20 bp, Artificial Sequence
  Description of Artificial Sequence: Synthetic oligonucleotide
  Target: DMPK; (+) strand; PAM type: YTN; PAM sequence: TTT
gatcttggcttacatgttcc

SEQ ID NO: 19215 - DNA, 20 bp, Artificial Sequence
  Description of Artificial Sequence: Synthetic oligonucleotide
  Target: DMPK; (+) strand; PAM type: YTN; PAM sequence: TTG
atcttggcttacatgttccc

SEQ ID NO: 19216 - DNA, 20 bp, Artificial Sequence
  Description of Artificial Sequence: Synthetic oligonucleotide
  Target: DMPK; (+) strand; PAM type: YTN; PAM sequence: CTT
ggcttacatgttccccccaa

SEQ ID NO: 19217 - DNA, 20 bp, Artificial Sequence
  Description of Artificial Sequence: Synthetic oligonucleotide
  Target: DMPK; (+) strand; PAM type: YTN; PAM sequence: TTG
gcttacatgttccccccaaa

SEQ ID NO: 19218 - DNA, 20 bp, Artificial Sequence
  Description of Artificial Sequence: Synthetic oligonucleotide
  Target: DMPK; (+) strand; PAM type: YTN; PAM sequence: CTT
acatgttccccccaaaccag

SEQ ID NO: 19219 - DNA, 20 bp, Artificial Sequence
  Description of Artificial Sequence: Synthetic oligonucleotide
  Target: DMPK; (+) strand; PAM type: YTN; PAM sequence: TTA
catgttccccccaaaccagc

SEQ ID NO: 19220 - DNA, 20 bp, Artificial Sequence
  Description of Artificial Sequence: Synthetic oligonucleotide
  Target: DMPK; (+) strand; PAM type: YTN; PAM sequence: TTC
cccccaaaccagccccaact

SEQ ID NO: 19221 - DNA, 20 bp, Artificial Sequence
  Description of Artificial Sequence: Synthetic oligonucleotide
  Target: DMPK; (+) strand; PAM type: YTN; PAM sequence: CTC
agggcttatctaaagtggcc

SEQ ID NO: 19222 - DNA, 20 bp, Artificial Sequence
  Description of Artificial Sequence: Synthetic oligonucleotide
  Target: DMPK; (+) strand; PAM type: YTN; PAM sequence: CTT
atctaaagtggcccctccag

SEQ ID NO: 19223 - DNA, 20 bp, Artificial Sequence
  Description of Artificial Sequence: Synthetic oligonucleotide
  Target: DMPK; (+) strand; PAM type: YTN; PAM sequence: TTA
tctaaagtggcccctccagc

SEQ ID NO: 19224 - DNA, 20 bp, Artificial Sequence
  Description of Artificial Sequence: Synthetic oligonucleotide
  Target: DMPK; (+) strand; PAM type: YTN; PAM sequence: CTA
aagtggcccctccagcattt

SEQ ID NO: 19225 - DNA, 20 bp, Artificial Sequence
  Description of Artificial Sequence: Synthetic oligonucleotide
  Target: DMPK; (+) strand; PAM type: YTN; PAM sequence: CTC
cagcattttttcttttttct

SEQ ID NO: 19226 - DNA, 20 bp, Artificial Sequence
  Description of Artificial Sequence: Synthetic oligonucleotide
  Target: DMPK; (+) strand; PAM type: YTN; PAM sequence: TTT
tttcttttttctttttcttt

SEQ ID NO: 19227 - DNA, 20 bp, Artificial Sequence
  Description of Artificial Sequence: Synthetic oligonucleotide
  Target: DMPK; (+) strand; PAM type: YTN; PAM sequence: TTT
ttcttttttctttttctttg

SEQ ID NO: 19228 - DNA, 20 bp, Artificial Sequence
  Description of Artificial Sequence: Synthetic oligonucleotide
  Target: DMPK; (+) strand; PAM type: YTN; PAM sequence: TTT
tcttttttctttttctttga

SEQ ID NO: 19229 - DNA, 20 bp, Artificial Sequence
  Description of Artificial Sequence: Synthetic oligonucleotide
  Target: DMPK; (+) strand; PAM type: YTN; PAM sequence: TTT
cttttttctttttctttgat

SEQ ID NO: 19230 - DNA, 20 bp, Artificial Sequence
  Description of Artificial Sequence: Synthetic oligonucleotide
  Target: DMPK; (+) strand; PAM type: YTN; PAM sequence: TTC
ttttttctttttctttgata

SEQ ID NO: 19231 - DNA, 20 bp, Artificial Sequence
  Description of Artificial Sequence: Synthetic oligonucleotide
  Target: DMPK; (+) strand; PAM type: YTN; PAM sequence: CTT
ttttctttttctttgatacg

SEQ ID NO: 19232 - DNA, 20 bp, Artificial Sequence
  Description of Artificial Sequence: Synthetic oligonucleotide
  Target: DMPK; (+) strand; PAM type: YTN; PAM sequence: TTT
tttctttttctttgatacgg

SEQ ID NO: 19233 - DNA, 20 bp, Artificial Sequence
  Description of Artificial Sequence: Synthetic oligonucleotide
  Target: DMPK; (+) strand; PAM type: YTN; PAM sequence: TTT
ttctttttctttgatacgga

SEQ ID NO: 19234 - DNA, 20 bp, Artificial Sequence
  Description of Artificial Sequence: Synthetic oligonucleotide
  Target: DMPK; (+) strand; PAM type: YTN; PAM sequence: TTT
tctttttctttgatacggag

SEQ ID NO: 19235 - DNA, 20 bp, Artificial Sequence
  Description of Artificial Sequence: Synthetic oligonucleotide
  Target: DMPK; (+) strand; PAM type: YTN; PAM sequence: TTT
ctttttctttgatacggagt

SEQ ID NO: 19236 - DNA, 20 bp, Artificial Sequence
  Description of Artificial Sequence: Synthetic oligonucleotide
  Target: DMPK; (+) strand; PAM type: YTN; PAM sequence: TTC
tttttctttgatacggagtc

SEQ ID NO: 19237 - DNA, 20 bp, Artificial Sequence
  Description of Artificial Sequence: Synthetic oligonucleotide
  Target: DMPK; (+) strand; PAM type: YTN; PAM sequence: CTT
tttctttgatacggagtctc

SEQ ID NO: 19238 - DNA, 20 bp, Artificial Sequence
  Description of Artificial Sequence: Synthetic oligonucleotide
  Target: DMPK; (+) strand; PAM type: YTN; PAM sequence: TTT
ttctttgatacggagtctcg

SEQ ID NO: 19239 - DNA, 20 bp, Artificial Sequence
  Description of Artificial Sequence: Synthetic oligonucleotide
  Target: DMPK; (+) strand; PAM type: YTN; PAM sequence: TTT
tctttgatacggagtctcgc

SEQ ID NO: 19240 - DNA, 20 bp, Artificial Sequence
  Description of Artificial Sequence: Synthetic oligonucleotide
  Target: DMPK; (+) strand; PAM type: YTN; PAM sequence: TTT
ctttgatacggagtctcgct

SEQ ID NO: 19241 - DNA, 20 bp, Artificial Sequence
  Description of Artificial Sequence: Synthetic oligonucleotide
  Target: DMPK; (+) strand; PAM type: YTN; PAM sequence: TTC
tttgatacggagtctcgctc

SEQ ID NO: 19242 - DNA, 20 bp, Artificial Sequence
  Description of Artificial Sequence: Synthetic oligonucleotide
  Target: DMPK; (+) strand; PAM type: YTN; PAM sequence: CTT
tgatacggagtctcgctctg

SEQ ID NO: 19243 - DNA, 20 bp, Artificial Sequence
  Description of Artificial Sequence: Synthetic oligonucleotide
  Target: DMPK; (+) strand; PAM type: YTN; PAM sequence: TTT
gatacggagtctcgctctgt

SEQ ID NO: 19244 - DNA, 20 bp, Artificial Sequence
  Description of Artificial Sequence: Synthetic oligonucleotide
  Target: DMPK; (+) strand; PAM type: YTN; PAM sequence: TTG
atacggagtctcgctctgtt

SEQ ID NO: 19245 - DNA, 20 bp, Artificial Sequence
  Description of Artificial Sequence: Synthetic oligonucleotide
  Target: DMPK; (+) strand; PAM type: YTN; PAM sequence: CTC
gctctgttacccaggctgga

SEQ ID NO: 19246 - DNA, 20 bp, Artificial Sequence
  Description of Artificial Sequence: Synthetic oligonucleotide
  Target: DMPK; (+) strand; PAM type: YTN; PAM sequence: CTC
tgttacccaggctggagtgc

SEQ ID NO: 19247 - DNA, 20 bp, Artificial Sequence
  Description of Artificial Sequence: Synthetic oligonucleotide
  Target: DMPK; (+) strand; PAM type: YTN; PAM sequence: CTG
ttacccaggctggagtgcag

SEQ ID NO: 19248 - DNA, 20 bp, Artificial Sequence
  Description of Artificial Sequence: Synthetic oligonucleotide
  Target: DMPK; (+) strand; PAM type: YTN; PAM sequence: TTA
cccaggctggagtgcagtgg

SEQ ID NO: 19249 - DNA, 20 bp, Artificial Sequence
  Description of Artificial Sequence: Synthetic oligonucleotide
  Target: DMPK; (+) strand; PAM type: YTN; PAM sequence: CTG
gagtgcagtggtgcaatctc

SEQ ID NO: 19250 - DNA, 20 bp, Artificial Sequence
  Description of Artificial Sequence: Synthetic oligonucleotide
  Target: DMPK; (+) strand; PAM type: YTN; PAM sequence: CTC
agctcactgcaacctccgcc

SEQ ID NO: 19251 - DNA, 20 bp, Artificial Sequence
  Description of Artificial Sequence: Synthetic oligonucleotide
  Target: DMPK; (+) strand; PAM type: YTN; PAM sequence: CTC
actgcaacctccgcctccca

SEQ ID NO: 19252 - DNA, 20 bp, Artificial Sequence
  Description of Artificial Sequence: Synthetic oligonucleotide
  Target: DMPK; (+) strand; PAM type: YTN; PAM sequence: CTG
caacctccgcctcccaggtt

SEQ ID NO: 19253 - DNA, 20 bp, Artificial Sequence
  Description of Artificial Sequence: Synthetic oligonucleotide
  Target: DMPK; (+) strand; PAM type: YTN; PAM sequence: CTC
cgcctcccaggttcaggcga

SEQ ID NO: 19254 - DNA, 20 bp, Artificial Sequence
  Description of Artificial Sequence: Synthetic oligonucleotide
  Target: DMPK; (+) strand; PAM type: YTN; PAM sequence: CTC
ccaggttcaggcgattctcc

SEQ ID NO: 19255 - DNA, 20 bp, Artificial Sequence
  Description of Artificial Sequence: Synthetic oligonucleotide
  Target: DMPK; (+) strand; PAM type: YTN; PAM sequence: TTC
aggcgattctcctgcctcag

SEQ ID NO: 19256 - DNA, 20 bp, Artificial Sequence
  Description of Artificial Sequence: Synthetic oligonucleotide
  Target: DMPK; (+) strand; PAM type: YTN; PAM sequence: TTC
tcctgcctcagcgtcctgag

SEQ ID NO: 19257 - DNA, 20 bp, Artificial Sequence
  Description of Artificial Sequence: Synthetic oligonucleotide
  Target: DMPK; (+) strand; PAM type: YTN; PAM sequence: CTC
ctgcctcagcgtcctgagta

SEQ ID NO: 19258 - DNA, 20 bp, Artificial Sequence
  Description of Artificial Sequence: Synthetic oligonucleotide
  Target: DMPK; (+) strand; PAM type: YTN; PAM sequence: CTG
cctcagcgtcctgagtagct

SEQ ID NO: 19259 - DNA, 20 bp, Artificial Sequence
  Description of Artificial Sequence: Synthetic oligonucleotide
  Target: DMPK; (+) strand; PAM type: YTN; PAM sequence: CTC
agcgtcctgagtagctgaga

SEQ ID NO: 19260 - DNA, 20 bp, Artificial Sequence
  Description of Artificial Sequence: Synthetic oligonucleotide
  Target: DMPK; (+) strand; PAM type: YTN; PAM sequence: CTG
agtagctgagattacaggcg

SEQ ID NO: 19261 - DNA, 20 bp, Artificial Sequence
  Description of Artificial Sequence: Synthetic oligonucleotide
  Target: DMPK; (+) strand; PAM type: YTN; PAM sequence: CTG
agattacaggcgccctctac

SEQ ID NO: 19262 - DNA, 20 bp, Artificial Sequence
  Description of Artificial Sequence: Synthetic oligonucleotide
  Target: DMPK; (+) strand; PAM type: YTN; PAM sequence: TTA
caggcgccctctaccacgcc

SEQ ID NO: 19263 - DNA, 20 bp, Artificial Sequence
  Description of Artificial Sequence: Synthetic oligonucleotide
  Target: DMPK; (+) strand; PAM type: YTN; PAM sequence: CTC
taccacgcctggctaatttt

SEQ ID NO: 19264 - DNA, 20 bp, Artificial Sequence
  Description of Artificial Sequence: Synthetic oligonucleotide
  Target: DMPK; (+) strand; PAM type: YTN; PAM sequence: CTA
ccacgcctggctaatttttt

SEQ ID NO: 19265 - DNA, 20 bp, Artificial Sequence
  Description of Artificial Sequence: Synthetic oligonucleotide
  Target: DMPK; (+) strand; PAM type: YTN; PAM sequence: CTG
gctaattttttatatttttg

SEQ ID NO: 19266 - DNA, 20 bp, Artificial Sequence
  Description of Artificial Sequence: Synthetic oligonucleotide
  Target: DMPK; (+) strand; PAM type: YTN; PAM sequence: CTA
attttttatatttttggtag

SEQ ID NO: 19267 - DNA, 20 bp, Artificial Sequence
  Description of Artificial Sequence: Synthetic oligonucleotide
  Target: DMPK; (+) strand; PAM type: YTN; PAM sequence: TTT
tttatatttttggtagagac

SEQ ID NO: 19268 - DNA, 20 bp, Artificial Sequence
  Description of Artificial Sequence: Synthetic oligonucleotide
  Target: DMPK; (+) strand; PAM type: YTN; PAM sequence: TTT
ttatatttttggtagagacg

SEQ ID NO: 19269 - DNA, 20 bp, Artificial Sequence
  Description of Artificial Sequence: Synthetic oligonucleotide
  Target: DMPK; (+) strand; PAM type: YTN; PAM sequence: TTT
tatatttttggtagagacgg

SEQ ID NO: 19270 - DNA, 20 bp, Artificial Sequence
  Description of Artificial Sequence: Synthetic oligonucleotide
  Target: DMPK; (+) strand; PAM type: YTN; PAM sequence: TTT
atatttttggtagagacggg

SEQ ID NO: 19271 - DNA, 20 bp, Artificial Sequence
  Description of Artificial Sequence: Synthetic oligonucleotide
  Target: DMPK; (+) strand; PAM type: YTN; PAM sequence: TTA
tatttttggtagagacgggg

SEQ ID NO: 19272 - DNA, 20 bp, Artificial Sequence
  Description of Artificial Sequence: Synthetic oligonucleotide
  Target: DMPK; (+) strand; PAM type: YTN; PAM sequence: TTT
ttggtagagacggggtttcg

SEQ ID NO: 19273 - DNA, 20 bp, Artificial Sequence
  Description of Artificial Sequence: Synthetic oligonucleotide
  Target: DMPK; (+) strand; PAM type: YTN; PAM sequence: TTT
tggtagagacggggtttcgc

SEQ ID NO: 19274 - DNA, 20 bp, Artificial Sequence
  Description of Artificial Sequence: Synthetic oligonucleotide
  Target: DMPK; (+) strand; PAM type: YTN; PAM sequence: TTT
ggtagagacggggtttcgcc

SEQ ID NO: 19275 - DNA, 20 bp, Artificial Sequence
  Description of Artificial Sequence: Synthetic oligonucleotide
  Target: DMPK; (+) strand; PAM type: YTN; PAM sequence: TTG
gtagagacggggtttcgcca

SEQ ID NO: 19276 - DNA, 20 bp, Artificial Sequence
  Description of Artificial Sequence: Synthetic oligonucleotide
  Target: DMPK; (+) strand; PAM type: YTN; PAM sequence: TTT
cgccacgctggccaggctgg

SEQ ID NO: 19277 - DNA, 20 bp, Artificial Sequence
  Description of Artificial Sequence: Synthetic oligonucleotide
  Target: DMPK; (+) strand; PAM type: YTN; PAM sequence: TTC
gccacgctggccaggctggt

SEQ ID NO: 19278 - DNA, 20 bp, Artificial Sequence
  Description of Artificial Sequence: Synthetic oligonucleotide
  Target: DMPK; (+) strand; PAM type: YTN; PAM sequence: CTG
gccaggctggtctccatctt

SEQ ID NO: 19279 - DNA, 20 bp, Artificial Sequence
  Description of Artificial Sequence: Synthetic oligonucleotide
  Target: DMPK; (+) strand; PAM type: YTN; PAM sequence: CTG
gtctccatcttctgacctca

SEQ ID NO: 19280 - DNA, 20 bp, Artificial Sequence
  Description of Artificial Sequence: Synthetic oligonucleotide
  Target: DMPK; (+) strand; PAM type: YTN; PAM sequence: CTC
catcttctgacctcaagtga

SEQ ID NO: 19281 - DNA, 20 bp, Artificial Sequence
  Description of Artificial Sequence: Synthetic oligonucleotide
  Target: DMPK; (+) strand; PAM type: YTN; PAM sequence: CTT
ctgacctcaagtgatccgcc

SEQ ID NO: 19282 - DNA, 20 bp, Artificial Sequence
  Description of Artificial Sequence: Synthetic oligonucleotide
  Target: DMPK; (+) strand; PAM type: YTN; PAM sequence: TTC
tgacctcaagtgatccgcct

SEQ ID NO: 19283 - DNA, 20 bp, Artificial Sequence
  Description of Artificial Sequence: Synthetic oligonucleotide
  Target: DMPK; (+) strand; PAM type: YTN; PAM sequence: CTG
acctcaagtgatccgcctac

SEQ ID NO: 19284 - DNA, 20 bp, Artificial Sequence
  Description of Artificial Sequence: Synthetic oligonucleotide
  Target: DMPK; (+) strand; PAM type: YTN; PAM sequence: CTC
aagtgatccgcctacctcag

SEQ ID NO: 19285 - DNA, 20 bp, Artificial Sequence
  Description of Artificial Sequence: Synthetic oligonucleotide
  Target: DMPK; (+) strand; PAM type: YTN; PAM sequence: CTA
cctcagctgttgtagtccca

SEQ ID NO: 19286 - DNA, 20 bp, Artificial Sequence
  Description of Artificial Sequence: Synthetic oligonucleotide
  Target: DMPK; (+) strand; PAM type: YTN; PAM sequence: CTC
agctgttgtagtcccaaact

SEQ ID NO: 19287 - DNA, 20 bp, Artificial Sequence
  Description of Artificial Sequence: Synthetic oligonucleotide
  Target: DMPK; (+) strand; PAM type: YTN; PAM sequence: CTG
ttgtagtcccaaactctggg

SEQ ID NO: 19288 - DNA, 20 bp, Artificial Sequence
  Description of Artificial Sequence: Synthetic oligonucleotide
  Target: DMPK; (+) strand; PAM type: YTN; PAM sequence: TTG
tagtcccaaactctgggctc

SEQ ID NO: 19289 - DNA, 20 bp, Artificial Sequence
  Description of Artificial Sequence: Synthetic oligonucleotide
  Target: DMPK; (+) strand; PAM type: YTN; PAM sequence: CTC
tgggctcaagcagtcctcca

SEQ ID NO: 19290 - DNA, 20 bp, Artificial Sequence
  Description of Artificial Sequence: Synthetic oligonucleotide
  Target: DMPK; (+) strand; PAM type: YTN; PAM sequence: CTG
ggctcaagcagtcctccaac

SEQ ID NO: 19291 - DNA, 20 bp, Artificial Sequence
  Description of Artificial Sequence: Synthetic oligonucleotide
  Target: DMPK; (+) strand; PAM type: YTN; PAM sequence: CTC
aagcagtcctccaacctcag

SEQ ID NO: 19292 - DNA, 20 bp, Artificial Sequence
  Description of Artificial Sequence: Synthetic oligonucleotide
  Target: DMPK; (+) strand; PAM type: YTN; PAM sequence: CTC
caacctcagcctcccaaagt

SEQ ID NO: 19293 - DNA, 20 bp, Artificial Sequence
  Description of Artificial Sequence: Synthetic oligonucleotide
  Target: DMPK; (+) strand; PAM type: YTN; PAM sequence: CTC
agcctcccaaagtgctggga

SEQ ID NO: 19294 - DNA, 20 bp, Artificial Sequence
  Description of Artificial Sequence: Synthetic oligonucleotide
  Target: DMPK; (+) strand; PAM type: YTN; PAM sequence: CTC
ccaaagtgctgggattacaa

SEQ ID NO: 19295 - DNA, 20 bp, Artificial Sequence
  Description of Artificial Sequence: Synthetic oligonucleotide
  Target: DMPK; (+) strand; PAM type: YTN; PAM sequence: CTG
ggattacaaatataagccac

SEQ ID NO: 19296 - DNA, 20 bp, Artificial Sequence
  Description of Artificial Sequence: Synthetic oligonucleotide
  Target: DMPK; (+) strand; PAM type: YTN; PAM sequence: TTA
caaatataagccactgtgcc

SEQ ID NO: 19297 - DNA, 20 bp, Artificial Sequence
  Description of Artificial Sequence: Synthetic oligonucleotide
  Target: DMPK; (+) strand; PAM type: YTN; PAM sequence: CTG
tgcccagcccagttctgttt

SEQ ID NO: 19298 - DNA, 20 bp, Artificial Sequence
  Description of Artificial Sequence: Synthetic oligonucleotide
  Target: DMPK; (+) strand; PAM type: YTN; PAM sequence: TTC
tgttttttttttttagatgg

SEQ ID NO: 19299 - DNA, 20 bp, Artificial Sequence
  Description of Artificial Sequence: Synthetic oligonucleotide
  Target: DMPK; (+) strand; PAM type: YTN; PAM sequence: CTG
ttttttttttttagatggag

SEQ ID NO: 19300 - DNA, 20 bp, Artificial Sequence
  Description of Artificial Sequence: Synthetic oligonucleotide
  Target: DMPK; (+) strand; PAM type: YTN; PAM sequence: TTT
tttttttttagatggagtct

SEQ ID NO: 19301 - DNA, 20 bp, Artificial Sequence
  Description of Artificial Sequence: Synthetic oligonucleotide
  Target: DMPK; (+) strand; PAM type: YTN; PAM sequence: TTT
ttttttttagatggagtctt

SEQ ID NO: 19302 - DNA, 20 bp, Artificial Sequence
  Description of Artificial Sequence: Synthetic oligonucleotide
  Target: DMPK; (+) strand; PAM type: YTN; PAM sequence: TTT
tttttttagatggagtcttg

SEQ ID NO: 19303 - DNA, 20 bp, Artificial Sequence
  Description of Artificial Sequence: Synthetic oligonucleotide
  Target: DMPK; (+) strand; PAM type: YTN; PAM sequence: TTT
ttttttagatggagtcttgc

SEQ ID NO: 19304 - DNA, 20 bp, Artificial Sequence
  Description of Artificial Sequence: Synthetic oligonucleotide
  Target: DMPK; (+) strand; PAM type: YTN; PAM sequence: TTT
tttttagatggagtcttgct

SEQ ID NO: 19305 - DNA, 20 bp, Artificial Sequence
  Description of Artificial Sequence: Synthetic oligonucleotide
  Target: DMPK; (+) strand; PAM type: YTN; PAM sequence: TTT
ttttagatggagtcttgctg

SEQ ID NO: 19306 - DNA, 20 bp, Artificial Sequence
  Description of Artificial Sequence: Synthetic oligonucleotide
  Target: DMPK; (+) strand; PAM type: YTN; PAM sequence: TTT
tttagatggagtcttgctgt

SEQ ID NO: 19307 - DNA, 20 bp, Artificial Sequence
  Description of Artificial Sequence: Synthetic oligonucleotide
  Target: DMPK; (+) strand; PAM type: YTN; PAM sequence: TTT
ttagatggagtcttgctgtc

SEQ ID NO: 19308 - DNA, 20 bp, Artificial Sequence
  Description of Artificial Sequence: Synthetic oligonucleotide
  Target: DMPK; (+) strand; PAM type: YTN; PAM sequence: TTT
tagatggagtcttgctgtct

SEQ ID NO: 19309 - DNA, 20 bp, Artificial Sequence
  Description of Artificial Sequence: Synthetic oligonucleotide
  Target: DMPK; (+) strand; PAM type: YTN; PAM sequence: TTT
agatggagtcttgctgtctc

SEQ ID NO: 19310 - DNA, 20 bp, Artificial Sequence
  Description of Artificial Sequence: Synthetic oligonucleotide
  Target: DMPK; (+) strand; PAM type: YTN; PAM sequence: TTA
gatggagtcttgctgtctcc

SEQ ID NO: 19311 - DNA, 20 bp, Artificial Sequence
  Description of Artificial Sequence: Synthetic oligonucleotide
  Target: DMPK; (+) strand; PAM type: YTN; PAM sequence: CTT
gctgtctcccagcctagagt

SEQ ID NO: 19312 - DNA, 20 bp, Artificial Sequence
  Description of Artificial Sequence: Synthetic oligonucleotide
  Target: DMPK; (+) strand; PAM type: YTN; PAM sequence: TTG
ctgtctcccagcctagagtg

SEQ ID NO: 19313 - DNA, 20 bp, Artificial Sequence
  Description of Artificial Sequence: Synthetic oligonucleotide
  Target: DMPK; (+) strand; PAM type: YTN; PAM sequence: CTG
tctcccagcctagagtgcag

SEQ ID NO: 19314 - DNA, 20 bp, Artificial Sequence
  Description of Artificial Sequence: Synthetic oligonucleotide
  Target: DMPK; (+) strand; PAM type: YTN; PAM sequence: CTC
ccagcctagagtgcagtggc

SEQ ID NO: 19315 - DNA, 20 bp, Artificial Sequence
  Description of Artificial Sequence: Synthetic oligonucleotide
  Target: DMPK; (+) strand; PAM type: YTN; PAM sequence: CTA
gagtgcagtggcacaacccc

SEQ ID NO: 19316 - DNA, 20 bp, Artificial Sequence
  Description of Artificial Sequence: Synthetic oligonucleotide
  Target: DMPK; (+) strand; PAM type: YTN; PAM sequence: CTG
caaactctgcctcccaggtt

SEQ ID NO: 19317 - DNA, 20 bp, Artificial Sequence
  Description of Artificial Sequence: Synthetic oligonucleotide
  Target: DMPK; (+) strand; PAM type: YTN; PAM sequence: CTC
tgcctcccaggttcaatcaa

SEQ ID NO: 19318 - DNA, 20 bp, Artificial Sequence
  Description of Artificial Sequence: Synthetic oligonucleotide
  Target: DMPK; (+) strand; PAM type: YTN; PAM sequence: CTG
cctcccaggttcaatcaagc

SEQ ID NO: 19319 - DNA, 20 bp, Artificial Sequence
  Description of Artificial Sequence: Synthetic oligonucleotide
  Target: DMPK; (+) strand; PAM type: YTN; PAM sequence: CTC
ccaggttcaatcaagcgatt

SEQ ID NO: 19320 - DNA, 20 bp, Artificial Sequence
  Description of Artificial Sequence: Synthetic oligonucleotide
  Target: DMPK; (+) strand; PAM type: YTN; PAM sequence: TTC
aatcaagcgattctcctgcc

SEQ ID NO: 19321 - DNA, 20 bp, Artificial Sequence
  Description of Artificial Sequence: Synthetic oligonucleotide
  Target: DMPK; (+) strand; PAM type: YTN; PAM sequence: TTC
tcctgcctcagcctcctgag

SEQ ID NO: 19322 - DNA, 20 bp, Artificial Sequence
  Description of Artificial Sequence: Synthetic oligonucleotide
  Target: DMPK; (+) strand; PAM type: YTN; PAM sequence: CTC
ctgcctcagcctcctgagta

SEQ ID NO: 19323 - DNA, 20 bp, Artificial Sequence
  Description of Artificial Sequence: Synthetic oligonucleotide
  Target: DMPK; (+) strand; PAM type: YTN; PAM sequence: CTG
cctcagcctcctgagtagct

SEQ ID NO: 19324 - DNA, 20 bp, Artificial Sequence
  Description of Artificial Sequence: Synthetic oligonucleotide
  Target: DMPK; (+) strand; PAM type: YTN; PAM sequence: CTC
agcctcctgagtagctggca

SEQ ID NO: 19325 - DNA, 20 bp, Artificial Sequence
  Description of Artificial Sequence: Synthetic oligonucleotide
  Target: DMPK; (+) strand; PAM type: YTN; PAM sequence: CTC
ctgagtagctggcattacag

SEQ ID NO: 19326 - DNA, 20 bp, Artificial Sequence
  Description of Artificial Sequence: Synthetic oligonucleotide
  Target: DMPK; (+) strand; PAM type: YTN; PAM sequence: CTG
agtagctggcattacaggca

SEQ ID NO: 19327 - DNA, 20 bp, Artificial Sequence
  Description of Artificial Sequence: Synthetic oligonucleotide
  Target: DMPK; (+) strand; PAM type: YTN; PAM sequence: CTG
gcattacaggcatacgccac

SEQ ID NO: 19328 - DNA, 20 bp, Artificial Sequence
  Description of Artificial Sequence: Synthetic oligonucleotide
  Target: DMPK; (+) strand; PAM type: YTN; PAM sequence: TTA
caggcatacgccaccaagcc

SEQ ID NO: 19329 - DNA, 20 bp, Artificial Sequence
  Description of Artificial Sequence: Synthetic oligonucleotide
  Target: DMPK; (+) strand; PAM type: YTN; PAM sequence: CTG
gctaaattttgtatttttag

SEQ ID NO: 19330 - DNA, 20 bp, Artificial Sequence
  Description of Artificial Sequence: Synthetic oligonucleotide
  Target: DMPK; (+) strand; PAM type: YTN; PAM sequence: CTA
aattttgtatttttagtaga

SEQ ID NO: 19331 - DNA, 20 bp, Artificial Sequence
  Description of Artificial Sequence: Synthetic oligonucleotide
  Target: DMPK; (+) strand; PAM type: YTN; PAM sequence: TTT
tgtatttttagtagacacag

SEQ ID NO: 19332 - DNA, 20 bp, Artificial Sequence
  Description of Artificial Sequence: Synthetic oligonucleotide
  Target: DMPK; (+) strand; PAM type: YTN; PAM sequence: TTT
gtatttttagtagacacagg

SEQ ID NO: 19333 - DNA, 20 bp, Artificial Sequence
  Description of Artificial Sequence: Synthetic oligonucleotide
  Target: DMPK; (+) strand; PAM type: YTN; PAM sequence: TTG
tatttttagtagacacaggg

SEQ ID NO: 19334 - DNA, 20 bp, Artificial Sequence
  Description of Artificial Sequence: Synthetic oligonucleotide
  Target: DMPK; (+) strand; PAM type: YTN; PAM sequence: TTT
ttagtagacacagggtttca

SEQ ID NO: 19335 - DNA, 20 bp, Artificial Sequence
  Description of Artificial Sequence: Synthetic oligonucleotide
  Target: DMPK; (+) strand; PAM type: YTN; PAM sequence: TTT
tagtagacacagggtttcac

SEQ ID NO: 19336 - DNA, 20 bp, Artificial Sequence
  Description of Artificial Sequence: Synthetic oligonucleotide
  Target: DMPK; (+) strand; PAM type: YTN; PAM sequence: TTT
agtagacacagggtttcacc

SEQ ID NO: 19337 - DNA, 20 bp, Artificial Sequence
  Description of Artificial Sequence: Synthetic oligonucleotide
  Target: DMPK; (+) strand; PAM type: YTN; PAM sequence: TTA
gtagacacagggtttcacca

SEQ ID NO: 19338 - DNA, 20 bp, Artificial Sequence
  Description of Artificial Sequence: Synthetic oligonucleotide
  Target: DMPK; (+) strand; PAM type: YTN; PAM sequence: TTT
caccatgttggccaggctgg

SEQ ID NO: 19339 - DNA, 20 bp, Artificial Sequence
  Description of Artificial Sequence: Synthetic oligonucleotide
  Target: DMPK; (+) strand; PAM type: YTN; PAM sequence: TTC
accatgttggccaggctggt

SEQ ID NO: 19340 - DNA, 20 bp, Artificial Sequence
  Description of Artificial Sequence: Synthetic oligonucleotide
  Target: DMPK; (+) strand; PAM type: YTN; PAM sequence: TTG
gccaggctggtcttgaactc

SEQ ID NO: 19341 - DNA, 20 bp, Artificial Sequence
  Description of Artificial Sequence: Synthetic oligonucleotide
  Target: DMPK; (+) strand; PAM type: YTN; PAM sequence: CTG
gtcttgaactcctgacttcc

SEQ ID NO: 19342 - DNA, 20 bp, Artificial Sequence
  Description of Artificial Sequence: Synthetic oligonucleotide
  Target: DMPK; (+) strand; PAM type: YTN; PAM sequence: CTT
gaactcctgacttccagtga

SEQ ID NO: 19343 - DNA, 20 bp, Artificial Sequence
  Description of Artificial Sequence: Synthetic oligonucleotide
  Target: DMPK; (+) strand; PAM type: YTN; PAM sequence: TTG
aactcctgacttccagtgat

SEQ ID NO: 19344 - DNA, 20 bp, Artificial Sequence
  Description of Artificial Sequence: Synthetic oligonucleotide
  Target: DMPK; (+) strand; PAM type: YTN; PAM sequence: CTC
ctgacttccagtgatctgcc

SEQ ID NO: 19345 - DNA, 20 bp, Artificial Sequence
  Description of Artificial Sequence: Synthetic oligonucleotide
  Target: DMPK; (+) strand; PAM type: YTN; PAM sequence: CTG
acttccagtgatctgcctgc

SEQ ID NO: 19346 - DNA, 20 bp, Artificial Sequence
  Description of Artificial Sequence: Synthetic oligonucleotide
  Target: DMPK; (+) strand; PAM type: YTN; PAM sequence: CTT
ccagtgatctgcctgcctca

SEQ ID NO: 19347 - DNA, 20 bp, Artificial Sequence
  Description of Artificial Sequence: Synthetic oligonucleotide
  Target: DMPK; (+) strand; PAM type: YTN; PAM sequence: TTC
cagtgatctgcctgcctcag

SEQ ID NO: 19348 - DNA, 20 bp, Artificial Sequence
  Description of Artificial Sequence: Synthetic oligonucleotide
  Target: DMPK; (+) strand; PAM type: YTN; PAM sequence: CTG
cctgcctcagcctcccaaag

SEQ ID NO: 19349 - DNA, 20 bp, Artificial Sequence
  Description of Artificial Sequence: Synthetic oligonucleotide
  Target: DMPK; (+) strand; PAM type: YTN; PAM sequence: CTG
cctcagcctcccaaagttct

SEQ ID NO: 19350 - DNA, 20 bp, Artificial Sequence
  Description of Artificial Sequence: Synthetic oligonucleotide
  Target: DMPK; (+) strand; PAM type: YTN; PAM sequence: CTC
agcctcccaaagttctggga

SEQ ID NO: 19351 - DNA, 20 bp, Artificial Sequence
  Description of Artificial Sequence: Synthetic oligonucleotide
  Target: DMPK; (+) strand; PAM type: YTN; PAM sequence: CTC
ccaaagttctgggattacag

SEQ ID NO: 19352 - DNA, 20 bp, Artificial Sequence
  Description of Artificial Sequence: Synthetic oligonucleotide
  Target: DMPK; (+) strand; PAM type: YTN; PAM sequence: TTC
tgggattacaggcgtgaacc

SEQ ID NO: 19353 - DNA, 20 bp, Artificial Sequence
  Description of Artificial Sequence: Synthetic oligonucleotide
  Target: DMPK; (+) strand; PAM type: YTN; PAM sequence: CTG
ggattacaggcgtgaaccac

SEQ ID NO: 19354 - DNA, 20 bp, Artificial Sequence
  Description of Artificial Sequence: Synthetic oligonucleotide
  Target: DMPK; (+) strand; PAM type: YTN; PAM sequence: TTA
caggcgtgaaccaccttgcc

SEQ ID NO: 19355 - DNA, 20 bp, Artificial Sequence
  Description of Artificial Sequence: Synthetic oligonucleotide
  Target: DMPK; (+) strand; PAM type: YTN; PAM sequence: CTT
gcccaacccttttttttttt

SEQ ID NO: 19356 - DNA, 20 bp, Artificial Sequence
  Description of Artificial Sequence: Synthetic oligonucleotide
  Target: DMPK; (+) strand; PAM type: YTN; PAM sequence: TTG
cccaaccctttttttttttt

SEQ ID NO: 19357 - DNA, 20 bp, Artificial Sequence
  Description of Artificial Sequence: Synthetic oligonucleotide
  Target: DMPK; (+) strand; PAM type: YTN; PAM sequence: CTT
ttttttttttttttttttga

SEQ ID NO: 19358 - DNA, 20 bp, Artificial Sequence
  Description of Artificial Sequence: Synthetic oligonucleotide
  Target: DMPK; (+) strand; PAM type: YTN; PAM sequence: TTT
tttttttttttttttttgag

SEQ ID NO: 19359 - DNA, 20 bp, Artificial Sequence
  Description of Artificial Sequence: Synthetic oligonucleotide
  Target: DMPK; (+) strand; PAM type: YTN; PAM sequence: TTT
ttttttttttttttttgaga

SEQ ID NO: 19360 - DNA, 20 bp, Artificial Sequence
  Description of Artificial Sequence: Synthetic oligonucleotide
  Target: DMPK; (+) strand; PAM type: YTN; PAM sequence: TTT
tttttttttttttttgagac

SEQ ID NO: 19361 - DNA, 20 bp, Artificial Sequence
  Description of Artificial Sequence: Synthetic oligonucleotide
  Target: DMPK; (+) strand; PAM type: YTN; PAM sequence: TTT
ttttttttttttttgagaca

SEQ ID NO: 19362 - DNA, 20 bp, Artificial Sequence
  Description of Artificial Sequence: Synthetic oligonucleotide
  Target: DMPK; (+) strand; PAM type: YTN; PAM sequence: TTT
tttttttttttttgagacag

SEQ ID NO: 19363 - DNA, 20 bp, Artificial Sequence
  Description of Artificial Sequence: Synthetic oligonucleotide
  Target: DMPK; (+) strand; PAM type: YTN; PAM sequence: TTT
ttttttttttttgagacaga

SEQ ID NO: 19364 - DNA, 20 bp, Artificial Sequence
  Description of Artificial Sequence: Synthetic oligonucleotide
  Target: DMPK; (+) strand; PAM type: YTN; PAM sequence: TTT
tttttttttttgagacagag

SEQ ID NO: 19365 - DNA, 20 bp, Artificial Sequence
  Description of Artificial Sequence: Synthetic oligonucleotide
  Target: DMPK; (+) strand; PAM type: YTN; PAM sequence: TTT
ttttttttttgagacagagt

SEQ ID NO: 19366 - DNA, 20 bp, Artificial Sequence
  Description of Artificial Sequence: Synthetic oligonucleotide
  Target: DMPK; (+) strand; PAM type: YTN; PAM sequence: TTT
tttttttttgagacagagtc

SEQ ID NO: 19367 - DNA, 20 bp, Artificial Sequence
  Description of Artificial Sequence: Synthetic oligonucleotide
  Target: DMPK; (+) strand; PAM type: YTN; PAM sequence: TTT
ttttttttgagacagagtct

SEQ ID NO: 19368 - DNA, 20 bp, Artificial Sequence
  Description of Artificial Sequence: Synthetic oligonucleotide
  Target: DMPK; (+) strand; PAM type: YTN; PAM sequence: TTT
tttttttgagacagagtctc

SEQ ID NO: 19369 - DNA, 20 bp, Artificial Sequence
  Description of Artificial Sequence: Synthetic oligonucleotide
  Target: DMPK; (+) strand; PAM type: YTN; PAM sequence: TTT
ttttttgagacagagtctca

SEQ ID NO: 19370 - DNA, 20 bp, Artificial Sequence
  Description of Artificial Sequence: Synthetic oligonucleotide
  Target: DMPK; (+) strand; PAM type: YTN; PAM sequence: TTT
tttttgagacagagtctcac

SEQ ID NO: 19371 - DNA, 20 bp, Artificial Sequence
  Description of Artificial Sequence: Synthetic oligonucleotide
  Target: DMPK; (+) strand; PAM type: YTN; PAM sequence: TTT
ttttgagacagagtctcact

SEQ ID NO: 19372 - DNA, 20 bp, Artificial Sequence
  Description of Artificial Sequence: Synthetic oligonucleotide
  Target: DMPK; (+) strand; PAM type: YTN; PAM sequence: TTT
tttgagacagagtctcactc

SEQ ID NO: 19373 - DNA, 20 bp, Artificial Sequence
  Description of Artificial Sequence: Synthetic oligonucleotide
  Target: DMPK; (+) strand; PAM type: YTN; PAM sequence: TTT
ttgagacagagtctcactct

SEQ ID NO: 19374 - DNA, 20 bp, Artificial Sequence
  Description of Artificial Sequence: Synthetic oligonucleotide
  Target: DMPK; (+) strand; PAM type: YTN; PAM sequence: TTT
tgagacagagtctcactctg

SEQ ID NO: 19375 - DNA, 20 bp, Artificial Sequence
  Description of Artificial Sequence: Synthetic oligonucleotide
  Target: DMPK; (+) strand; PAM type: YTN; PAM sequence: TTT
gagacagagtctcactctgt

SEQ ID NO: 19376 - DNA, 20 bp, Artificial Sequence
  Description of Artificial Sequence: Synthetic oligonucleotide
  Target: DMPK; (+) strand; PAM type: YTN; PAM sequence: TTG
agacagagtctcactctgtc

SEQ ID NO: 19377 - DNA, 20 bp, Artificial Sequence
  Description of Artificial Sequence: Synthetic oligonucleotide
  Target: DMPK; (+) strand; PAM type: YTN; PAM sequence: CTC
actctgtcacccagactgga

SEQ ID NO: 19378 - DNA, 20 bp, Artificial Sequence
  Description of Artificial Sequence: Synthetic oligonucleotide
  Target: DMPK; (+) strand; PAM type: YTN; PAM sequence: CTC
tgtcacccagactggagtgt

SEQ ID NO: 19379 - DNA, 20 bp, Artificial Sequence
  Description of Artificial Sequence: Synthetic oligonucleotide
  Target: DMPK; (+) strand; PAM type: YTN; PAM sequence: CTG
tcacccagactggagtgtag

SEQ ID NO: 19380 - DNA, 20 bp, Artificial Sequence
  Description of Artificial Sequence: Synthetic oligonucleotide
  Target: DMPK; (+) strand; PAM type: YTN; PAM sequence: CTG
gagtgtagtggcatgatctt

SEQ ID NO: 19381 - DNA, 20 bp, Artificial Sequence
  Description of Artificial Sequence: Synthetic oligonucleotide
  Target: DMPK; (+) strand; PAM type: YTN; PAM sequence: CTT
ggctcactgcaaactctgcc

SEQ ID NO: 19382 - DNA, 20 bp, Artificial Sequence
  Description of Artificial Sequence: Synthetic oligonucleotide
  Target: DMPK; (+) strand; PAM type: YTN; PAM sequence: TTG
gctcactgcaaactctgcct

SEQ ID NO: 19383 - DNA, 20 bp, Artificial Sequence
  Description of Artificial Sequence: Synthetic oligonucleotide
  Target: DMPK; (+) strand; PAM type: YTN; PAM sequence: CTC
actgcaaactctgcctccca

SEQ ID NO: 19384 - DNA, 20 bp, Artificial Sequence
  Description of Artificial Sequence: Synthetic oligonucleotide
  Target: DMPK; (+) strand; PAM type: YTN; PAM sequence: CTG
caaactctgcctcccaggtt

SEQ ID NO: 19385 - DNA, 20 bp, Artificial Sequence
  Description of Artificial Sequence: Synthetic oligonucleotide
  Target: DMPK; (+) strand; PAM type: YTN; PAM sequence: CTC
tgcctcccaggttcaagcaa

SEQ ID NO: 19386 - DNA, 20 bp, Artificial Sequence
  Description of Artificial Sequence: Synthetic oligonucleotide
  Target: DMPK; (+) strand; PAM type: YTN; PAM sequence: CTG
cctcccaggttcaagcaatt

SEQ ID NO: 19387 - DNA, 20 bp, Artificial Sequence
  Description of Artificial Sequence: Synthetic oligonucleotide
  Target: DMPK; (+) strand; PAM type: YTN; PAM sequence: CTC
ccaggttcaagcaattctcc

SEQ ID NO: 19388 - DNA, 20 bp, Artificial Sequence
  Description of Artificial Sequence: Synthetic oligonucleotide
  Target: DMPK; (+) strand; PAM type: YTN; PAM sequence: TTC
aagcaattctcctgcctcag

SEQ ID NO: 19389 - DNA, 20 bp, Artificial Sequence
  Description of Artificial Sequence: Synthetic oligonucleotide
  Target: DMPK; (+) strand; PAM type: YTN; PAM sequence: TTC
tcctgcctcagcttccccag

SEQ ID NO: 19390 - DNA, 20 bp, Artificial Sequence
  Description of Artificial Sequence: Synthetic oligonucleotide
  Target: DMPK; (+) strand; PAM type: YTN; PAM sequence: CTC
ctgcctcagcttccccagta

SEQ ID NO: 19391 - DNA, 20 bp, Artificial Sequence
  Description of Artificial Sequence: Synthetic oligonucleotide
  Target: DMPK; (+) strand; PAM type: YTN; PAM sequence: CTG
cctcagcttccccagtaact

SEQ ID NO: 19392 - DNA, 20 bp, Artificial Sequence
  Description of Artificial Sequence: Synthetic oligonucleotide
  Target: DMPK; (+) strand; PAM type: YTN; PAM sequence: CTC
agcttccccagtaactggaa

SEQ ID NO: 19393 - DNA, 20 bp, Artificial Sequence
  Description of Artificial Sequence: Synthetic oligonucleotide
  Target: DMPK; (+) strand; PAM type: YTN; PAM sequence: CTT
ccccagtaactggaattaca

SEQ ID NO: 19394 - DNA, 20 bp, Artificial Sequence
  Description of Artificial Sequence: Synthetic oligonucleotide
  Target: DMPK; (+) strand; PAM type: YTN; PAM sequence: TTC
cccagtaactggaattacag

SEQ ID NO: 19395 - DNA, 20 bp, Artificial Sequence
  Description of Artificial Sequence: Synthetic oligonucleotide
  Target: DMPK; (+) strand; PAM type: YTN; PAM sequence: CTG
gaattacaggcacccgagac

SEQ ID NO: 19396 - DNA, 20 bp, Artificial Sequence
  Description of Artificial Sequence: Synthetic oligonucleotide
  Target: DMPK; (+) strand; PAM type: YTN; PAM sequence: TTA
caggcacccgagaccacacc

SEQ ID NO: 19397 - DNA, 20 bp, Artificial Sequence
  Description of Artificial Sequence: Synthetic oligonucleotide
  Target: DMPK; (+) strand; PAM type: YTN; PAM sequence: CTA
attttcttgtatttttagta

SEQ ID NO: 19398 - DNA, 20 bp, Artificial Sequence
  Description of Artificial Sequence: Synthetic oligonucleotide
  Target: DMPK; (+) strand; PAM type: YTN; PAM sequence: TTT
tcttgtatttttagtagaga

SEQ ID NO: 19399 - DNA, 20 bp, Artificial Sequence
  Description of Artificial Sequence: Synthetic oligonucleotide
  Target: DMPK; (+) strand; PAM type: YTN; PAM sequence: TTT
cttgtatttttagtagagac

SEQ ID NO: 19400 - DNA, 20 bp, Artificial Sequence
  Description of Artificial Sequence: Synthetic oligonucleotide
  Target: DMPK; (+) strand; PAM type: YTN; PAM sequence: TTC
ttgtatttttagtagagacg

SEQ ID NO: 19401 - DNA, 20 bp, Artificial Sequence
  Description of Artificial Sequence: Synthetic oligonucleotide
  Target: DMPK; (+) strand; PAM type: YTN; PAM sequence: CTT
gtatttttagtagagacggg

SEQ ID NO: 19402 - DNA, 20 bp, Artificial Sequence
  Description of Artificial Sequence: Synthetic oligonucleotide
  Target: DMPK; (+) strand; PAM type: YTN; PAM sequence: TTG
tatttttagtagagacgggg

SEQ ID NO: 19403 - DNA, 20 bp, Artificial Sequence
  Description of Artificial Sequence: Synthetic oligonucleotide
  Target: DMPK; (+) strand; PAM type: YTN; PAM sequence: TTT
ttagtagagacggggtttca

SEQ ID NO: 19404 - DNA, 20 bp, Artificial Sequence
  Description of Artificial Sequence: Synthetic oligonucleotide
  Target: DMPK; (+) strand; PAM type: YTN; PAM sequence: TTT
tagtagagacggggtttcac

SEQ ID NO: 19405 - DNA, 20 bp, Artificial Sequence
  Description of Artificial Sequence: Synthetic oligonucleotide
  Target: DMPK; (+) strand; PAM type: YTN; PAM sequence: TTT
agtagagacggggtttcacc

SEQ ID NO: 19406 - DNA, 20 bp, Artificial Sequence
  Description of Artificial Sequence: Synthetic oligonucleotide
  Target: DMPK; (+) strand; PAM type: YTN; PAM sequence: TTA
gtagagacggggtttcaccg

SEQ ID NO: 19407 - DNA, 20 bp, Artificial Sequence
  Description of Artificial Sequence: Synthetic oligonucleotide
  Target: DMPK; (+) strand; PAM type: YTN; PAM sequence: TTT
caccgtgttggccagcctag

SEQ ID NO: 19408 - DNA, 20 bp, Artificial Sequence
  Description of Artificial Sequence: Synthetic oligonucleotide
  Target: DMPK; (+) strand; PAM type: YTN; PAM sequence: TTC
accgtgttggccagcctagt

SEQ ID NO: 19409 - DNA, 20 bp, Artificial Sequence
  Description of Artificial Sequence: Synthetic oligonucleotide
  Target: DMPK; (+) strand; PAM type: YTN; PAM sequence: TTG
gccagcctagtctcaaaact

SEQ ID NO: 19410 - DNA, 20 bp, Artificial Sequence
  Description of Artificial Sequence: Synthetic oligonucleotide
  Target: DMPK; (+) strand; PAM type: YTN; PAM sequence: CTA
gtctcaaaactcctgatctc

SEQ ID NO: 19411 - DNA, 20 bp, Artificial Sequence
  Description of Artificial Sequence: Synthetic oligonucleotide
  Target: DMPK; (+) strand; PAM type: YTN; PAM sequence: CTC
aaaactcctgatctcatgac

SEQ ID NO: 19412 - DNA, 20 bp, Artificial Sequence
  Description of Artificial Sequence: Synthetic oligonucleotide
  Target: DMPK; (+) strand; PAM type: YTN; PAM sequence: CTC
ctgatctcatgacccaccgg

SEQ ID NO: 19413 - DNA, 20 bp, Artificial Sequence
  Description of Artificial Sequence: Synthetic oligonucleotide
  Target: DMPK; (+) strand; PAM type: YTN; PAM sequence: CTG
atctcatgacccaccggcct

SEQ ID NO: 19414 - DNA, 20 bp, Artificial Sequence
  Description of Artificial Sequence: Synthetic oligonucleotide
  Target: DMPK; (+) strand; PAM type: YTN; PAM sequence: CTC
atgacccaccggccttggac

SEQ ID NO: 19415 - DNA, 20 bp, Artificial Sequence
  Description of Artificial Sequence: Synthetic oligonucleotide
  Target: DMPK; (+) strand; PAM type: YTN; PAM sequence: CTT
ggactcccaaagtgctggga

SEQ ID NO: 19416 - DNA, 20 bp, Artificial Sequence
  Description of Artificial Sequence: Synthetic oligonucleotide
  Target: DMPK; (+) strand; PAM type: YTN; PAM sequence: TTG
gactcccaaagtgctgggat

SEQ ID NO: 19417 - DNA, 20 bp, Artificial Sequence
  Description of Artificial Sequence: Synthetic oligonucleotide
  Target: DMPK; (+) strand; PAM type: YTN; PAM sequence: CTC
ccaaagtgctgggattacag

SEQ ID NO: 19418 - DNA, 20 bp, Artificial Sequence
  Description of Artificial Sequence: Synthetic oligonucleotide
  Target: DMPK; (+) strand; PAM type: YTN; PAM sequence: CTG
ggattacaggcatgagccac

SEQ ID NO: 19419 - DNA, 20 bp, Artificial Sequence
  Description of Artificial Sequence: Synthetic oligonucleotide
  Target: DMPK; (+) strand; PAM type: YTN; PAM sequence: TTA
caggcatgagccacagcgcc

SEQ ID NO: 19420 - DNA, 20 bp, Artificial Sequence
  Description of Artificial Sequence: Synthetic oligonucleotide
  Target: DMPK; (+) strand; PAM type: YTN; PAM sequence: CTA
tttttttttttttttttttt

SEQ ID NO: 19421 - DNA, 20 bp, Artificial Sequence
  Description of Artificial Sequence: Synthetic oligonucleotide
  Target: DMPK; (+) strand; PAM type: YTN; PAM sequence: TTT
tttttttttttttttttttt

SEQ ID NO: 19422 - DNA, 20 bp, Artificial Sequence
  Description of Artificial Sequence: Synthetic oligonucleotide
  Target: DMPK; (+) strand; PAM type: YTN; PAM sequence: TTT
tttttttttttttttttttt

SEQ ID NO: 19423 - DNA, 20 bp, Artificial Sequence
  Description of Artificial Sequence: Synthetic oligonucleotide
  Target: DMPK; (+) strand; PAM type: YTN; PAM sequence: TTT
tttttttttttttttttttt

SEQ ID NO: 19424 - DNA, 20 bp, Artificial Sequence
  Description of Artificial Sequence: Synthetic oligonucleotide
  Target: DMPK; (+) strand; PAM type: YTN; PAM sequence: TTT
tttttttttttttttttttc

SEQ ID NO: 19425 - DNA, 20 bp, Artificial Sequence
  Description of Artificial Sequence: Synthetic oligonucleotide
  Target: DMPK; (+) strand; PAM type: YTN; PAM sequence: TTT
ttttttttttttttttttct

SEQ ID NO: 19426 - DNA, 20 bp, Artificial Sequence
  Description of Artificial Sequence: Synthetic oligonucleotide
  Target: DMPK; (+) strand; PAM type: YTN; PAM sequence: TTT
tttttttttttttttttctg

SEQ ID NO: 19427 - DNA, 20 bp, Artificial Sequence
  Description of Artificial Sequence: Synthetic oligonucleotide
  Target: DMPK; (+) strand; PAM type: YTN; PAM sequence: TTT
ttttttttttttttttctga

SEQ ID NO: 19428 - DNA, 20 bp, Artificial Sequence
  Description of Artificial Sequence: Synthetic oligonucleotide
  Target: DMPK; (+) strand; PAM type: YTN; PAM sequence: TTT
tttttttttttttttctgag

SEQ ID NO: 19429 - DNA, 20 bp, Artificial Sequence
  Description of Artificial Sequence: Synthetic oligonucleotide
  Target: DMPK; (+) strand; PAM type: YTN; PAM sequence: TTT
ttttttttttttttctgaga

SEQ ID NO: 19430 - DNA, 20 bp, Artificial Sequence
  Description of Artificial Sequence: Synthetic oligonucleotide
  Target: DMPK; (+) strand; PAM type: YTN; PAM sequence: TTT
tttttttttttttctgagac

SEQ ID NO: 19431 - DNA, 20 bp, Artificial Sequence
  Description of Artificial Sequence: Synthetic oligonucleotide
  Target: DMPK; (+) strand; PAM type: YTN; PAM sequence: TTT
ttttttttttttctgagaca

SEQ ID NO: 19432 - DNA, 20 bp, Artificial Sequence
  Description of Artificial Sequence: Synthetic oligonucleotide
  Target: DMPK; (+) strand; PAM type: YTN; PAM sequence: TTT
tttttttttttctgagacag

SEQ ID NO: 19433 - DNA, 20 bp, Artificial Sequence
  Description of Artificial Sequence: Synthetic oligonucleotide
  Target: DMPK; (+) strand; PAM type: YTN; PAM sequence: TTT
ttttttttttctgagacaga

SEQ ID NO: 19434 - DNA, 20 bp, Artificial Sequence
  Description of Artificial Sequence: Synthetic oligonucleotide
  Target: DMPK; (+) strand; PAM type: YTN; PAM sequence: TTT
tttttttttctgagacagag

SEQ ID NO: 19435 - DNA, 20 bp, Artificial Sequence
  Description of Artificial Sequence: Synthetic oligonucleotide
  Target: DMPK; (+) strand; PAM type: YTN; PAM sequence: TTT
ttttttttctgagacagagt

SEQ ID NO: 19436 - DNA, 20 bp, Artificial Sequence
  Description of Artificial Sequence: Synthetic oligonucleotide
  Target: DMPK; (+) strand; PAM type: YTN; PAM sequence: TTT
tttttttctgagacagagtc

SEQ ID NO: 19437 - DNA, 20 bp, Artificial Sequence
  Description of Artificial Sequence: Synthetic oligonucleotide
  Target: DMPK; (+) strand; PAM type: YTN; PAM sequence: TTT
ttttttctgagacagagtct

SEQ ID NO: 19438 - DNA, 20 bp, Artificial Sequence
  Description of Artificial Sequence: Synthetic oligonucleotide
  Target: DMPK; (+) strand; PAM type: YTN; PAM sequence: TTT
tttttctgagacagagtctc

SEQ ID NO: 19439 - DNA, 20 bp, Artificial Sequence
  Description of Artificial Sequence: Synthetic oligonucleotide
  Target: DMPK; (+) strand; PAM type: YTN; PAM sequence: TTT
ttttctgagacagagtctcg

SEQ ID NO: 19440 - DNA, 20 bp, Artificial Sequence
  Description of Artificial Sequence: Synthetic oligonucleotide
  Target: DMPK; (+) strand; PAM type: YTN; PAM sequence: TTT
tttctgagacagagtctcgc

SEQ ID NO: 19441 - DNA, 20 bp, Artificial Sequence
  Description of Artificial Sequence: Synthetic oligonucleotide
  Target: DMPK; (+) strand; PAM type: YTN; PAM sequence: TTT
ttctgagacagagtctcgct

SEQ ID NO: 19442 - DNA, 20 bp, Artificial Sequence
  Description of Artificial Sequence: Synthetic oligonucleotide
  Target: DMPK; (+) strand; PAM type: YTN; PAM sequence: TTT
tctgagacagagtctcgctc

SEQ ID NO: 19443 - DNA, 20 bp, Artificial Sequence
  Description of Artificial Sequence: Synthetic oligonucleotide
  Target: DMPK; (+) strand; PAM type: YTN; PAM sequence: TTT
ctgagacagagtctcgctct

SEQ ID NO: 19444 - DNA, 20 bp, Artificial Sequence
  Description of Artificial Sequence: Synthetic oligonucleotide
  Target: DMPK; (+) strand; PAM type: YTN; PAM sequence: TTC
tgagacagagtctcgctctg

SEQ ID NO: 19445 - DNA, 20 bp, Artificial Sequence
  Description of Artificial Sequence: Synthetic oligonucleotide
  Target: DMPK; (+) strand; PAM type: YTN; PAM sequence: CTG
agacagagtctcgctctgtc

SEQ ID NO: 19446 - DNA, 20 bp, Artificial Sequence
  Description of Artificial Sequence: Synthetic oligonucleotide
  Target: DMPK; (+) strand; PAM type: YTN; PAM sequence: CTC
gctctgtcgcccaggctgga

SEQ ID NO: 19447 - DNA, 20 bp, Artificial Sequence
  Description of Artificial Sequence: Synthetic oligonucleotide
  Target: DMPK; (+) strand; PAM type: YTN; PAM sequence: CTC
tgtcgcccaggctggagtgc

SEQ ID NO: 19448 - DNA, 20 bp, Artificial Sequence
  Description of Artificial Sequence: Synthetic oligonucleotide
  Target: DMPK; (+) strand; PAM type: YTN; PAM sequence: CTG
tcgcccaggctggagtgcag

SEQ ID NO: 19449 - DNA, 20 bp, Artificial Sequence
  Description of Artificial Sequence: Synthetic oligonucleotide
  Target: DMPK; (+) strand; PAM type: YTN; PAM sequence: CTG
gagtgcagtggcacgatctc

SEQ ID NO: 19450 - DNA, 20 bp, Artificial Sequence
  Description of Artificial Sequence: Synthetic oligonucleotide
  Target: DMPK; (+) strand; PAM type: YTN; PAM sequence: CTC
ggctcactgcaaactctgcc

SEQ ID NO: 19451 - DNA, 20 bp, Artificial Sequence
  Description of Artificial Sequence: Synthetic oligonucleotide
  Target: DMPK; (+) strand; PAM type: YTN; PAM sequence: CTC
actgcaaactctgcctcccg

SEQ ID NO: 19452 - DNA, 20 bp, Artificial Sequence
  Description of Artificial Sequence: Synthetic oligonucleotide
  Target: DMPK; (+) strand; PAM type: YTN; PAM sequence: CTG
caaactctgcctcccgggtt

SEQ ID NO: 19453 - DNA, 20 bp, Artificial Sequence
  Description of Artificial Sequence: Synthetic oligonucleotide
  Target: DMPK; (+) strand; PAM type: YTN; PAM sequence: CTC
tgcctcccgggttcacgcca

SEQ ID NO: 19454 - DNA, 20 bp, Artificial Sequence
  Description of Artificial Sequence: Synthetic oligonucleotide
  Target: DMPK; (+) strand; PAM type: YTN; PAM sequence: CTG
cctcccgggttcacgccatt

SEQ ID NO: 19455 - DNA, 20 bp, Artificial Sequence
  Description of Artificial Sequence: Synthetic oligonucleotide
  Target: DMPK; (+) strand; PAM type: YTN; PAM sequence: CTC
ccgggttcacgccattctcc

SEQ ID NO: 19456 - DNA, 20 bp, Artificial Sequence
  Description of Artificial Sequence: Synthetic oligonucleotide
  Target: DMPK; (+) strand; PAM type: YTN; PAM sequence: TTC
acgccattctcctgcctcag

SEQ ID NO: 19457 - DNA, 20 bp, Artificial Sequence
  Description of Artificial Sequence: Synthetic oligonucleotide
  Target: DMPK; (+) strand; PAM type: YTN; PAM sequence: TTC
tcctgcctcagcctcctgag

SEQ ID NO: 19458 - DNA, 20 bp, Artificial Sequence
  Description of Artificial Sequence: Synthetic oligonucleotide
  Target: DMPK; (+) strand; PAM type: YTN; PAM sequence: CTC
ctgcctcagcctcctgagta

SEQ ID NO: 19459 - DNA, 20 bp, Artificial Sequence
  Description of Artificial Sequence: Synthetic oligonucleotide
  Target: DMPK; (+) strand; PAM type: YTN; PAM sequence: CTG
cctcagcctcctgagtagct

SEQ ID NO: 19460 - DNA, 20 bp, Artificial Sequence
  Description of Artificial Sequence: Synthetic oligonucleotide
  Target: DMPK; (+) strand; PAM type: YTN; PAM sequence: CTC
agcctcctgagtagctggga

SEQ ID NO: 19461 - DNA, 20 bp, Artificial Sequence
  Description of Artificial Sequence: Synthetic oligonucleotide
  Target: DMPK; (+) strand; PAM type: YTN; PAM sequence: CTC
ctgagtagctgggactacag

SEQ ID NO: 19462 - DNA, 20 bp, Artificial Sequence
  Description of Artificial Sequence: Synthetic oligonucleotide
  Target: DMPK; (+) strand; PAM type: YTN; PAM sequence: CTG
agtagctgggactacaggcg

SEQ ID NO: 19463 - DNA, 20 bp, Artificial Sequence
  Description of Artificial Sequence: Synthetic oligonucleotide
  Target: DMPK; (+) strand; PAM type: YTN; PAM sequence: CTG
ggactacaggcgcccgccac

SEQ ID NO: 19464 - DNA, 20 bp, Artificial Sequence
  Description of Artificial Sequence: Synthetic oligonucleotide
  Target: DMPK; (+) strand; PAM type: YTN; PAM sequence: CTA
caggcgcccgccaccacgcc

SEQ ID NO: 19465 - DNA, 20 bp, Artificial Sequence
  Description of Artificial Sequence: Synthetic oligonucleotide
  Target: DMPK; (+) strand; PAM type: YTN; PAM sequence: CTG
gctaattttttgtattttta

SEQ ID NO: 19466 - DNA, 20 bp, Artificial Sequence
  Description of Artificial Sequence: Synthetic oligonucleotide
  Target: DMPK; (+) strand; PAM type: YTN; PAM sequence: CTA
attttttgtatttttaggag

SEQ ID NO: 19467 - DNA, 20 bp, Artificial Sequence
  Description of Artificial Sequence: Synthetic oligonucleotide
  Target: DMPK; (+) strand; PAM type: YTN; PAM sequence: TTT
tttgtatttttaggagagat

SEQ ID NO: 19468 - DNA, 20 bp, Artificial Sequence
  Description of Artificial Sequence: Synthetic oligonucleotide
  Target: DMPK; (+) strand; PAM type: YTN; PAM sequence: TTT
ttgtatttttaggagagatg

SEQ ID NO: 19469 - DNA, 20 bp, Artificial Sequence
  Description of Artificial Sequence: Synthetic oligonucleotide
  Target: DMPK; (+) strand; PAM type: YTN; PAM sequence: TTT
tgtatttttaggagagatgg

SEQ ID NO: 19470 - DNA, 20 bp, Artificial Sequence
  Description of Artificial Sequence: Synthetic oligonucleotide
  Target: DMPK; (+) strand; PAM type: YTN; PAM sequence: TTT
gtatttttaggagagatggg

SEQ ID NO: 19471 - DNA, 20 bp, Artificial Sequence
  Description of Artificial Sequence: Synthetic oligonucleotide
  Target: DMPK; (+) strand; PAM type: YTN; PAM sequence: TTG
tatttttaggagagatgggg

SEQ ID NO: 19472 - DNA, 20 bp, Artificial Sequence
  Description of Artificial Sequence: Synthetic oligonucleotide
  Target: DMPK; (+) strand; PAM type: YTN; PAM sequence: TTT
ttaggagagatggggtttca

SEQ ID NO: 19473 - DNA, 20 bp, Artificial Sequence
  Description of Artificial Sequence: Synthetic oligonucleotide
  Target: DMPK; (+) strand; PAM type: YTN; PAM sequence: TTT
taggagagatggggtttcac

SEQ ID NO: 19474 - DNA, 20 bp, Artificial Sequence
  Description of Artificial Sequence: Synthetic oligonucleotide
  Target: DMPK; (+) strand; PAM type: YTN; PAM sequence: TTT
aggagagatggggtttcacc

SEQ ID NO: 19475 - DNA, 20 bp, Artificial Sequence
  Description of Artificial Sequence: Synthetic oligonucleotide
  Target: DMPK; (+) strand; PAM type: YTN; PAM sequence: TTA
ggagagatggggtttcaccg

SEQ ID NO: 19476 - DNA, 20 bp, Artificial Sequence
  Description of Artificial Sequence: Synthetic oligonucleotide
  Target: DMPK; (+) strand; PAM type: YTN; PAM sequence: TTT
caccgtgttagccaagatgg

SEQ ID NO: 19477 - DNA, 20 bp, Artificial Sequence
  Description of Artificial Sequence: Synthetic oligonucleotide
  Target: DMPK; (+) strand; PAM type: YTN; PAM sequence: TTC
accgtgttagccaagatggt

SEQ ID NO: 19478 - DNA, 20 bp, Artificial Sequence
  Description of Artificial Sequence: Synthetic oligonucleotide
  Target: DMPK; (+) strand; PAM type: YTN; PAM sequence: TTA
gccaagatggtctcgatctc

SEQ ID NO: 19479 - DNA, 20 bp, Artificial Sequence
  Description of Artificial Sequence: Synthetic oligonucleotide
  Target: DMPK; (+) strand; PAM type: YTN; PAM sequence: CTC
gatctcctgacctcgtgatc

SEQ ID NO: 19480 - DNA, 20 bp, Artificial Sequence
  Description of Artificial Sequence: Synthetic oligonucleotide
  Target: DMPK; (+) strand; PAM type: YTN; PAM sequence: CTC
ctgacctcgtgatccacccg

SEQ ID NO: 19481 - DNA, 20 bp, Artificial Sequence
  Description of Artificial Sequence: Synthetic oligonucleotide
  Target: DMPK; (+) strand; PAM type: YTN; PAM sequence: CTG
acctcgtgatccacccgcct

SEQ ID NO: 19482 - DNA, 20 bp, Artificial Sequence
  Description of Artificial Sequence: Synthetic oligonucleotide
  Target: DMPK; (+) strand; PAM type: YTN; PAM sequence: CTC
gtgatccacccgcctcggcc

SEQ ID NO: 19483 - DNA, 20 bp, Artificial Sequence
  Description of Artificial Sequence: Synthetic oligonucleotide
  Target: DMPK; (+) strand; PAM type: YTN; PAM sequence: CTC
ggcctcccaaagtgctgaga

SEQ ID NO: 19484 - DNA, 20 bp, Artificial Sequence
  Description of Artificial Sequence: Synthetic oligonucleotide
  Target: DMPK; (+) strand; PAM type: YTN; PAM sequence: CTC
ccaaagtgctgagattacag

SEQ ID NO: 19485 - DNA, 20 bp, Artificial Sequence
  Description of Artificial Sequence: Synthetic oligonucleotide
  Target: DMPK; (+) strand; PAM type: YTN; PAM sequence: CTG
agattacaggcgtgagccac

SEQ ID NO: 19486 - DNA, 20 bp, Artificial Sequence
  Description of Artificial Sequence: Synthetic oligonucleotide
  Target: DMPK; (+) strand; PAM type: YTN; PAM sequence: TTA
caggcgtgagccaccacgcc

SEQ ID NO: 19487 - DNA, 20 bp, Artificial Sequence
  Description of Artificial Sequence: Synthetic oligonucleotide
  Target: DMPK; (+) strand; PAM type: YTN; PAM sequence: CTA
ttttttaatttcagtttatc

SEQ ID NO: 19488 - DNA, 20 bp, Artificial Sequence
  Description of Artificial Sequence: Synthetic oligonucleotide
  Target: DMPK; (+) strand; PAM type: YTN; PAM sequence: TTT
tttaatttcagtttatctta

SEQ ID NO: 19489 - DNA, 20 bp, Artificial Sequence
  Description of Artificial Sequence: Synthetic oligonucleotide
  Target: DMPK; (+) strand; PAM type: YTN; PAM sequence: TTT
ttaatttcagtttatcttat

SEQ ID NO: 19490 - DNA, 20 bp, Artificial Sequence
  Description of Artificial Sequence: Synthetic oligonucleotide
  Target: DMPK; (+) strand; PAM type: YTN; PAM sequence: TTT
taatttcagtttatcttatt

SEQ ID NO: 19491 - DNA, 20 bp, Artificial Sequence
  Description of Artificial Sequence: Synthetic oligonucleotide
  Target: DMPK; (+) strand; PAM type: YTN; PAM sequence: TTT
aatttcagtttatcttattt

SEQ ID NO: 19492 - DNA, 20 bp, Artificial Sequence
  Description of Artificial Sequence: Synthetic oligonucleotide
  Target: DMPK; (+) strand; PAM type: YTN; PAM sequence: TTA
atttcagtttatcttatttt

SEQ ID NO: 19493 - DNA, 20 bp, Artificial Sequence
  Description of Artificial Sequence: Synthetic oligonucleotide
  Target: DMPK; (+) strand; PAM type: YTN; PAM sequence: TTT
cagtttatcttatttttgag

SEQ ID NO: 19494 - DNA, 20 bp, Artificial Sequence
  Description of Artificial Sequence: Synthetic oligonucleotide
  Target: DMPK; (+) strand; PAM type: YTN; PAM sequence: TTC
agtttatcttatttttgaga

SEQ ID NO: 19495 - DNA, 20 bp, Artificial Sequence
  Description of Artificial Sequence: Synthetic oligonucleotide
  Target: DMPK; (+) strand; PAM type: YTN; PAM sequence: TTT
atcttatttttgagacagag

SEQ ID NO: 19496 - DNA, 20 bp, Artificial Sequence
  Description of Artificial Sequence: Synthetic oligonucleotide
  Target: DMPK; (+) strand; PAM type: YTN; PAM sequence: TTA
tcttatttttgagacagagt

SEQ ID NO: 19497 - DNA, 20 bp, Artificial Sequence
  Description of Artificial Sequence: Synthetic oligonucleotide
  Target: DMPK; (+) strand; PAM type: YTN; PAM sequence: CTT
atttttgagacagagtctct

SEQ ID NO: 19498 - DNA, 20 bp, Artificial Sequence
  Description of Artificial Sequence: Synthetic oligonucleotide
  Target: DMPK; (+) strand; PAM type: YTN; PAM sequence: TTA
tttttgagacagagtctctc

SEQ ID NO: 19499 - DNA, 20 bp, Artificial Sequence
  Description of Artificial Sequence: Synthetic oligonucleotide
  Target: DMPK; (+) strand; PAM type: YTN; PAM sequence: TTT
ttgagacagagtctctctcc

SEQ ID NO: 19500 - DNA, 20 bp, Artificial Sequence
  Description of Artificial Sequence: Synthetic oligonucleotide
  Target: DMPK; (+) strand; PAM type: YTN; PAM sequence: TTT
tgagacagagtctctctccg

SEQ ID NO: 19501 - DNA, 20 bp, Artificial Sequence
  Description of Artificial Sequence: Synthetic oligonucleotide
  Target: DMPK; (+) strand; PAM type: YTN; PAM sequence: TTT
gagacagagtctctctccgt

SEQ ID NO: 19502 - DNA, 20 bp, Artificial Sequence
  Description of Artificial Sequence: Synthetic oligonucleotide
  Target: DMPK; (+) strand; PAM type: YTN; PAM sequence: TTG
agacagagtctctctccgtt

SEQ ID NO: 19503 - DNA, 20 bp, Artificial Sequence
  Description of Artificial Sequence: Synthetic oligonucleotide
  Target: DMPK; (+) strand; PAM type: YTN; PAM sequence: CTC
tctccgttgcccaggctgga

SEQ ID NO: 19504 - DNA, 20 bp, Artificial Sequence
  Description of Artificial Sequence: Synthetic oligonucleotide
  Target: DMPK; (+) strand; PAM type: YTN; PAM sequence: CTC
tccgttgcccaggctggagt

SEQ ID NO: 19505 - DNA, 20 bp, Artificial Sequence
  Description of Artificial Sequence: Synthetic oligonucleotide
  Target: DMPK; (+) strand; PAM type: YTN; PAM sequence: CTC
cgttgcccaggctggagtgc

SEQ ID NO: 19506 - DNA, 20 bp, Artificial Sequence
  Description of Artificial Sequence: Synthetic oligonucleotide
  Target: DMPK; (+) strand; PAM type: YTN; PAM sequence: TTG
cccaggctggagtgcagtgg

SEQ ID NO: 19507 - DNA, 20 bp, Artificial Sequence
  Description of Artificial Sequence: Synthetic oligonucleotide
  Target: DMPK; (+) strand; PAM type: YTN; PAM sequence: CTG
gagtgcagtggcacaatcac

SEQ ID NO: 19508 - DNA, 20 bp, Artificial Sequence
  Description of Artificial Sequence: Synthetic oligonucleotide
  Target: DMPK; (+) strand; PAM type: YTN; PAM sequence: CTC
actgcagccttgacctcctg

SEQ ID NO: 19509 - DNA, 20 bp, Artificial Sequence
  Description of Artificial Sequence: Synthetic oligonucleotide
  Target: DMPK; (+) strand; PAM type: YTN; PAM sequence: CTG
cagccttgacctcctgggct

SEQ ID NO: 19510 - DNA, 20 bp, Artificial Sequence
  Description of Artificial Sequence: Synthetic oligonucleotide
  Target: DMPK; (+) strand; PAM type: YTN; PAM sequence: CTT
gacctcctgggctcaagccc

SEQ ID NO: 19511 - DNA, 20 bp, Artificial Sequence
  Description of Artificial Sequence: Synthetic oligonucleotide
  Target: DMPK; (+) strand; PAM type: YTN; PAM sequence: TTG
acctcctgggctcaagccca

SEQ ID NO: 19512 - DNA, 20 bp, Artificial Sequence
  Description of Artificial Sequence: Synthetic oligonucleotide
  Target: DMPK; (+) strand; PAM type: YTN; PAM sequence: CTC
ctgggctcaagcccacgtcg

SEQ ID NO: 19513 - DNA, 20 bp, Artificial Sequence
  Description of Artificial Sequence: Synthetic oligonucleotide
  Target: DMPK; (+) strand; PAM type: YTN; PAM sequence: CTG
ggctcaagcccacgtcggcc

SEQ ID NO: 19514 - DNA, 20 bp, Artificial Sequence
  Description of Artificial Sequence: Synthetic oligonucleotide
  Target: DMPK; (+) strand; PAM type: YTN; PAM sequence: CTC
aagcccacgtcggccaccct

SEQ ID NO: 19515 - DNA, 20 bp, Artificial Sequence
  Description of Artificial Sequence: Synthetic oligonucleotide
  Target: DMPK; (+) strand; PAM type: YTN; PAM sequence: CTA
gtagctgagtatacaggcat

SEQ ID NO: 19516 - DNA, 20 bp, Artificial Sequence
  Description of Artificial Sequence: Synthetic oligonucleotide
  Target: DMPK; (+) strand; PAM type: YTN; PAM sequence: CTG
agtatacaggcatgcgccac

SEQ ID NO: 19517 - DNA, 20 bp, Artificial Sequence
  Description of Artificial Sequence: Synthetic oligonucleotide
  Target: DMPK; (+) strand; PAM type: YTN; PAM sequence: TTT
ttaaaacatttttgtagaga

SEQ ID NO: 19518 - DNA, 20 bp, Artificial Sequence
  Description of Artificial Sequence: Synthetic oligonucleotide
  Target: DMPK; (+) strand; PAM type: YTN; PAM sequence: TTT
taaaacatttttgtagagac

SEQ ID NO: 19519 - DNA, 20 bp, Artificial Sequence
  Description of Artificial Sequence: Synthetic oligonucleotide
  Target: DMPK; (+) strand; PAM type: YTN; PAM sequence: TTT
aaaacatttttgtagagacg

SEQ ID NO: 19520 - DNA, 20 bp, Artificial Sequence
  Description of Artificial Sequence: Synthetic oligonucleotide
  Target: DMPK; (+) strand; PAM type: YTN; PAM sequence: TTA
aaacatttttgtagagacgg

SEQ ID NO: 19521 - DNA, 20 bp, Artificial Sequence
  Description of Artificial Sequence: Synthetic oligonucleotide
  Target: DMPK; (+) strand; PAM type: YTN; PAM sequence: TTT
ttgtagagacgggggtctca

SEQ ID NO: 19522 - DNA, 20 bp, Artificial Sequence
  Description of Artificial Sequence: Synthetic oligonucleotide
  Target: DMPK; (+) strand; PAM type: YTN; PAM sequence: TTT
tgtagagacgggggtctcac

SEQ ID NO: 19523 - DNA, 20 bp, Artificial Sequence
  Description of Artificial Sequence: Synthetic oligonucleotide
  Target: DMPK; (+) strand; PAM type: YTN; PAM sequence: TTT
gtagagacgggggtctcacc

SEQ ID NO: 19524 - DNA, 20 bp, Artificial Sequence
  Description of Artificial Sequence: Synthetic oligonucleotide
  Target: DMPK; (+) strand; PAM type: YTN; PAM sequence: TTG
tagagacgggggtctcacca

SEQ ID NO: 19525 - DNA, 20 bp, Artificial Sequence
  Description of Artificial Sequence: Synthetic oligonucleotide
  Target: DMPK; (+) strand; PAM type: YTN; PAM sequence: CTC
accacattgcccaggctggt

SEQ ID NO: 19526 - DNA, 20 bp, Artificial Sequence
  Description of Artificial Sequence: Synthetic oligonucleotide
  Target: DMPK; (+) strand; PAM type: YTN; PAM sequence: TTG
cccaggctggtctcgaactc

SEQ ID NO: 19527 - DNA, 20 bp, Artificial Sequence
  Description of Artificial Sequence: Synthetic oligonucleotide
  Target: DMPK; (+) strand; PAM type: YTN; PAM sequence: CTG
gtctcgaactcctgggctca

SEQ ID NO: 19528 - DNA, 20 bp, Artificial Sequence
  Description of Artificial Sequence: Synthetic oligonucleotide
  Target: DMPK; (+) strand; PAM type: YTN; PAM sequence: CTC
gaactcctgggctcaagcaa

SEQ ID NO: 19529 - DNA, 20 bp, Artificial Sequence
  Description of Artificial Sequence: Synthetic oligonucleotide
  Target: DMPK; (+) strand; PAM type: YTN; PAM sequence: CTC
ctgggctcaagcaatccacc

SEQ ID NO: 19530 - DNA, 20 bp, Artificial Sequence
  Description of Artificial Sequence: Synthetic oligonucleotide
  Target: DMPK; (+) strand; PAM type: YTN; PAM sequence: CTG
ggctcaagcaatccacccac

SEQ ID NO: 19531 - DNA, 20 bp, Artificial Sequence
  Description of Artificial Sequence: Synthetic oligonucleotide
  Target: DMPK; (+) strand; PAM type: YTN; PAM sequence: CTC
aagcaatccacccacttcgg

SEQ ID NO: 19532 - DNA, 20 bp, Artificial Sequence
  Description of Artificial Sequence: Synthetic oligonucleotide
  Target: DMPK; (+) strand; PAM type: YTN; PAM sequence: CTT
cggcctgccaaattgctggg

SEQ ID NO: 19533 - DNA, 20 bp, Artificial Sequence
  Description of Artificial Sequence: Synthetic oligonucleotide
  Target: DMPK; (+) strand; PAM type: YTN; PAM sequence: TTC
ggcctgccaaattgctgggg

SEQ ID NO: 19534 - DNA, 20 bp, Artificial Sequence
  Description of Artificial Sequence: Synthetic oligonucleotide
  Target: DMPK; (+) strand; PAM type: YTN; PAM sequence: CTG
ccaaattgctggggttacag

SEQ ID NO: 19535 - DNA, 20 bp, Artificial Sequence
  Description of Artificial Sequence: Synthetic oligonucleotide
  Target: DMPK; (+) strand; PAM type: YTN; PAM sequence: TTG
ctggggttacaggcgtgagc

SEQ ID NO: 19536 - DNA, 20 bp, Artificial Sequence
  Description of Artificial Sequence: Synthetic oligonucleotide
  Target: DMPK; (+) strand; PAM type: YTN; PAM sequence: CTG
gggttacaggcgtgagccac

SEQ ID NO: 19537 - DNA, 20 bp, Artificial Sequence
  Description of Artificial Sequence: Synthetic oligonucleotide
  Target: DMPK; (+) strand; PAM type: YTN; PAM sequence: TTA
caggcgtgagccaccgtgcc

SEQ ID NO: 19538 - DNA, 20 bp, Artificial Sequence
  Description of Artificial Sequence: Synthetic oligonucleotide
  Target: DMPK; (+) strand; PAM type: YTN; PAM sequence: CTG
gccccatcattttttcttgt

SEQ ID NO: 19539 - DNA, 20 bp, Artificial Sequence
  Description of Artificial Sequence: Synthetic oligonucleotide
  Target: DMPK; (+) strand; PAM type: YTN; PAM sequence: TTT
tttcttgtatcctgttgctt

SEQ ID NO: 19540 - DNA, 20 bp, Artificial Sequence
  Description of Artificial Sequence: Synthetic oligonucleotide
  Target: DMPK; (+) strand; PAM type: YTN; PAM sequence: TTT
ttcttgtatcctgttgcttc

SEQ ID NO: 19541 - DNA, 20 bp, Artificial Sequence
  Description of Artificial Sequence: Synthetic oligonucleotide
  Target: DMPK; (+) strand; PAM type: YTN; PAM sequence: TTT
tcttgtatcctgttgcttcc

SEQ ID NO: 19542 - DNA, 20 bp, Artificial Sequence
  Description of Artificial Sequence: Synthetic oligonucleotide
  Target: DMPK; (+) strand; PAM type: YTN; PAM sequence: TTT
cttgtatcctgttgcttccc

SEQ ID NO: 19543 - DNA, 20 bp, Artificial Sequence
  Description of Artificial Sequence: Synthetic oligonucleotide
  Target: DMPK; (+) strand; PAM type: YTN; PAM sequence: TTC
ttgtatcctgttgcttccct

SEQ ID NO: 19544 - DNA, 20 bp, Artificial Sequence
  Description of Artificial Sequence: Synthetic oligonucleotide
  Target: DMPK; (+) strand; PAM type: YTN; PAM sequence: CTT
gtatcctgttgcttcccttc

SEQ ID NO: 19545 - DNA, 20 bp, Artificial Sequence
  Description of Artificial Sequence: Synthetic oligonucleotide
  Target: DMPK; (+) strand; PAM type: YTN; PAM sequence: TTG
tatcctgttgcttcccttca

SEQ ID NO: 19546 - DNA, 20 bp, Artificial Sequence
  Description of Artificial Sequence: Synthetic oligonucleotide
  Target: DMPK; (+) strand; PAM type: YTN; PAM sequence: CTG
ttgcttcccttcagggcacc

SEQ ID NO: 19547 - DNA, 20 bp, Artificial Sequence
  Description of Artificial Sequence: Synthetic oligonucleotide
  Target: DMPK; (+) strand; PAM type: YTN; PAM sequence: TTG
cttcccttcagggcacctgc

SEQ ID NO: 19548 - DNA, 20 bp, Artificial Sequence
  Description of Artificial Sequence: Synthetic oligonucleotide
  Target: DMPK; (+) strand; PAM type: YTN; PAM sequence: CTT
cccttcagggcacctgccac

SEQ ID NO: 19549 - DNA, 20 bp, Artificial Sequence
  Description of Artificial Sequence: Synthetic oligonucleotide
  Target: DMPK; (+) strand; PAM type: YTN; PAM sequence: TTC
ccttcagggcacctgccaca

SEQ ID NO: 19550 - DNA, 20 bp, Artificial Sequence
  Description of Artificial Sequence: Synthetic oligonucleotide
  Target: DMPK; (+) strand; PAM type: YTN; PAM sequence: CTT
cagggcacctgccacactct

SEQ ID NO: 19551 - DNA, 20 bp, Artificial Sequence
  Description of Artificial Sequence: Synthetic oligonucleotide
  Target: DMPK; (+) strand; PAM type: YTN; PAM sequence: TTC
agggcacctgccacactctc

SEQ ID NO: 19552 - DNA, 20 bp, Artificial Sequence
  Description of Artificial Sequence: Synthetic oligonucleotide
  Target: DMPK; (+) strand; PAM type: YTN; PAM sequence: CTG
ccacactctccataattctc

SEQ ID NO: 19553 - DNA, 20 bp, Artificial Sequence
  Description of Artificial Sequence: Synthetic oligonucleotide
  Target: DMPK; (+) strand; PAM type: YTN; PAM sequence: CTC
tccataattctctaattctc

SEQ ID NO: 19554 - DNA, 20 bp, Artificial Sequence
  Description of Artificial Sequence: Synthetic oligonucleotide
  Target: DMPK; (+) strand; PAM type: YTN; PAM sequence: CTC
cataattctctaattctcta

SEQ ID NO: 19555 - DNA, 20 bp, Artificial Sequence
  Description of Artificial Sequence: Synthetic oligonucleotide
  Target: DMPK; (+) strand; PAM type: YTN; PAM sequence: TTC
tctaattctctagactgcaa

SEQ ID NO: 19556 - DNA, 20 bp, Artificial Sequence
  Description of Artificial Sequence: Synthetic oligonucleotide
  Target: DMPK; (+) strand; PAM type: YTN; PAM sequence: CTC
taattctctagactgcaact

SEQ ID NO: 19557 - DNA, 20 bp, Artificial Sequence
  Description of Artificial Sequence: Synthetic oligonucleotide
  Target: DMPK; (+) strand; PAM type: YTN; PAM sequence: CTA
attctctagactgcaactgg

SEQ ID NO: 19558 - DNA, 20 bp, Artificial Sequence
  Description of Artificial Sequence: Synthetic oligonucleotide
  Target: DMPK; (+) strand; PAM type: YTN; PAM sequence: TTC
tctagactgcaactggatga

SEQ ID NO: 19559 - DNA, 20 bp, Artificial Sequence
  Description of Artificial Sequence: Synthetic oligonucleotide
  Target: DMPK; (+) strand; PAM type: YTN; PAM sequence: CTC
tagactgcaactggatgagg

SEQ ID NO: 19560 - DNA, 20 bp, Artificial Sequence
  Description of Artificial Sequence: Synthetic oligonucleotide
  Target: DMPK; (+) strand; PAM type: YTN; PAM sequence: CTA
gactgcaactggatgagggc

SEQ ID NO: 19561 - DNA, 20 bp, Artificial Sequence
  Description of Artificial Sequence: Synthetic oligonucleotide
  Target: DMPK; (+) strand; PAM type: YTN; PAM sequence: CTG
caactggatgagggcaggga

SEQ ID NO: 19562 - DNA, 20 bp, Artificial Sequence
  Description of Artificial Sequence: Synthetic oligonucleotide
  Target: DMPK; (+) strand; PAM type: YTN; PAM sequence: CTG
gatgagggcagggaccagag

SEQ ID NO: 19563 - DNA, 20 bp, Artificial Sequence
  Description of Artificial Sequence: Synthetic oligonucleotide
  Target: DMPK; (+) strand; PAM type: YTN; PAM sequence: CTC
atctggtccgtgctggatcc

SEQ ID NO: 19564 - DNA, 20 bp, Artificial Sequence
  Description of Artificial Sequence: Synthetic oligonucleotide
  Target: DMPK; (+) strand; PAM type: YTN; PAM sequence: CTG
gtccgtgctggatccccagt

SEQ ID NO: 19565 - DNA, 20 bp, Artificial Sequence
  Description of Artificial Sequence: Synthetic oligonucleotide
  Target: DMPK; (+) strand; PAM type: YTN; PAM sequence: CTG
gatccccagtattgttcagc

SEQ ID NO: 19566 - DNA, 20 bp, Artificial Sequence
  Description of Artificial Sequence: Synthetic oligonucleotide
  Target: DMPK; (+) strand; PAM type: YTN; PAM sequence: TTG
ttcagcaaaagggcacccag

SEQ ID NO: 19567 - DNA, 20 bp, Artificial Sequence
  Description of Artificial Sequence: Synthetic oligonucleotide
  Target: DMPK; (+) strand; PAM type: YTN; PAM sequence: TTC
agcaaaagggcacccagagc

SEQ ID NO: 19568 - DNA, 20 bp, Artificial Sequence
  Description of Artificial Sequence: Synthetic oligonucleotide
  Target: DMPK; (+) strand; PAM type: YTN; PAM sequence: CTT
gttacacggtgaagagagac

SEQ ID NO: 19569 - DNA, 20 bp, Artificial Sequence
  Description of Artificial Sequence: Synthetic oligonucleotide
  Target: DMPK; (+) strand; PAM type: YTN; PAM sequence: TTG
ttacacggtgaagagagacg

SEQ ID NO: 19570 - DNA, 20 bp, Artificial Sequence
  Description of Artificial Sequence: Synthetic oligonucleotide
  Target: DMPK; (+) strand; PAM type: YTN; PAM sequence: TTA
cacggtgaagagagacggcc

SEQ ID NO: 19571 - DNA, 20 bp, Artificial Sequence
  Description of Artificial Sequence: Synthetic oligonucleotide
  Target: DMPK; (+) strand; PAM type: YTN; PAM sequence: CTA
agggaggaggagtcctctcc

SEQ ID NO: 19572 - DNA, 20 bp, Artificial Sequence
  Description of Artificial Sequence: Synthetic oligonucleotide
  Target: DMPK; (+) strand; PAM type: YTN; PAM sequence: CTC
tcctgcttctcatccctcca

SEQ ID NO: 19573 - DNA, 20 bp, Artificial Sequence
  Description of Artificial Sequence: Synthetic oligonucleotide
  Target: DMPK; (+) strand; PAM type: YTN; PAM sequence: CTC
ctgcttctcatccctccaag

SEQ ID NO: 19574 - DNA, 20 bp, Artificial Sequence
  Description of Artificial Sequence: Synthetic oligonucleotide
  Target: DMPK; (+) strand; PAM type: YTN; PAM sequence: CTG
cttctcatccctccaagtct

SEQ ID NO: 19575 - DNA, 20 bp, Artificial Sequence
  Description of Artificial Sequence: Synthetic oligonucleotide
  Target: DMPK; (+) strand; PAM type: YTN; PAM sequence: CTT
ctcatccctccaagtctcag

SEQ ID NO: 19576 - DNA, 20 bp, Artificial Sequence
  Description of Artificial Sequence: Synthetic oligonucleotide
  Target: DMPK; (+) strand; PAM type: YTN; PAM sequence: TTC
tcatccctccaagtctcagc

SEQ ID NO: 19577 - DNA, 20 bp, Artificial Sequence
  Description of Artificial Sequence: Synthetic oligonucleotide
  Target: DMPK; (+) strand; PAM type: YTN; PAM sequence: CTC
atccctccaagtctcagctc

SEQ ID NO: 19578 - DNA, 20 bp, Artificial Sequence
  Description of Artificial Sequence: Synthetic oligonucleotide
  Target: DMPK; (+) strand; PAM type: YTN; PAM sequence: CTC
caagtctcagctcagatagc

SEQ ID NO: 19579 - DNA, 20 bp, Artificial Sequence
  Description of Artificial Sequence: Synthetic oligonucleotide
  Target: DMPK; (+) strand; PAM type: YTN; PAM sequence: CTC
agctcagatagctccccact

SEQ ID NO: 19580 - DNA, 20 bp, Artificial Sequence
  Description of Artificial Sequence: Synthetic oligonucleotide
  Target: DMPK; (+) strand; PAM type: YTN; PAM sequence: CTC
agatagctccccactccaga

SEQ ID NO: 19581 - DNA, 20 bp, Artificial Sequence
  Description of Artificial Sequence: Synthetic oligonucleotide
  Target: DMPK; (+) strand; PAM type: YTN; PAM sequence: CTC
cccactccagaaagccctcc

SEQ ID NO: 19582 - DNA, 20 bp, Artificial Sequence
  Description of Artificial Sequence: Synthetic oligonucleotide
  Target: DMPK; (+) strand; PAM type: YTN; PAM sequence: CTC
cagaaagccctccaggacct

SEQ ID NO: 19583 - DNA, 20 bp, Artificial Sequence
  Description of Artificial Sequence: Synthetic oligonucleotide
  Target: DMPK; (+) strand; PAM type: YTN; PAM sequence: CTC
caggaccttccttgctgagt

SEQ ID NO: 19584 - DNA, 20 bp, Artificial Sequence
  Description of Artificial Sequence: Synthetic oligonucleotide
  Target: DMPK; (+) strand; PAM type: YTN; PAM sequence: CTT
ccttgctgagtcaggagtcc

SEQ ID NO: 19585 - DNA, 20 bp, Artificial Sequence
  Description of Artificial Sequence: Synthetic oligonucleotide
  Target: DMPK; (+) strand; PAM type: YTN; PAM sequence: TTC
cttgctgagtcaggagtccc

SEQ ID NO: 19586 - DNA, 20 bp, Artificial Sequence
  Description of Artificial Sequence: Synthetic oligonucleotide
  Target: DMPK; (+) strand; PAM type: YTN; PAM sequence: CTT
gctgagtcaggagtccccca

SEQ ID NO: 19587 - DNA, 20 bp, Artificial Sequence
  Description of Artificial Sequence: Synthetic oligonucleotide
  Target: DMPK; (+) strand; PAM type: YTN; PAM sequence: TTG
ctgagtcaggagtcccccac

SEQ ID NO: 19588 - DNA, 20 bp, Artificial Sequence
  Description of Artificial Sequence: Synthetic oligonucleotide
  Target: DMPK; (+) strand; PAM type: YTN; PAM sequence: CTG
agtcaggagtcccccacccc

SEQ ID NO: 19589 - DNA, 20 bp, Artificial Sequence
  Description of Artificial Sequence: Synthetic oligonucleotide
  Target: DMPK; (+) strand; PAM type: YTN; PAM sequence: CTG
cactccattgtctcagccct

SEQ ID NO: 19590 - DNA, 20 bp, Artificial Sequence
  Description of Artificial Sequence: Synthetic oligonucleotide
  Target: DMPK; (+) strand; PAM type: YTN; PAM sequence: CTC
cattgtctcagccctgatca

SEQ ID NO: 19591 - DNA, 20 bp, Artificial Sequence
  Description of Artificial Sequence: Synthetic oligonucleotide
  Target: DMPK; (+) strand; PAM type: YTN; PAM sequence: TTG
tctcagccctgatcactctg

SEQ ID NO: 19592 - DNA, 20 bp, Artificial Sequence
  Description of Artificial Sequence: Synthetic oligonucleotide
  Target: DMPK; (+) strand; PAM type: YTN; PAM sequence: CTC
agccctgatcactctggggc

SEQ ID NO: 19593 - DNA, 20 bp, Artificial Sequence
  Description of Artificial Sequence: Synthetic oligonucleotide
  Target: DMPK; (+) strand; PAM type: YTN; PAM sequence: CTG
atcactctggggccttactg

SEQ ID NO: 19594 - DNA, 20 bp, Artificial Sequence
  Description of Artificial Sequence: Synthetic oligonucleotide
  Target: DMPK; (+) strand; PAM type: YTN; PAM sequence: CTC
tggggccttactgtctgaag

SEQ ID NO: 19595 - DNA, 20 bp, Artificial Sequence
  Description of Artificial Sequence: Synthetic oligonucleotide
  Target: DMPK; (+) strand; PAM type: YTN; PAM sequence: CTG
gggccttactgtctgaagac

SEQ ID NO: 19596 - DNA, 20 bp, Artificial Sequence
  Description of Artificial Sequence: Synthetic oligonucleotide
  Target: DMPK; (+) strand; PAM type: YTN; PAM sequence: CTT
actgtctgaagactgctctg

SEQ ID NO: 19597 - DNA, 20 bp, Artificial Sequence
  Description of Artificial Sequence: Synthetic oligonucleotide
  Target: DMPK; (+) strand; PAM type: YTN; PAM sequence: TTA
ctgtctgaagactgctctgt

SEQ ID NO: 19598 - DNA, 20 bp, Artificial Sequence
  Description of Artificial Sequence: Synthetic oligonucleotide
  Target: DMPK; (+) strand; PAM type: YTN; PAM sequence: CTG
tctgaagactgctctgtgtt

SEQ ID NO: 19599 - DNA, 20 bp, Artificial Sequence
  Description of Artificial Sequence: Synthetic oligonucleotide
  Target: DMPK; (+) strand; PAM type: YTN; PAM sequence: CTG
aagactgctctgtgttcccc

SEQ ID NO: 19600 - DNA, 20 bp, Artificial Sequence
  Description of Artificial Sequence: Synthetic oligonucleotide
  Target: DMPK; (+) strand; PAM type: YTN; PAM sequence: CTG
ctctgtgttcccccactgga

SEQ ID NO: 19601 - DNA, 20 bp, Artificial Sequence
  Description of Artificial Sequence: Synthetic oligonucleotide
  Target: DMPK; (+) strand; PAM type: YTN; PAM sequence: CTC
tgtgttcccccactggactg

SEQ ID NO: 19602 - DNA, 20 bp, Artificial Sequence
  Description of Artificial Sequence: Synthetic oligonucleotide
  Target: DMPK; (+) strand; PAM type: YTN; PAM sequence: CTG
tgttcccccactggactgta

SEQ ID NO: 19603 - DNA, 20 bp, Artificial Sequence
  Description of Artificial Sequence: Synthetic oligonucleotide
  Target: DMPK; (+) strand; PAM type: YTN; PAM sequence: TTC
ccccactggactgtaagtct

SEQ ID NO: 19604 - DNA, 20 bp, Artificial Sequence
  Description of Artificial Sequence: Synthetic oligonucleotide
  Target: DMPK; (+) strand; PAM type: YTN; PAM sequence: CTG
gactgtaagtctaggtcact

SEQ ID NO: 19605 - DNA, 20 bp, Artificial Sequence
  Description of Artificial Sequence: Synthetic oligonucleotide
  Target: DMPK; (+) strand; PAM type: YTN; PAM sequence: CTG
taagtctaggtcactgctgg

SEQ ID NO: 19606 - DNA, 20 bp, Artificial Sequence
  Description of Artificial Sequence: Synthetic oligonucleotide
  Target: DMPK; (+) strand; PAM type: YTN; PAM sequence: CTA
ggtcactgctgggtcctcag

SEQ ID NO: 19607 - DNA, 20 bp, Artificial Sequence
  Description of Artificial Sequence: Synthetic oligonucleotide
  Target: DMPK; (+) strand; PAM type: YTN; PAM sequence: CTG
ctgggtcctcagtagtagat

SEQ ID NO: 19608 - DNA, 20 bp, Artificial Sequence
  Description of Artificial Sequence: Synthetic oligonucleotide
  Target: DMPK; (+) strand; PAM type: YTN; PAM sequence: CTG
ggtcctcagtagtagatggg

SEQ ID NO: 19609 - DNA, 20 bp, Artificial Sequence
  Description of Artificial Sequence: Synthetic oligonucleotide
  Target: DMPK; (+) strand; PAM type: YTN; PAM sequence: CTC
agtagtagatgggcacagag

SEQ ID NO: 19610 - DNA, 20 bp, Artificial Sequence
  Description of Artificial Sequence: Synthetic oligonucleotide
  Target: DMPK; (+) strand; PAM type: YTN; PAM sequence: CTC
tggggaatgagtgattcagg

SEQ ID NO: 19611 - DNA, 20 bp, Artificial Sequence
  Description of Artificial Sequence: Synthetic oligonucleotide
  Target: DMPK; (+) strand; PAM type: YTN; PAM sequence: CTG
gggaatgagtgattcaggac

SEQ ID NO: 19612 - DNA, 20 bp, Artificial Sequence
  Description of Artificial Sequence: Synthetic oligonucleotide
  Target: DMPK; (+) strand; PAM type: YTN; PAM sequence: TTC
aggaccccagaaggtaggca

SEQ ID NO: 19613 - DNA, 20 bp, Artificial Sequence
  Description of Artificial Sequence: Synthetic oligonucleotide
  Target: DMPK; (+) strand; PAM type: YTN; PAM sequence: CTG
tccttactccaactttatgg

SEQ ID NO: 19614 - DNA, 20 bp, Artificial Sequence
  Description of Artificial Sequence: Synthetic oligonucleotide
  Target: DMPK; (+) strand; PAM type: YTN; PAM sequence: CTT
actccaactttatggaggga

SEQ ID NO: 19615 - DNA, 20 bp, Artificial Sequence
  Description of Artificial Sequence: Synthetic oligonucleotide
  Target: DMPK; (+) strand; PAM type: YTN; PAM sequence: TTA
ctccaactttatggagggag

SEQ ID NO: 19616 - DNA, 20 bp, Artificial Sequence
  Description of Artificial Sequence: Synthetic oligonucleotide
  Target: DMPK; (+) strand; PAM type: YTN; PAM sequence: CTC
caactttatggagggagcat

SEQ ID NO: 19617 - DNA, 20 bp, Artificial Sequence
  Description of Artificial Sequence: Synthetic oligonucleotide
  Target: DMPK; (+) strand; PAM type: YTN; PAM sequence: CTT
tatggagggagcatggggag

SEQ ID NO: 19618 - DNA, 20 bp, Artificial Sequence
  Description of Artificial Sequence: Synthetic oligonucleotide
  Target: DMPK; (+) strand; PAM type: YTN; PAM sequence: TTT
atggagggagcatggggagg

SEQ ID NO: 19619 - DNA, 20 bp, Artificial Sequence
  Description of Artificial Sequence: Synthetic oligonucleotide
  Target: DMPK; (+) strand; PAM type: YTN; PAM sequence: TTA
tggagggagcatggggaggt

SEQ ID NO: 19620 - DNA, 20 bp, Artificial Sequence
  Description of Artificial Sequence: Synthetic oligonucleotide
  Target: DMPK; (+) strand; PAM type: YTN; PAM sequence: TTC
ccgcagccgagcaggggcca

SEQ ID NO: 19621 - DNA, 20 bp, Artificial Sequence
  Description of Artificial Sequence: Synthetic oligonucleotide
  Target: DMPK; (+) strand; PAM type: YTN; PAM sequence: CTA
ccccgcccccgctcaccatg

SEQ ID NO: 19622 - DNA, 20 bp, Artificial Sequence
  Description of Artificial Sequence: Synthetic oligonucleotide
  Target: DMPK; (+) strand; PAM type: YTN; PAM sequence: CTC
accatggcagtgagcccgtc

SEQ ID NO: 19623 - DNA, 20 bp, Artificial Sequence
  Description of Artificial Sequence: Synthetic oligonucleotide
  Target: DMPK; (+) strand; PAM type: YTN; PAM sequence: CTC
caccaagtcgaagttgcatg

SEQ ID NO: 19624 - DNA, 20 bp, Artificial Sequence
  Description of Artificial Sequence: Synthetic oligonucleotide
  Target: DMPK; (+) strand; PAM type: YTN; PAM sequence: TTG
catgtgtcggtggcaccttc

SEQ ID NO: 19625 - DNA, 20 bp, Artificial Sequence
  Description of Artificial Sequence: Synthetic oligonucleotide
  Target: DMPK; (+) strand; PAM type: YTN; PAM sequence: CTT
cgaaatccggtgtaaagggg

SEQ ID NO: 19626 - DNA, 20 bp, Artificial Sequence
  Description of Artificial Sequence: Synthetic oligonucleotide
  Target: DMPK; (+) strand; PAM type: YTN; PAM sequence: TTC
gaaatccggtgtaaaggggg

SEQ ID NO: 19627 - DNA, 20 bp, Artificial Sequence
  Description of Artificial Sequence: Synthetic oligonucleotide
  Target: DMPK; (+) strand; PAM type: YTN; PAM sequence: CTG
tcccggagaccatcccagtc

SEQ ID NO: 19628 - DNA, 20 bp, Artificial Sequence
  Description of Artificial Sequence: Synthetic oligonucleotide
  Target: DMPK; (+) strand; PAM type: YTN; PAM sequence: CTG
ctccaccccggcccagccgt

SEQ ID NO: 19629 - DNA, 20 bp, Artificial Sequence
  Description of Artificial Sequence: Synthetic oligonucleotide
  Target: DMPK; (+) strand; PAM type: YTN; PAM sequence: CTC
caccccggcccagccgtgtc

SEQ ID NO: 19630 - DNA, 20 bp, Artificial Sequence
  Description of Artificial Sequence: Synthetic oligonucleotide
  Target: DMPK; (+) strand; PAM type: YTN; PAM sequence: CTC
cgggggacacagcaaccgct

SEQ ID NO: 19631 - DNA, 20 bp, Artificial Sequence
  Description of Artificial Sequence: Synthetic oligonucleotide
  Target: DMPK; (+) strand; PAM type: YTN; PAM sequence: CTG
aatgaagtctcgagcctcct

SEQ ID NO: 19632 - DNA, 20 bp, Artificial Sequence
  Description of Artificial Sequence: Synthetic oligonucleotide
  Target: DMPK; (+) strand; PAM type: YTN; PAM sequence: CTC
gagcctcctcagggacccct

SEQ ID NO: 19633 - DNA, 20 bp, Artificial Sequence
  Description of Artificial Sequence: Synthetic oligonucleotide
  Target: DMPK; (+) strand; PAM type: YTN; PAM sequence: CTC
ctcagggaccccttcgtcca

SEQ ID NO: 19634 - DNA, 20 bp, Artificial Sequence
  Description of Artificial Sequence: Synthetic oligonucleotide
  Target: DMPK; (+) strand; PAM type: YTN; PAM sequence: CTC
agggaccccttcgtccacca

SEQ ID NO: 19635 - DNA, 20 bp, Artificial Sequence
  Description of Artificial Sequence: Synthetic oligonucleotide
  Target: DMPK; (+) strand; PAM type: YTN; PAM sequence: CTT
cgtccaccagcggcagagag

SEQ ID NO: 19636 - DNA, 20 bp, Artificial Sequence
  Description of Artificial Sequence: Synthetic oligonucleotide
  Target: DMPK; (+) strand; PAM type: YTN; PAM sequence: TTC
gtccaccagcggcagagaga

SEQ ID NO: 19637 - DNA, 20 bp, Artificial Sequence
  Description of Artificial Sequence: Synthetic oligonucleotide
  Target: DMPK; (+) strand; PAM type: YTN; PAM sequence: CTC
ctgctcagagggagaggagg

SEQ ID NO: 19638 - DNA, 20 bp, Artificial Sequence
  Description of Artificial Sequence: Synthetic oligonucleotide
  Target: DMPK; (+) strand; PAM type: YTN; PAM sequence: CTG
ctcagagggagaggaggcga

SEQ ID NO: 19639 - DNA, 20 bp, Artificial Sequence
  Description of Artificial Sequence: Synthetic oligonucleotide
  Target: DMPK; (+) strand; PAM type: YTN; PAM sequence: CTC
agagggagaggaggcgatag

SEQ ID NO: 19640 - DNA, 20 bp, Artificial Sequence
  Description of Artificial Sequence: Synthetic oligonucleotide
  Target: DMPK; (+) strand; PAM type: YTN; PAM sequence: CTG
ggagcgcctaccgggagagg

SEQ ID NO: 19641 - DNA, 20 bp, Artificial Sequence
  Description of Artificial Sequence: Synthetic oligonucleotide
  Target: DMPK; (+) strand; PAM type: YTN; PAM sequence: CTA
ccgggagaggccaggtctcc

SEQ ID NO: 19642 - DNA, 20 bp, Artificial Sequence
  Description of Artificial Sequence: Synthetic oligonucleotide
  Target: DMPK; (+) strand; PAM type: YTN; PAM sequence: CTC
cctgcggccgtgctcacctt

SEQ ID NO: 19643 - DNA, 20 bp, Artificial Sequence
  Description of Artificial Sequence: Synthetic oligonucleotide
  Target: DMPK; (+) strand; PAM type: YTN; PAM sequence: CTG
cggccgtgctcaccttgtag

SEQ ID NO: 19644 - DNA, 20 bp, Artificial Sequence
  Description of Artificial Sequence: Synthetic oligonucleotide
  Target: DMPK; (+) strand; PAM type: YTN; PAM sequence: CTC
accttgtagtggacgatctt

SEQ ID NO: 19645 - DNA, 20 bp, Artificial Sequence
  Description of Artificial Sequence: Synthetic oligonucleotide
  Target: DMPK; (+) strand; PAM type: YTN; PAM sequence: CTT
gtagtggacgatcttgccat

SEQ ID NO: 19646 - DNA, 20 bp, Artificial Sequence
  Description of Artificial Sequence: Synthetic oligonucleotide
  Target: DMPK; (+) strand; PAM type: YTN; PAM sequence: TTG
tagtggacgatcttgccata

SEQ ID NO: 19647 - DNA, 20 bp, Artificial Sequence
  Description of Artificial Sequence: Synthetic oligonucleotide
  Target: DMPK; (+) strand; PAM type: YTN; PAM sequence: CTT
gccataggtctccgccgtgg

SEQ ID NO: 19648 - DNA, 20 bp, Artificial Sequence
  Description of Artificial Sequence: Synthetic oligonucleotide
  Target: DMPK; (+) strand; PAM type: YTN; PAM sequence: TTG
ccataggtctccgccgtgga

SEQ ID NO: 19649 - DNA, 20 bp, Artificial Sequence
  Description of Artificial Sequence: Synthetic oligonucleotide
  Target: DMPK; (+) strand; PAM type: YTN; PAM sequence: CTC
cgccgtggaatccgcgtaga

SEQ ID NO: 19650 - DNA, 20 bp, Artificial Sequence
  Description of Artificial Sequence: Synthetic oligonucleotide
  Target: DMPK; (+) strand; PAM type: YTN; PAM sequence: CTG
cccatagaacatttcatagg

SEQ ID NO: 19651 - DNA, 20 bp, Artificial Sequence
  Description of Artificial Sequence: Synthetic oligonucleotide
  Target: DMPK; (+) strand; PAM type: YTN; PAM sequence: TTT
cataggcgaatacacccagc

SEQ ID NO: 19652 - DNA, 20 bp, Artificial Sequence
  Description of Artificial Sequence: Synthetic oligonucleotide
  Target: DMPK; (+) strand; PAM type: YTN; PAM sequence: TTC
ataggcgaatacacccagcg

SEQ ID NO: 19653 - DNA, 20 bp, Artificial Sequence
  Description of Artificial Sequence: Synthetic oligonucleotide
  Target: DMPK; (+) strand; PAM type: YTN; PAM sequence: CTC
gggcccgtagctgcctgtcc

SEQ ID NO: 19654 - DNA, 20 bp, Artificial Sequence
  Description of Artificial Sequence: Synthetic oligonucleotide
  Target: DMPK; (+) strand; PAM type: YTN; PAM sequence: CTG
cctgtcccaggcccaccgcc

SEQ ID NO: 19655 - DNA, 20 bp, Artificial Sequence
  Description of Artificial Sequence: Synthetic oligonucleotide
  Target: DMPK; (+) strand; PAM type: YTN; PAM sequence: CTG
tcccaggcccaccgcccaca

SEQ ID NO: 19656 - DNA, 20 bp, Artificial Sequence
  Description of Artificial Sequence: Synthetic oligonucleotide
  Target: DMPK; (+) strand; PAM type: YTN; PAM sequence: CTG
caggatctcgggggacaggt

SEQ ID NO: 19657 - DNA, 20 bp, Artificial Sequence
  Description of Artificial Sequence: Synthetic oligonucleotide
  Target: DMPK; (+) strand; PAM type: YTN; PAM sequence: CTC
gggggacaggtagtctgggg

SEQ ID NO: 19658 - DNA, 20 bp, Artificial Sequence
  Description of Artificial Sequence: Synthetic oligonucleotide
  Target: DMPK; (+) strand; PAM type: YTN; PAM sequence: CTG
gggtgcccacagccaccagc

SEQ ID NO: 19659 - DNA, 20 bp, Artificial Sequence
  Description of Artificial Sequence: Synthetic oligonucleotide
  Target: DMPK; (+) strand; PAM type: YTN; PAM sequence: CTG
gaccaaaaggagcagagcga

SEQ ID NO: 19660 - DNA, 20 bp, Artificial Sequence
  Description of Artificial Sequence: Synthetic oligonucleotide
  Target: DMPK; (+) strand; PAM type: YTN; PAM sequence: CTT
gggcccacccctctgggccc

SEQ ID NO: 19661 - DNA, 20 bp, Artificial Sequence
  Description of Artificial Sequence: Synthetic oligonucleotide
  Target: DMPK; (+) strand; PAM type: YTN; PAM sequence: TTG
ggcccacccctctgggccca

SEQ ID NO: 19662 - DNA, 20 bp, Artificial Sequence
  Description of Artificial Sequence: Synthetic oligonucleotide
  Target: DMPK; (+) strand; PAM type: YTN; PAM sequence: CTC
tgggcccaccagctctgggc

SEQ ID NO: 19663 - DNA, 20 bp, Artificial Sequence
  Description of Artificial Sequence: Synthetic oligonucleotide
  Target: DMPK; (+) strand; PAM type: YTN; PAM sequence: CTG
ggcccaccagctctgggccc

SEQ ID NO: 19664 - DNA, 20 bp, Artificial Sequence
  Description of Artificial Sequence: Synthetic oligonucleotide
  Target: DMPK; (+) strand; PAM type: YTN; PAM sequence: CTC
tgggccctccttccaaccac

SEQ ID NO: 19665 - DNA, 20 bp, Artificial Sequence
  Description of Artificial Sequence: Synthetic oligonucleotide
  Target: DMPK; (+) strand; PAM type: YTN; PAM sequence: CTG
ggccctccttccaaccactc

SEQ ID NO: 19666 - DNA, 20 bp, Artificial Sequence
  Description of Artificial Sequence: Synthetic oligonucleotide
  Target: DMPK; (+) strand; PAM type: YTN; PAM sequence: CTC
cttccaaccactccccaaat

SEQ ID NO: 19667 - DNA, 20 bp, Artificial Sequence
  Description of Artificial Sequence: Synthetic oligonucleotide
  Target: DMPK; (+) strand; PAM type: YTN; PAM sequence: CTT
ccaaccactccccaaatgct

SEQ ID NO: 19668 - DNA, 20 bp, Artificial Sequence
  Description of Artificial Sequence: Synthetic oligonucleotide
  Target: DMPK; (+) strand; PAM type: YTN; PAM sequence: TTC
caaccactccccaaatgctt

SEQ ID NO: 19669 - DNA, 20 bp, Artificial Sequence
  Description of Artificial Sequence: Synthetic oligonucleotide
  Target: DMPK; (+) strand; PAM type: YTN; PAM sequence: CTC
cccaaatgcttagcccctcc

SEQ ID NO: 19670 - DNA, 20 bp, Artificial Sequence
  Description of Artificial Sequence: Synthetic oligonucleotide
  Target: DMPK; (+) strand; PAM type: YTN; PAM sequence: CTT
agcccctccctctgcctggt

SEQ ID NO: 19671 - DNA, 20 bp, Artificial Sequence
  Description of Artificial Sequence: Synthetic oligonucleotide
  Target: DMPK; (+) strand; PAM type: YTN; PAM sequence: TTA
gcccctccctctgcctggtc

SEQ ID NO: 19672 - DNA, 20 bp, Artificial Sequence
  Description of Artificial Sequence: Synthetic oligonucleotide
  Target: DMPK; (+) strand; PAM type: YTN; PAM sequence: CTC
cctctgcctggtctaatact

SEQ ID NO: 19673 - DNA, 20 bp, Artificial Sequence
  Description of Artificial Sequence: Synthetic oligonucleotide
  Target: DMPK; (+) strand; PAM type: YTN; PAM sequence: CTC
tgcctggtctaatactccgc

SEQ ID NO: 19674 - DNA, 20 bp, Artificial Sequence
  Description of Artificial Sequence: Synthetic oligonucleotide
  Target: DMPK; (+) strand; PAM type: YTN; PAM sequence: CTG
cctggtctaatactccgcca

SEQ ID NO: 19675 - DNA, 20 bp, Artificial Sequence
  Description of Artificial Sequence: Synthetic oligonucleotide
  Target: DMPK; (+) strand; PAM type: YTN; PAM sequence: CTG
gtctaatactccgccacaca

SEQ ID NO: 19676 - DNA, 20 bp, Artificial Sequence
  Description of Artificial Sequence: Synthetic oligonucleotide
  Target: DMPK; (+) strand; PAM type: YTN; PAM sequence: CTA
atactccgccacacagatgc

SEQ ID NO: 19677 - DNA, 20 bp, Artificial Sequence
  Description of Artificial Sequence: Synthetic oligonucleotide
  Target: DMPK; (+) strand; PAM type: YTN; PAM sequence: CTC
cgccacacagatgcacactt

SEQ ID NO: 19678 - DNA, 20 bp, Artificial Sequence
  Description of Artificial Sequence: Synthetic oligonucleotide
  Target: DMPK; (+) strand; PAM type: YTN; PAM sequence: CTT
aagcctgggtcacaccacct

SEQ ID NO: 19679 - DNA, 20 bp, Artificial Sequence
  Description of Artificial Sequence: Synthetic oligonucleotide
  Target: DMPK; (+) strand; PAM type: YTN; PAM sequence: TTA
agcctgggtcacaccacctc

SEQ ID NO: 19680 - DNA, 20 bp, Artificial Sequence
  Description of Artificial Sequence: Synthetic oligonucleotide
  Target: DMPK; (+) strand; PAM type: YTN; PAM sequence: CTG
ggtcacaccacctcttttcc

SEQ ID NO: 19681 - DNA, 20 bp, Artificial Sequence
  Description of Artificial Sequence: Synthetic oligonucleotide
  Target: DMPK; (+) strand; PAM type: YTN; PAM sequence: CTC
ttttcccctccaaatccagt

SEQ ID NO: 19682 - DNA, 20 bp, Artificial Sequence
  Description of Artificial Sequence: Synthetic oligonucleotide
  Target: DMPK; (+) strand; PAM type: YTN; PAM sequence: CTT
ttcccctccaaatccagtcc

SEQ ID NO: 19683 - DNA, 20 bp, Artificial Sequence
  Description of Artificial Sequence: Synthetic oligonucleotide
  Target: DMPK; (+) strand; PAM type: YTN; PAM sequence: TTT
tcccctccaaatccagtccc

SEQ ID NO: 19684 - DNA, 20 bp, Artificial Sequence
  Description of Artificial Sequence: Synthetic oligonucleotide
  Target: DMPK; (+) strand; PAM type: YTN; PAM sequence: TTT
cccctccaaatccagtcccg

SEQ ID NO: 19685 - DNA, 20 bp, Artificial Sequence
  Description of Artificial Sequence: Synthetic oligonucleotide
  Target: DMPK; (+) strand; PAM type: YTN; PAM sequence: TTC
ccctccaaatccagtcccgc

SEQ ID NO: 19686 - DNA, 20 bp, Artificial Sequence
  Description of Artificial Sequence: Synthetic oligonucleotide
  Target: DMPK; (+) strand; PAM type: YTN; PAM sequence: CTC
caaatccagtcccgctccca

SEQ ID NO: 19687 - DNA, 20 bp, Artificial Sequence
  Description of Artificial Sequence: Synthetic oligonucleotide
  Target: DMPK; (+) strand; PAM type: YTN; PAM sequence: CTC
ccacactctgtgccttccat

SEQ ID NO: 19688 - DNA, 20 bp, Artificial Sequence
  Description of Artificial Sequence: Synthetic oligonucleotide
  Target: DMPK; (+) strand; PAM type: YTN; PAM sequence: CTC
tgtgccttccatccctcatc

SEQ ID NO: 19689 - DNA, 20 bp, Artificial Sequence
  Description of Artificial Sequence: Synthetic oligonucleotide
  Target: DMPK; (+) strand; PAM type: YTN; PAM sequence: CTG
tgccttccatccctcatcag

SEQ ID NO: 19690 - DNA, 20 bp, Artificial Sequence
  Description of Artificial Sequence: Synthetic oligonucleotide
  Target: DMPK; (+) strand; PAM type: YTN; PAM sequence: CTT
ccatccctcatcagcagccc

SEQ ID NO: 19691 - DNA, 20 bp, Artificial Sequence
  Description of Artificial Sequence: Synthetic oligonucleotide
  Target: DMPK; (+) strand; PAM type: YTN; PAM sequence: TTC
catccctcatcagcagcccc

SEQ ID NO: 19692 - DNA, 20 bp, Artificial Sequence
  Description of Artificial Sequence: Synthetic oligonucleotide
  Target: DMPK; (+) strand; PAM type: YTN; PAM sequence: CTC
atcagcagccccagttgctc

SEQ ID NO: 19693 - DNA, 20 bp, Artificial Sequence
  Description of Artificial Sequence: Synthetic oligonucleotide
  Target: DMPK; (+) strand; PAM type: YTN; PAM sequence: TTG
ctctgtggccagggcactgg

SEQ ID NO: 19694 - DNA, 20 bp, Artificial Sequence
  Description of Artificial Sequence: Synthetic oligonucleotide
  Target: DMPK; (+) strand; PAM type: YTN; PAM sequence: CTC
tgtggccagggcactggctc

SEQ ID NO: 19695 - DNA, 20 bp, Artificial Sequence
  Description of Artificial Sequence: Synthetic oligonucleotide
  Target: DMPK; (+) strand; PAM type: YTN; PAM sequence: CTG
tggccagggcactggctcac

SEQ ID NO: 19696 - DNA, 20 bp, Artificial Sequence
  Description of Artificial Sequence: Synthetic oligonucleotide
  Target: DMPK; (+) strand; PAM type: YTN; PAM sequence: CTG
gctcaccgttccatctgccc

SEQ ID NO: 19697 - DNA, 20 bp, Artificial Sequence
  Description of Artificial Sequence: Synthetic oligonucleotide
  Target: DMPK; (+) strand; PAM type: YTN; PAM sequence: CTC
accgttccatctgcccgcag

SEQ ID NO: 19698 - DNA, 20 bp, Artificial Sequence
  Description of Artificial Sequence: Synthetic oligonucleotide
  Target: DMPK; (+) strand; PAM type: YTN; PAM sequence: TTC
catctgcccgcagcttgagg

SEQ ID NO: 19699 - DNA, 20 bp, Artificial Sequence
  Description of Artificial Sequence: Synthetic oligonucleotide
  Target: DMPK; (+) strand; PAM type: YTN; PAM sequence: CTG
cccgcagcttgaggcaagag

SEQ ID NO: 19700 - DNA, 20 bp, Artificial Sequence
  Description of Artificial Sequence: Synthetic oligonucleotide
  Target: DMPK; (+) strand; PAM type: YTN; PAM sequence: CTT
gaggcaagagccgaagtcgg

SEQ ID NO: 19701 - DNA, 20 bp, Artificial Sequence
  Description of Artificial Sequence: Synthetic oligonucleotide
  Target: DMPK; (+) strand; PAM type: YTN; PAM sequence: TTG
aggcaagagccgaagtcggc

SEQ ID NO: 19702 - DNA, 20 bp, Artificial Sequence
  Description of Artificial Sequence: Synthetic oligonucleotide
  Target: DMPK; (+) strand; PAM type: YTN; PAM sequence: TTG
tcgggtttgatgtccctgca

SEQ ID NO: 19703 - DNA, 20 bp, Artificial Sequence
  Description of Artificial Sequence: Synthetic oligonucleotide
  Target: DMPK; (+) strand; PAM type: YTN; PAM sequence: TTT
gatgtccctgcacggaggaa

SEQ ID NO: 19704 - DNA, 20 bp, Artificial Sequence
  Description of Artificial Sequence: Synthetic oligonucleotide
  Target: DMPK; (+) strand; PAM type: YTN; PAM sequence: TTG
atgtccctgcacggaggaaa

SEQ ID NO: 19705 - DNA, 20 bp, Artificial Sequence
  Description of Artificial Sequence: Synthetic oligonucleotide
  Target: DMPK; (+) strand; PAM type: YTN; PAM sequence: CTG
cacggaggaaaagagaaggg

SEQ ID NO: 19706 - DNA, 20 bp, Artificial Sequence
  Description of Artificial Sequence: Synthetic oligonucleotide
  Target: DMPK; (+) strand; PAM type: YTN; PAM sequence: CTC
ccttctgtggtcccaccagg

SEQ ID NO: 19707 - DNA, 20 bp, Artificial Sequence
  Description of Artificial Sequence: Synthetic oligonucleotide
  Target: DMPK; (+) strand; PAM type: YTN; PAM sequence: CTT
ctgtggtcccaccaggctcc

SEQ ID NO: 19708 - DNA, 20 bp, Artificial Sequence
  Description of Artificial Sequence: Synthetic oligonucleotide
  Target: DMPK; (+) strand; PAM type: YTN; PAM sequence: TTC
tgtggtcccaccaggctccg

SEQ ID NO: 19709 - DNA, 20 bp, Artificial Sequence
  Description of Artificial Sequence: Synthetic oligonucleotide
  Target: DMPK; (+) strand; PAM type: YTN; PAM sequence: CTG
tggtcccaccaggctccgcc

SEQ ID NO: 19710 - DNA, 20 bp, Artificial Sequence
  Description of Artificial Sequence: Synthetic oligonucleotide
  Target: DMPK; (+) strand; PAM type: YTN; PAM sequence: CTC
cgcccctccgggcagtgcca

SEQ ID NO: 19711 - DNA, 20 bp, Artificial Sequence
  Description of Artificial Sequence: Synthetic oligonucleotide
  Target: DMPK; (+) strand; PAM type: YTN; PAM sequence: CTC
cgggcagtgccacctgggac

SEQ ID NO: 19712 - DNA, 20 bp, Artificial Sequence
  Description of Artificial Sequence: Synthetic oligonucleotide
  Target: DMPK; (+) strand; PAM type: YTN; PAM sequence: CTG
ggaccccacttcctcgggtt

SEQ ID NO: 19713 - DNA, 20 bp, Artificial Sequence
  Description of Artificial Sequence: Synthetic oligonucleotide
  Target: DMPK; (+) strand; PAM type: YTN; PAM sequence: CTT
cctcgggttccgcccctgta

SEQ ID NO: 19714 - DNA, 20 bp, Artificial Sequence
  Description of Artificial Sequence: Synthetic oligonucleotide
  Target: DMPK; (+) strand; PAM type: YTN; PAM sequence: TTC
ctcgggttccgcccctgtag

SEQ ID NO: 19715 - DNA, 20 bp, Artificial Sequence
  Description of Artificial Sequence: Synthetic oligonucleotide
  Target: DMPK; (+) strand; PAM type: YTN; PAM sequence: CTC
gggttccgcccctgtagggc

SEQ ID NO: 19716 - DNA, 20 bp, Artificial Sequence
  Description of Artificial Sequence: Synthetic oligonucleotide
  Target: DMPK; (+) strand; PAM type: YTN; PAM sequence: TTC
cgcccctgtagggcttctac

SEQ ID NO: 19717 - DNA, 20 bp, Artificial Sequence
  Description of Artificial Sequence: Synthetic oligonucleotide
  Target: DMPK; (+) strand; PAM type: YTN; PAM sequence: CTG
tagggcttctacagttctga

SEQ ID NO: 19718 - DNA, 20 bp, Artificial Sequence
  Description of Artificial Sequence: Synthetic oligonucleotide
  Target: DMPK; (+) strand; PAM type: YTN; PAM sequence: CTT
ctacagttctgacccctact

SEQ ID NO: 19719 - DNA, 20 bp, Artificial Sequence
  Description of Artificial Sequence: Synthetic oligonucleotide
  Target: DMPK; (+) strand; PAM type: YTN; PAM sequence: TTC
tacagttctgacccctactc

SEQ ID NO: 19720 - DNA, 20 bp, Artificial Sequence
  Description of Artificial Sequence: Synthetic oligonucleotide
  Target: DMPK; (+) strand; PAM type: YTN; PAM sequence: CTA
cagttctgacccctactccc

SEQ ID NO: 19721 - DNA, 20 bp, Artificial Sequence
  Description of Artificial Sequence: Synthetic oligonucleotide
  Target: DMPK; (+) strand; PAM type: YTN; PAM sequence: TTC
tgacccctactcccaggcac

SEQ ID NO: 19722 - DNA, 20 bp, Artificial Sequence
  Description of Artificial Sequence: Synthetic oligonucleotide
  Target: DMPK; (+) strand; PAM type: YTN; PAM sequence: CTG
acccctactcccaggcaccc

SEQ ID NO: 19723 - DNA, 20 bp, Artificial Sequence
  Description of Artificial Sequence: Synthetic oligonucleotide
  Target: DMPK; (+) strand; PAM type: YTN; PAM sequence: CTA
ctcccaggcaccccccggtg

SEQ ID NO: 19724 - DNA, 20 bp, Artificial Sequence
  Description of Artificial Sequence: Synthetic oligonucleotide
  Target: DMPK; (+) strand; PAM type: YTN; PAM sequence: CTC
ccaggcaccccccggtgggc

SEQ ID NO: 19725 - DNA, 20 bp, Artificial Sequence
  Description of Artificial Sequence: Synthetic oligonucleotide
  Target: DMPK; (+) strand; PAM type: YTN; PAM sequence: CTC
tccaggccctggcctctctg

SEQ ID NO: 19726 - DNA, 20 bp, Artificial Sequence
  Description of Artificial Sequence: Synthetic oligonucleotide
  Target: DMPK; (+) strand; PAM type: YTN; PAM sequence: CTC
caggccctggcctctctggg

SEQ ID NO: 19727 - DNA, 20 bp, Artificial Sequence
  Description of Artificial Sequence: Synthetic oligonucleotide
  Target: DMPK; (+) strand; PAM type: YTN; PAM sequence: CTG
gcctctctgggctctgacct

SEQ ID NO: 19728 - DNA, 20 bp, Artificial Sequence
  Description of Artificial Sequence: Synthetic oligonucleotide
  Target: DMPK; (+) strand; PAM type: YTN; PAM sequence: CTC
tctgggctctgaccttccaa

SEQ ID NO: 19729 - DNA, 20 bp, Artificial Sequence
  Description of Artificial Sequence: Synthetic oligonucleotide
  Target: DMPK; (+) strand; PAM type: YTN; PAM sequence: CTC
tgggctctgaccttccaaga

SEQ ID NO: 19730 - DNA, 20 bp, Artificial Sequence
  Description of Artificial Sequence: Synthetic oligonucleotide
  Target: DMPK; (+) strand; PAM type: YTN; PAM sequence: CTG
ggctctgaccttccaagaac

SEQ ID NO: 19731 - DNA, 20 bp, Artificial Sequence
  Description of Artificial Sequence: Synthetic oligonucleotide
  Target: DMPK; (+) strand; PAM type: YTN; PAM sequence: CTC
tgaccttccaagaacccggc

SEQ ID NO: 19732 - DNA, 20 bp, Artificial Sequence
  Description of Artificial Sequence: Synthetic oligonucleotide
  Target: DMPK; (+) strand; PAM type: YTN; PAM sequence: CTG
accttccaagaacccggcca

SEQ ID NO: 19733 - DNA, 20 bp, Artificial Sequence
  Description of Artificial Sequence: Synthetic oligonucleotide
  Target: DMPK; (+) strand; PAM type: YTN; PAM sequence: CTT
ccaagaacccggccagggaa

SEQ ID NO: 19734 - DNA, 20 bp, Artificial Sequence
  Description of Artificial Sequence: Synthetic oligonucleotide
  Target: DMPK; (+) strand; PAM type: YTN; PAM sequence: TTC
caagaacccggccagggaac

SEQ ID NO: 19735 - DNA, 20 bp, Artificial Sequence
  Description of Artificial Sequence: Synthetic oligonucleotide
  Target: DMPK; (+) strand; PAM type: YTN; PAM sequence: CTT
gctatcccctcggccatgct

SEQ ID NO: 19736 - DNA, 20 bp, Artificial Sequence
  Description of Artificial Sequence: Synthetic oligonucleotide
  Target: DMPK; (+) strand; PAM type: YTN; PAM sequence: TTG
ctatcccctcggccatgctg

SEQ ID NO: 19737 - DNA, 20 bp, Artificial Sequence
  Description of Artificial Sequence: Synthetic oligonucleotide
  Target: DMPK; (+) strand; PAM type: YTN; PAM sequence: CTA
tcccctcggccatgctgcac

SEQ ID NO: 19738 - DNA, 20 bp, Artificial Sequence
  Description of Artificial Sequence: Synthetic oligonucleotide
  Target: DMPK; (+) strand; PAM type: YTN; PAM sequence: CTC
ggccatgctgcacccacctg

SEQ ID NO: 19739 - DNA, 20 bp, Artificial Sequence
  Description of Artificial Sequence: Synthetic oligonucleotide
  Target: DMPK; (+) strand; PAM type: YTN; PAM sequence: CTG
cacccacctgtgcacgtagc

SEQ ID NO: 19740 - DNA, 20 bp, Artificial Sequence
  Description of Artificial Sequence: Synthetic oligonucleotide
  Target: DMPK; (+) strand; PAM type: YTN; PAM sequence: CTG
tgcacgtagccaagccggtg

SEQ ID NO: 19741 - DNA, 20 bp, Artificial Sequence
  Description of Artificial Sequence: Synthetic oligonucleotide
  Target: DMPK; (+) strand; PAM type: YTN; PAM sequence: CTA
tggccatgacaatctccgcc

SEQ ID NO: 19742 - DNA, 20 bp, Artificial Sequence
  Description of Artificial Sequence: Synthetic oligonucleotide
  Target: DMPK; (+) strand; PAM type: YTN; PAM sequence: CTC
cgccaggtagaagcgcgcca

SEQ ID NO: 19743 - DNA, 20 bp, Artificial Sequence
  Description of Artificial Sequence: Synthetic oligonucleotide
  Target: DMPK; (+) strand; PAM type: YTN; PAM sequence: CTC
ggccggaatccgctccccaa

SEQ ID NO: 19744 - DNA, 20 bp, Artificial Sequence
  Description of Artificial Sequence: Synthetic oligonucleotide
  Target: DMPK; (+) strand; PAM type: YTN; PAM sequence: CTC
cccaaacttgctcagcagtg

SEQ ID NO: 19745 - DNA, 20 bp, Artificial Sequence
  Description of Artificial Sequence: Synthetic oligonucleotide
  Target: DMPK; (+) strand; PAM type: YTN; PAM sequence: CTT
gctcagcagtgtcagcaggt

SEQ ID NO: 19746 - DNA, 20 bp, Artificial Sequence
  Description of Artificial Sequence: Synthetic oligonucleotide
  Target: DMPK; (+) strand; PAM type: YTN; PAM sequence: TTG
ctcagcagtgtcagcaggtc

SEQ ID NO: 19747 - DNA, 20 bp, Artificial Sequence
  Description of Artificial Sequence: Synthetic oligonucleotide
  Target: DMPK; (+) strand; PAM type: YTN; PAM sequence: CTC
agcagtgtcagcaggtcccc

SEQ ID NO: 19748 - DNA, 20 bp, Artificial Sequence
  Description of Artificial Sequence: Synthetic oligonucleotide
  Target: DMPK; (+) strand; PAM type: YTN; PAM sequence: CTC
catgaccaggtactgagaag

SEQ ID NO: 19749 - DNA, 20 bp, Artificial Sequence
  Description of Artificial Sequence: Synthetic oligonucleotide
  Target: DMPK; (+) strand; PAM type: YTN; PAM sequence: CTG
agaaggggttcgtcatgggt

SEQ ID NO: 19750 - DNA, 20 bp, Artificial Sequence
  Description of Artificial Sequence: Synthetic oligonucleotide
  Target: DMPK; (+) strand; PAM type: YTN; PAM sequence: TTC
gtcatgggtggttggtagtc

SEQ ID NO: 19751 - DNA, 20 bp, Artificial Sequence
  Description of Artificial Sequence: Synthetic oligonucleotide
  Target: DMPK; (+) strand; PAM type: YTN; PAM sequence: TTG
gtagtcccctgaggccctga

SEQ ID NO: 19752 - DNA, 20 bp, Artificial Sequence
  Description of Artificial Sequence: Synthetic oligonucleotide
  Target: DMPK; (+) strand; PAM type: YTN; PAM sequence: CTG
aggccctgatccatcacgga

SEQ ID NO: 19753 - DNA, 20 bp, Artificial Sequence
  Description of Artificial Sequence: Synthetic oligonucleotide
  Target: DMPK; (+) strand; PAM type: YTN; PAM sequence: CTG
atccatcacggatggctggg

SEQ ID NO: 19754 - DNA, 20 bp, Artificial Sequence
  Description of Artificial Sequence: Synthetic oligonucleotide
  Target: DMPK; (+) strand; PAM type: YTN; PAM sequence: CTG
ggacaacccctcccagagac

SEQ ID NO: 19755 - DNA, 20 bp, Artificial Sequence
  Description of Artificial Sequence: Synthetic oligonucleotide
  Target: DMPK; (+) strand; PAM type: YTN; PAM sequence: CTC
ccagagacaccccatccttg

SEQ ID NO: 19756 - DNA, 20 bp, Artificial Sequence
  Description of Artificial Sequence: Synthetic oligonucleotide
  Target: DMPK; (+) strand; PAM type: YTN; PAM sequence: CTT
gggcagagacctgcagcccc

SEQ ID NO: 19757 - DNA, 20 bp, Artificial Sequence
  Description of Artificial Sequence: Synthetic oligonucleotide
  Target: DMPK; (+) strand; PAM type: YTN; PAM sequence: TTG
ggcagagacctgcagcccca

SEQ ID NO: 19758 - DNA, 20 bp, Artificial Sequence
  Description of Artificial Sequence: Synthetic oligonucleotide
  Target: DMPK; (+) strand; PAM type: YTN; PAM sequence: CTG
cagccccagcccagagataa

SEQ ID NO: 19759 - DNA, 20 bp, Artificial Sequence
  Description of Artificial Sequence: Synthetic oligonucleotide
  Target: DMPK; (+) strand; PAM type: YTN; PAM sequence: CTG
ccgggccaaatcagagacca

SEQ ID NO: 19760 - DNA, 20 bp, Artificial Sequence
  Description of Artificial Sequence: Synthetic oligonucleotide
  Target: DMPK; (+) strand; PAM type: YTN; PAM sequence: CTG
cggcccccgcccccgcccct

SEQ ID NO: 19761 - DNA, 20 bp, Artificial Sequence
  Description of Artificial Sequence: Synthetic oligonucleotide
  Target: DMPK; (+) strand; PAM type: YTN; PAM sequence: CTC
aaaaaaaaacacaaacaaaa

SEQ ID NO: 19762 - DNA, 20 bp, Artificial Sequence
  Description of Artificial Sequence: Synthetic oligonucleotide
  Target: DMPK; (+) strand; PAM type: YTN; PAM sequence: CTT
tcctgggatgtcactgggca

SEQ ID NO: 19763 - DNA, 20 bp, Artificial Sequence
  Description of Artificial Sequence: Synthetic oligonucleotide
  Target: DMPK; (+) strand; PAM type: YTN; PAM sequence: TTT
cctgggatgtcactgggcag

SEQ ID NO: 19764 - DNA, 20 bp, Artificial Sequence
  Description of Artificial Sequence: Synthetic oligonucleotide
  Target: DMPK; (+) strand; PAM type: YTN; PAM sequence: TTC
ctgggatgtcactgggcaga

SEQ ID NO: 19765 - DNA, 20 bp, Artificial Sequence
  Description of Artificial Sequence: Synthetic oligonucleotide
  Target: DMPK; (+) strand; PAM type: YTN; PAM sequence: CTG
ggatgtcactgggcagattc

SEQ ID NO: 19766 - DNA, 20 bp, Artificial Sequence
  Description of Artificial Sequence: Synthetic oligonucleotide
  Target: DMPK; (+) strand; PAM type: YTN; PAM sequence: CTG
ggcagattcactccccctga

SEQ ID NO: 19767 - DNA, 20 bp, Artificial Sequence
  Description of Artificial Sequence: Synthetic oligonucleotide
  Target: DMPK; (+) strand; PAM type: YTN; PAM sequence: TTC
actccccctgagatgttctg

SEQ ID NO: 19768 - DNA, 20 bp, Artificial Sequence
  Description of Artificial Sequence: Synthetic oligonucleotide
  Target: DMPK; (+) strand; PAM type: YTN; PAM sequence: CTC
cccctgagatgttctgggaa

SEQ ID NO: 19769 - DNA, 20 bp, Artificial Sequence
  Description of Artificial Sequence: Synthetic oligonucleotide
  Target: DMPK; (+) strand; PAM type: YTN; PAM sequence: CTG
agatgttctgggaaagagaa

SEQ ID NO: 19770 - DNA, 20 bp, Artificial Sequence
  Description of Artificial Sequence: Synthetic oligonucleotide
  Target: DMPK; (+) strand; PAM type: YTN; PAM sequence: TTC
tgggaaagagaacccagagg

SEQ ID NO: 19771 - DNA, 20 bp, Artificial Sequence
  Description of Artificial Sequence: Synthetic oligonucleotide
  Target: DMPK; (+) strand; PAM type: YTN; PAM sequence: CTG
ggaaagagaacccagaggcc

SEQ ID NO: 19772 - DNA, 20 bp, Artificial Sequence
  Description of Artificial Sequence: Synthetic oligonucleotide
  Target: DMPK; (+) strand; PAM type: YTN; PAM sequence: CTC
cttccctaggcagtggcccc

SEQ ID NO: 19773 - DNA, 20 bp, Artificial Sequence
  Description of Artificial Sequence: Synthetic oligonucleotide
  Target: DMPK; (+) strand; PAM type: YTN; PAM sequence: CTT
ccctaggcagtggccccgtt

SEQ ID NO: 19774 - DNA, 20 bp, Artificial Sequence
  Description of Artificial Sequence: Synthetic oligonucleotide
  Target: DMPK; (+) strand; PAM type: YTN; PAM sequence: TTC
cctaggcagtggccccgtta

SEQ ID NO: 19775 - DNA, 20 bp, Artificial Sequence
  Description of Artificial Sequence: Synthetic oligonucleotide
  Target: DMPK; (+) strand; PAM type: YTN; PAM sequence: CTA
ggcagtggccccgttagaat

SEQ ID NO: 19776 - DNA, 20 bp, Artificial Sequence
  Description of Artificial Sequence: Synthetic oligonucleotide
  Target: DMPK; (+) strand; PAM type: YTN; PAM sequence: TTA
gaattcctgaagacctatcc

SEQ ID NO: 19777 - DNA, 20 bp, Artificial Sequence
  Description of Artificial Sequence: Synthetic oligonucleotide
  Target: DMPK; (+) strand; PAM type: YTN; PAM sequence: TTC
ctgaagacctatcccattcc

SEQ ID NO: 19778 - DNA, 20 bp, Artificial Sequence
  Description of Artificial Sequence: Synthetic oligonucleotide
  Target: DMPK; (+) strand; PAM type: YTN; PAM sequence: CTG
aagacctatcccattccagg

SEQ ID NO: 19779 - DNA, 20 bp, Artificial Sequence
  Description of Artificial Sequence: Synthetic oligonucleotide
  Target: DMPK; (+) strand; PAM type: YTN; PAM sequence: CTA
tcccattccaggtaagagac

SEQ ID NO: 19780 - DNA, 20 bp, Artificial Sequence
  Description of Artificial Sequence: Synthetic oligonucleotide
  Target: DMPK; (+) strand; PAM type: YTN; PAM sequence: TTC
caggtaagagaccccccgca

SEQ ID NO: 19781 - DNA, 20 bp, Artificial Sequence
  Description of Artificial Sequence: Synthetic oligonucleotide
  Target: DMPK; (+) strand; PAM type: YTN; PAM sequence: CTT
tataagagtcccccagatca

SEQ ID NO: 19782 - DNA, 20 bp, Artificial Sequence
  Description of Artificial Sequence: Synthetic oligonucleotide
  Target: DMPK; (+) strand; PAM type: YTN; PAM sequence: TTT
ataagagtcccccagatcac

SEQ ID NO: 19783 - DNA, 20 bp, Artificial Sequence
  Description of Artificial Sequence: Synthetic oligonucleotide
  Target: DMPK; (+) strand; PAM type: YTN; PAM sequence: TTA
taagagtcccccagatcacc

SEQ ID NO: 19784 - DNA, 20 bp, Artificial Sequence
  Description of Artificial Sequence: Synthetic oligonucleotide
  Target: DMPK; (+) strand; PAM type: YTN; PAM sequence: CTC
agatagggaaggcccctcat

SEQ ID NO: 19785 - DNA, 20 bp, Artificial Sequence
  Description of Artificial Sequence: Synthetic oligonucleotide
  Target: DMPK; (+) strand; PAM type: YTN; PAM sequence: CTC
atccacctgacacaccctct

SEQ ID NO: 19786 - DNA, 20 bp, Artificial Sequence
  Description of Artificial Sequence: Synthetic oligonucleotide
  Target: DMPK; (+) strand; PAM type: YTN; PAM sequence: CTG
acacaccctcttaccgcaca

SEQ ID NO: 19787 - DNA, 20 bp, Artificial Sequence
  Description of Artificial Sequence: Synthetic oligonucleotide
  Target: DMPK; (+) strand; PAM type: YTN; PAM sequence: CTC
ttaccgcacacagactttcc

SEQ ID NO: 19788 - DNA, 20 bp, Artificial Sequence
  Description of Artificial Sequence: Synthetic oligonucleotide
  Target: DMPK; (+) strand; PAM type: YTN; PAM sequence: CTT
accgcacacagactttccca

SEQ ID NO: 19789 - DNA, 20 bp, Artificial Sequence
  Description of Artificial Sequence: Synthetic oligonucleotide
  Target: DMPK; (+) strand; PAM type: YTN; PAM sequence: TTA
ccgcacacagactttcccac

SEQ ID NO: 19790 - DNA, 20 bp, Artificial Sequence
  Description of Artificial Sequence: Synthetic oligonucleotide
  Target: DMPK; (+) strand; PAM type: YTN; PAM sequence: CTT
tcccacagacgtttccgggc

SEQ ID NO: 19791 - DNA, 20 bp, Artificial Sequence
  Description of Artificial Sequence: Synthetic oligonucleotide
  Target: DMPK; (+) strand; PAM type: YTN; PAM sequence: TTT
cccacagacgtttccgggca

SEQ ID NO: 19792 - DNA, 20 bp, Artificial Sequence
  Description of Artificial Sequence: Synthetic oligonucleotide
  Target: DMPK; (+) strand; PAM type: YTN; PAM sequence: TTC
ccacagacgtttccgggcag

SEQ ID NO: 19793 - DNA, 20 bp, Artificial Sequence
  Description of Artificial Sequence: Synthetic oligonucleotide
  Target: DMPK; (+) strand; PAM type: YTN; PAM sequence: TTT
ccgggcagcacccccaatcc

SEQ ID NO: 19794 - DNA, 20 bp, Artificial Sequence
  Description of Artificial Sequence: Synthetic oligonucleotide
  Target: DMPK; (+) strand; PAM type: YTN; PAM sequence: TTC
cgggcagcacccccaatcct

SEQ ID NO: 19795 - DNA, 20 bp, Artificial Sequence
  Description of Artificial Sequence: Synthetic oligonucleotide
  Target: DMPK; (+) strand; PAM type: YTN; PAM sequence: CTA
gagcttcctctccccacctc

SEQ ID NO: 19796 - DNA, 20 bp, Artificial Sequence
  Description of Artificial Sequence: Synthetic oligonucleotide
  Target: DMPK; (+) strand; PAM type: YTN; PAM sequence: CTT
cctctccccacctcctcgtc

SEQ ID NO: 19797 - DNA, 20 bp, Artificial Sequence
  Description of Artificial Sequence: Synthetic oligonucleotide
  Target: DMPK; (+) strand; PAM type: YTN; PAM sequence: TTC
ctctccccacctcctcgtcc

SEQ ID NO: 19798 - DNA, 20 bp, Artificial Sequence
  Description of Artificial Sequence: Synthetic oligonucleotide
  Target: DMPK; (+) strand; PAM type: YTN; PAM sequence: CTC
tccccacctcctcgtccagt

SEQ ID NO: 19799 - DNA, 20 bp, Artificial Sequence
  Description of Artificial Sequence: Synthetic oligonucleotide
  Target: DMPK; (+) strand; PAM type: YTN; PAM sequence: CTC
cccacctcctcgtccagtga

SEQ ID NO: 19800 - DNA, 20 bp, Artificial Sequence
  Description of Artificial Sequence: Synthetic oligonucleotide
  Target: DMPK; (+) strand; PAM type: YTN; PAM sequence: CTC
ctcgtccagtgacagcacgg

SEQ ID NO: 19801 - DNA, 20 bp, Artificial Sequence
  Description of Artificial Sequence: Synthetic oligonucleotide
  Target: DMPK; (+) strand; PAM type: YTN; PAM sequence: CTC
gtccagtgacagcacgggct

SEQ ID NO: 19802 - DNA, 20 bp, Artificial Sequence
  Description of Artificial Sequence: Synthetic oligonucleotide
  Target: DMPK; (+) strand; PAM type: YTN; PAM sequence: CTC
ttgtccctcttcctagtcac

SEQ ID NO: 19803 - DNA, 20 bp, Artificial Sequence
  Description of Artificial Sequence: Synthetic oligonucleotide
  Target: DMPK; (+) strand; PAM type: YTN; PAM sequence: CTT
gtccctcttcctagtcaccc

SEQ ID NO: 19804 - DNA, 20 bp, Artificial Sequence
  Description of Artificial Sequence: Synthetic oligonucleotide
  Target: DMPK; (+) strand; PAM type: YTN; PAM sequence: TTG
tccctcttcctagtcacccc

SEQ ID NO: 19805 - DNA, 20 bp, Artificial Sequence
  Description of Artificial Sequence: Synthetic oligonucleotide
  Target: DMPK; (+) strand; PAM type: YTN; PAM sequence: CTC
ttcctagtcaccccggcccg

SEQ ID NO: 19806 - DNA, 20 bp, Artificial Sequence
  Description of Artificial Sequence: Synthetic oligonucleotide
  Target: DMPK; (+) strand; PAM type: YTN; PAM sequence: CTT
cctagtcaccccggcccgga

SEQ ID NO: 19807 - DNA, 20 bp, Artificial Sequence
  Description of Artificial Sequence: Synthetic oligonucleotide
  Target: DMPK; (+) strand; PAM type: YTN; PAM sequence: TTC
ctagtcaccccggcccggag

SEQ ID NO: 19808 - DNA, 20 bp, Artificial Sequence
  Description of Artificial Sequence: Synthetic oligonucleotide
  Target: DMPK; (+) strand; PAM type: YTN; PAM sequence: CTA
gtcaccccggcccggagctc

SEQ ID NO: 19809 - DNA, 20 bp, Artificial Sequence
  Description of Artificial Sequence: Synthetic oligonucleotide
  Target: DMPK; (+) strand; PAM type: YTN; PAM sequence: CTC
accaggtagttctcatcctg

SEQ ID NO: 19810 - DNA, 20 bp, Artificial Sequence
  Description of Artificial Sequence: Synthetic oligonucleotide
  Target: DMPK; (+) strand; PAM type: YTN; PAM sequence: TTC
tcatcctggaaggcgaagtg

SEQ ID NO: 19811 - DNA, 20 bp, Artificial Sequence
  Description of Artificial Sequence: Synthetic oligonucleotide
  Target: DMPK; (+) strand; PAM type: YTN; PAM sequence: CTC
atcctggaaggcgaagtgca

SEQ ID NO: 19812 - DNA, 20 bp, Artificial Sequence
  Description of Artificial Sequence: Synthetic oligonucleotide
  Target: DMPK; (+) strand; PAM type: YTN; PAM sequence: CTG
gaaggcgaagtgcagctgcg

SEQ ID NO: 19813 - DNA, 20 bp, Artificial Sequence
  Description of Artificial Sequence: Synthetic oligonucleotide
  Target: DMPK; (+) strand; PAM type: YTN; PAM sequence: CTG
cgtgatccaccgccggtccc

SEQ ID NO: 19814 - DNA, 20 bp, Artificial Sequence
  Description of Artificial Sequence: Synthetic oligonucleotide
  Target: DMPK; (+) strand; PAM type: YTN; PAM sequence: TTC
accaacacgtccctctcctc

SEQ ID NO: 19815 - DNA, 20 bp, Artificial Sequence
  Description of Artificial Sequence: Synthetic oligonucleotide
  Target: DMPK; (+) strand; PAM type: YTN; PAM sequence: CTC
tcctcacggaagcacgacac

SEQ ID NO: 19816 - DNA, 20 bp, Artificial Sequence
  Description of Artificial Sequence: Synthetic oligonucleotide
  Target: DMPK; (+) strand; PAM type: YTN; PAM sequence: CTC
ctcacggaagcacgacacct

SEQ ID NO: 19817 - DNA, 20 bp, Artificial Sequence
  Description of Artificial Sequence: Synthetic oligonucleotide
  Target: DMPK; (+) strand; PAM type: YTN; PAM sequence: CTC
acggaagcacgacacctgca

SEQ ID NO: 19818 - DNA, 20 bp, Artificial Sequence
  Description of Artificial Sequence: Synthetic oligonucleotide
  Target: DMPK; (+) strand; PAM type: YTN; PAM sequence: CTG
cagggcacccggaggagctg

SEQ ID NO: 19819 - DNA, 20 bp, Artificial Sequence
  Description of Artificial Sequence: Synthetic oligonucleotide
  Target: DMPK; (+) strand; PAM type: YTN; PAM sequence: CTG
cagccggagacggggcgcgg

SEQ ID NO: 19820 - DNA, 20 bp, Artificial Sequence
  Description of Artificial Sequence: Synthetic oligonucleotide
  Target: DMPK; (+) strand; PAM type: YTN; PAM sequence: CTC
aaagccccccacgtccgccc

SEQ ID NO: 19821 - DNA, 20 bp, Artificial Sequence
  Description of Artificial Sequence: Synthetic oligonucleotide
  Target: DMPK; (+) strand; PAM type: YTN; PAM sequence: CTC
acctcgcccctcttcagcat

SEQ ID NO: 19822 - DNA, 20 bp, Artificial Sequence
  Description of Artificial Sequence: Synthetic oligonucleotide
  Target: DMPK; (+) strand; PAM type: YTN; PAM sequence: CTC
gcccctcttcagcatgtccc

SEQ ID NO: 19823 - DNA, 20 bp, Artificial Sequence
  Description of Artificial Sequence: Synthetic oligonucleotide
  Target: DMPK; (+) strand; PAM type: YTN; PAM sequence: CTC
ttcagcatgtcccacttgtt

SEQ ID NO: 19824 - DNA, 20 bp, Artificial Sequence
  Description of Artificial Sequence: Synthetic oligonucleotide
  Target: DMPK; (+) strand; PAM type: YTN; PAM sequence: CTT
cagcatgtcccacttgttca

SEQ ID NO: 19825 - DNA, 20 bp, Artificial Sequence
  Description of Artificial Sequence: Synthetic oligonucleotide
  Target: DMPK; (+) strand; PAM type: YTN; PAM sequence: TTC
agcatgtcccacttgttcat

SEQ ID NO: 19826 - DNA, 20 bp, Artificial Sequence
  Description of Artificial Sequence: Synthetic oligonucleotide
  Target: DMPK; (+) strand; PAM type: YTN; PAM sequence: CTT
gttcatgatcttcatggcat

SEQ ID NO: 19827 - DNA, 20 bp, Artificial Sequence
  Description of Artificial Sequence: Synthetic oligonucleotide
  Target: DMPK; (+) strand; PAM type: YTN; PAM sequence: TTG
ttcatgatcttcatggcata

SEQ ID NO: 19828 - DNA, 20 bp, Artificial Sequence
  Description of Artificial Sequence: Synthetic oligonucleotide
  Target: DMPK; (+) strand; PAM type: YTN; PAM sequence: TTC
atgatcttcatggcatacac

SEQ ID NO: 19829 - DNA, 20 bp, Artificial Sequence
  Description of Artificial Sequence: Synthetic oligonucleotide
  Target: DMPK; (+) strand; PAM type: YTN; PAM sequence: CTT
catggcatacacctggcccg

SEQ ID NO: 19830 - DNA, 20 bp, Artificial Sequence
  Description of Artificial Sequence: Synthetic oligonucleotide
  Target: DMPK; (+) strand; PAM type: YTN; PAM sequence: TTC
atggcatacacctggcccgt

SEQ ID NO: 19831 - DNA, 20 bp, Artificial Sequence
  Description of Artificial Sequence: Synthetic oligonucleotide
  Target: DMPK; (+) strand; PAM type: YTN; PAM sequence: CTG
gcccgtctgcttcatcttca

SEQ ID NO: 19832 - DNA, 20 bp, Artificial Sequence
  Description of Artificial Sequence: Synthetic oligonucleotide
  Target: DMPK; (+) strand; PAM type: YTN; PAM sequence: CTG
cttcatcttcactaccgcta

SEQ ID NO: 19833 - DNA, 20 bp, Artificial Sequence
  Description of Artificial Sequence: Synthetic oligonucleotide
  Target: DMPK; (+) strand; PAM type: YTN; PAM sequence: CTT
catcttcactaccgctacct

SEQ ID NO: 19834 - DNA, 20 bp, Artificial Sequence
  Description of Artificial Sequence: Synthetic oligonucleotide
  Target: DMPK; (+) strand; PAM type: YTN; PAM sequence: TTC
atcttcactaccgctacctg

SEQ ID NO: 19835 - DNA, 20 bp, Artificial Sequence
  Description of Artificial Sequence: Synthetic oligonucleotide
  Target: DMPK; (+) strand; PAM type: YTN; PAM sequence: CTT
cactaccgctacctgaggtc

SEQ ID NO: 19836 - DNA, 20 bp, Artificial Sequence
  Description of Artificial Sequence: Synthetic oligonucleotide
  Target: DMPK; (+) strand; PAM type: YTN; PAM sequence: TTC
actaccgctacctgaggtcg

SEQ ID NO: 19837 - DNA, 20 bp, Artificial Sequence
  Description of Artificial Sequence: Synthetic oligonucleotide
  Target: DMPK; (+) strand; PAM type: YTN; PAM sequence: CTA
ccgctacctgaggtcgagat

SEQ ID NO: 19838 - DNA, 20 bp, Artificial Sequence
  Description of Artificial Sequence: Synthetic oligonucleotide
  Target: DMPK; (+) strand; PAM type: YTN; PAM sequence: CTA
cctgaggtcgagatagtgag

SEQ ID NO: 19839 - DNA, 20 bp, Artificial Sequence
  Description of Artificial Sequence: Synthetic oligonucleotide
  Target: DMPK; (+) strand; PAM type: YTN; PAM sequence: CTG
aggtcgagatagtgagacag

SEQ ID NO: 19840 - DNA, 20 bp, Artificial Sequence
  Description of Artificial Sequence: Synthetic oligonucleotide
  Target: DMPK; (+) strand; PAM type: YTN; PAM sequence: CTC
gcccagacccaactccaccc

SEQ ID NO: 19841 - DNA, 20 bp, Artificial Sequence
  Description of Artificial Sequence: Synthetic oligonucleotide
  Target: DMPK; (+) strand; PAM type: YTN; PAM sequence: CTC
cacccgcttctgcacccagc

SEQ ID NO: 19842 - DNA, 20 bp, Artificial Sequence
  Description of Artificial Sequence: Synthetic oligonucleotide
  Target: DMPK; (+) strand; PAM type: YTN; PAM sequence: CTT
ctgcacccagccgtggcccc

SEQ ID NO: 19843 - DNA, 20 bp, Artificial Sequence
  Description of Artificial Sequence: Synthetic oligonucleotide
  Target: DMPK; (+) strand; PAM type: YTN; PAM sequence: TTC
tgcacccagccgtggccccg

SEQ ID NO: 19844 - DNA, 20 bp, Artificial Sequence
  Description of Artificial Sequence: Synthetic oligonucleotide
  Target: DMPK; (+) strand; PAM type: YTN; PAM sequence: CTG
cacccagccgtggccccgcc

SEQ ID NO: 19845 - DNA, 20 bp, Artificial Sequence
  Description of Artificial Sequence: Synthetic oligonucleotide
  Target: DMPK; (+) strand; PAM type: YTN; PAM sequence: CTG
ccacaccacgcccattggtc

SEQ ID NO: 19846 - DNA, 20 bp, Artificial Sequence
  Description of Artificial Sequence: Synthetic oligonucleotide
  Target: DMPK; (+) strand; PAM type: YTN; PAM sequence: TTG
gtcccaagccccgcctccag

SEQ ID NO: 19847 - DNA, 20 bp, Artificial Sequence
  Description of Artificial Sequence: Synthetic oligonucleotide
  Target: DMPK; (+) strand; PAM type: YTN; PAM sequence: CTC
cagcccagccctaggttcta

SEQ ID NO: 19848 - DNA, 20 bp, Artificial Sequence
  Description of Artificial Sequence: Synthetic oligonucleotide
  Target: DMPK; (+) strand; PAM type: YTN; PAM sequence: CTA
ggttctaaggctcggtcatt

SEQ ID NO: 19849 - DNA, 20 bp, Artificial Sequence
  Description of Artificial Sequence: Synthetic oligonucleotide
  Target: DMPK; (+) strand; PAM type: YTN; PAM sequence: TTC
taaggctcggtcattcatca

SEQ ID NO: 19850 - DNA, 20 bp, Artificial Sequence
  Description of Artificial Sequence: Synthetic oligonucleotide
  Target: DMPK; (+) strand; PAM type: YTN; PAM sequence: CTA
aggctcggtcattcatcaat

SEQ ID NO: 19851 - DNA, 20 bp, Artificial Sequence
  Description of Artificial Sequence: Synthetic oligonucleotide
  Target: DMPK; (+) strand; PAM type: YTN; PAM sequence: CTC
ggtcattcatcaatttctaa

SEQ ID NO: 19852 - DNA, 20 bp, Artificial Sequence
  Description of Artificial Sequence: Synthetic oligonucleotide
  Target: DMPK; (+) strand; PAM type: YTN; PAM sequence: TTC
atcaatttctaaggccccgc

SEQ ID NO: 19853 - DNA, 20 bp, Artificial Sequence
  Description of Artificial Sequence: Synthetic oligonucleotide
  Target: DMPK; (+) strand; PAM type: YTN; PAM sequence: TTT
ctaaggccccgccccaaccc

SEQ ID NO: 19854 - DNA, 20 bp, Artificial Sequence
  Description of Artificial Sequence: Synthetic oligonucleotide
  Target: DMPK; (+) strand; PAM type: YTN; PAM sequence: TTC
taaggccccgccccaacccc

SEQ ID NO: 19855 - DNA, 20 bp, Artificial Sequence
  Description of Artificial Sequence: Synthetic oligonucleotide
  Target: DMPK; (+) strand; PAM type: YTN; PAM sequence: CTA
aggccccgccccaaccccta

SEQ ID NO: 19856 - DNA, 20 bp, Artificial Sequence
  Description of Artificial Sequence: Synthetic oligonucleotide
  Target: DMPK; (+) strand; PAM type: YTN; PAM sequence: CTA
tgccccgcccaccacgagtc

SEQ ID NO: 19857 - DNA, 20 bp, Artificial Sequence
  Description of Artificial Sequence: Synthetic oligonucleotide
  Target: DMPK; (+) strand; PAM type: YTN; PAM sequence: CTC
ccgcccggttcggcttacct

SEQ ID NO: 19858 - DNA, 20 bp, Artificial Sequence
  Description of Artificial Sequence: Synthetic oligonucleotide
  Target: DMPK; (+) strand; PAM type: YTN; PAM sequence: TTC
ggcttacctcgctgaacgcc

SEQ ID NO: 19859 - DNA, 20 bp, Artificial Sequence
  Description of Artificial Sequence: Synthetic oligonucleotide
  Target: DMPK; (+) strand; PAM type: YTN; PAM sequence: CTT
acctcgctgaacgccccgcg

SEQ ID NO: 19860 - DNA, 20 bp, Artificial Sequence
  Description of Artificial Sequence: Synthetic oligonucleotide
  Target: DMPK; (+) strand; PAM type: YTN; PAM sequence: TTA
cctcgctgaacgccccgcgt

SEQ ID NO: 19861 - DNA, 20 bp, Artificial Sequence
  Description of Artificial Sequence: Synthetic oligonucleotide
  Target: DMPK; (+) strand; PAM type: YTN; PAM sequence: CTC
gctgaacgccccgcgtccga

SEQ ID NO: 19862 - DNA, 20 bp, Artificial Sequence
  Description of Artificial Sequence: Synthetic oligonucleotide
  Target: DMPK; (+) strand; PAM type: YTN; PAM sequence: CTG
aacgccccgcgtccgatcac

SEQ ID NO: 19863 - DNA, 20 bp, Artificial Sequence
  Description of Artificial Sequence: Synthetic oligonucleotide
  Target: DMPK; (+) strand; PAM type: YTN; PAM sequence: CTT
cagaatctcgaagtcgtccc

SEQ ID NO: 19864 - DNA, 20 bp, Artificial Sequence
  Description of Artificial Sequence: Synthetic oligonucleotide
  Target: DMPK; (+) strand; PAM type: YTN; PAM sequence: TTC
agaatctcgaagtcgtccct

SEQ ID NO: 19865 - DNA, 20 bp, Artificial Sequence
  Description of Artificial Sequence: Synthetic oligonucleotide
  Target: DMPK; (+) strand; PAM type: YTN; PAM sequence: CTC
gaagtcgtccctctgcagtc

SEQ ID NO: 19866 - DNA, 20 bp, Artificial Sequence
  Description of Artificial Sequence: Synthetic oligonucleotide
  Target: DMPK; (+) strand; PAM type: YTN; PAM sequence: CTC
tgcagtcggacctccttaag

SEQ ID NO: 19867 - DNA, 20 bp, Artificial Sequence
  Description of Artificial Sequence: Synthetic oligonucleotide
  Target: DMPK; (+) strand; PAM type: YTN; PAM sequence: CTG
cagtcggacctccttaagcc

SEQ ID NO: 19868 - DNA, 20 bp, Artificial Sequence
  Description of Artificial Sequence: Synthetic oligonucleotide
  Target: DMPK; (+) strand; PAM type: YTN; PAM sequence: CTC
cttaagcctcaccacgatgg

SEQ ID NO: 19869 - DNA, 20 bp, Artificial Sequence
  Description of Artificial Sequence: Synthetic oligonucleotide
  Target: DMPK; (+) strand; PAM type: YTN; PAM sequence: CTT
aagcctcaccacgatgggct

SEQ ID NO: 19870 - DNA, 20 bp, Artificial Sequence
  Description of Artificial Sequence: Synthetic oligonucleotide
  Target: DMPK; (+) strand; PAM type: YTN; PAM sequence: TTA
agcctcaccacgatgggctc

SEQ ID NO: 19871 - DNA, 20 bp, Artificial Sequence
  Description of Artificial Sequence: Synthetic oligonucleotide
  Target: DMPK; (+) strand; PAM type: YTN; PAM sequence: CTC
accacgatgggctccgctgg

SEQ ID NO: 19872 - DNA, 20 bp, Artificial Sequence
  Description of Artificial Sequence: Synthetic oligonucleotide
  Target: DMPK; (+) strand; PAM type: YTN; PAM sequence: CTC
cgctgggggggtggtggggg

SEQ ID NO: 19873 - DNA, 20 bp, Artificial Sequence
  Description of Artificial Sequence: Synthetic oligonucleotide
  Target: DMPK; (+) strand; PAM type: YTN; PAM sequence: CTG
ggggggtggtgggggaaaag

SEQ ID NO: 19874 - DNA, 20 bp, Artificial Sequence
  Description of Artificial Sequence: Synthetic oligonucleotide
  Target: DMPK; (+) strand; PAM type: YTN; PAM sequence: CTG
gagacaagggggaaagcccc

SEQ ID NO: 19875 - DNA, 20 bp, Artificial Sequence
  Description of Artificial Sequence: Synthetic oligonucleotide
  Target: DMPK; (+) strand; PAM type: YTN; PAM sequence: CTC
tgtctgtctccccttctctc

SEQ ID NO: 19876 - DNA, 20 bp, Artificial Sequence
  Description of Artificial Sequence: Synthetic oligonucleotide
  Target: DMPK; (+) strand; PAM type: YTN; PAM sequence: CTG
tctgtctccccttctctctg

SEQ ID NO: 19877 - DNA, 20 bp, Artificial Sequence
  Description of Artificial Sequence: Synthetic oligonucleotide
  Target: DMPK; (+) strand; PAM type: YTN; PAM sequence: CTG
tctccccttctctctgcctc

SEQ ID NO: 19878 - DNA, 20 bp, Artificial Sequence
  Description of Artificial Sequence: Synthetic oligonucleotide
  Target: DMPK; (+) strand; PAM type: YTN; PAM sequence: CTC
cccttctctctgcctctcag

SEQ ID NO: 19879 - DNA, 20 bp, Artificial Sequence
  Description of Artificial Sequence: Synthetic oligonucleotide
  Target: DMPK; (+) strand; PAM type: YTN; PAM sequence: CTT
ctctctgcctctcagcttca

SEQ ID NO: 19880 - DNA, 20 bp, Artificial Sequence
  Description of Artificial Sequence: Synthetic oligonucleotide
  Target: DMPK; (+) strand; PAM type: YTN; PAM sequence: TTC
tctctgcctctcagcttcac

SEQ ID NO: 19881 - DNA, 20 bp, Artificial Sequence
  Description of Artificial Sequence: Synthetic oligonucleotide
  Target: DMPK; (+) strand; PAM type: YTN; PAM sequence: CTC
tctgcctctcagcttcaccc

SEQ ID NO: 19882 - DNA, 20 bp, Artificial Sequence
  Description of Artificial Sequence: Synthetic oligonucleotide
  Target: DMPK; (+) strand; PAM type: YTN; PAM sequence: CTC
tgcctctcagcttcacccta

SEQ ID NO: 19883 - DNA, 20 bp, Artificial Sequence
  Description of Artificial Sequence: Synthetic oligonucleotide
  Target: DMPK; (+) strand; PAM type: YTN; PAM sequence: CTG
cctctcagcttcaccctagg

SEQ ID NO: 19884 - DNA, 20 bp, Artificial Sequence
  Description of Artificial Sequence: Synthetic oligonucleotide
  Target: DMPK; (+) strand; PAM type: YTN; PAM sequence: CTC
tcagcttcaccctaggactg

SEQ ID NO: 19885 - DNA, 20 bp, Artificial Sequence
  Description of Artificial Sequence: Synthetic oligonucleotide
  Target: DMPK; (+) strand; PAM type: YTN; PAM sequence: CTC
agcttcaccctaggactgtc

SEQ ID NO: 19886 - DNA, 20 bp, Artificial Sequence
  Description of Artificial Sequence: Synthetic oligonucleotide
  Target: DMPK; (+) strand; PAM type: YTN; PAM sequence: CTT
caccctaggactgtctgctt

SEQ ID NO: 19887 - DNA, 20 bp, Artificial Sequence
  Description of Artificial Sequence: Synthetic oligonucleotide
  Target: DMPK; (+) strand; PAM type: YTN; PAM sequence: TTC
accctaggactgtctgcttc

SEQ ID NO: 19888 - DNA, 20 bp, Artificial Sequence
  Description of Artificial Sequence: Synthetic oligonucleotide
  Target: DMPK; (+) strand; PAM type: YTN; PAM sequence: CTA
ggactgtctgcttcccaggg

SEQ ID NO: 19889 - DNA, 20 bp, Artificial Sequence
  Description of Artificial Sequence: Synthetic oligonucleotide
  Target: DMPK; (+) strand; PAM type: YTN; PAM sequence: CTG
tctgcttcccaggggcttcc

SEQ ID NO: 19890 - DNA, 20 bp, Artificial Sequence
  Description of Artificial Sequence: Synthetic oligonucleotide
  Target: DMPK; (+) strand; PAM type: YTN; PAM sequence: CTG
cttcccaggggcttccccac

SEQ ID NO: 19891 - DNA, 20 bp, Artificial Sequence
  Description of Artificial Sequence: Synthetic oligonucleotide
  Target: DMPK; (+) strand; PAM type: YTN; PAM sequence: CTT
cccaggggcttccccacata

SEQ ID NO: 19892 - DNA, 20 bp, Artificial Sequence
  Description of Artificial Sequence: Synthetic oligonucleotide
  Target: DMPK; (+) strand; PAM type: YTN; PAM sequence: TTC
ccaggggcttccccacataa

SEQ ID NO: 19893 - DNA, 20 bp, Artificial Sequence
  Description of Artificial Sequence: Synthetic oligonucleotide
  Target: DMPK; (+) strand; PAM type: YTN; PAM sequence: CTT
ccccacataaacaccgtgta

SEQ ID NO: 19894 - DNA, 20 bp, Artificial Sequence
  Description of Artificial Sequence: Synthetic oligonucleotide
  Target: DMPK; (+) strand; PAM type: YTN; PAM sequence: TTC
cccacataaacaccgtgtaa

SEQ ID NO: 19895 - DNA, 20 bp, Artificial Sequence
  Description of Artificial Sequence: Synthetic oligonucleotide
  Target: DMPK; (+) strand; PAM type: YTN; PAM sequence: TTC
tgggggccaaaaatgccctc

SEQ ID NO: 19896 - DNA, 20 bp, Artificial Sequence
  Description of Artificial Sequence: Synthetic oligonucleotide
  Target: DMPK; (+) strand; PAM type: YTN; PAM sequence: CTG
ggggccaaaaatgccctccc

SEQ ID NO: 19897 - DNA, 20 bp, Artificial Sequence
  Description of Artificial Sequence: Synthetic oligonucleotide
  Target: DMPK; (+) strand; PAM type: YTN; PAM sequence: CTC
ccatagaggtgagatgcctg

SEQ ID NO: 19898 - DNA, 20 bp, Artificial Sequence
  Description of Artificial Sequence: Synthetic oligonucleotide
  Target: DMPK; (+) strand; PAM type: YTN; PAM sequence: CTG
agaagccctttgcgggacag

SEQ ID NO: 19899 - DNA, 20 bp, Artificial Sequence
  Description of Artificial Sequence: Synthetic oligonucleotide
  Target: DMPK; (+) strand; PAM type: YTN; PAM sequence: CTT
tgcgggacagggcattggcc

SEQ ID NO: 19900 - DNA, 20 bp, Artificial Sequence
  Description of Artificial Sequence: Synthetic oligonucleotide
  Target: DMPK; (+) strand; PAM type: YTN; PAM sequence: TTT
gcgggacagggcattggccc

SEQ ID NO: 19901 - DNA, 20 bp, Artificial Sequence
  Description of Artificial Sequence: Synthetic oligonucleotide
  Target: DMPK; (+) strand; PAM type: YTN; PAM sequence: TTG
cgggacagggcattggccca

SEQ ID NO: 19902 - DNA, 20 bp, Artificial Sequence
  Description of Artificial Sequence: Synthetic oligonucleotide
  Target: DMPK; (+) strand; PAM type: YTN; PAM sequence: TTG
gcccagagggctccaagggt

SEQ ID NO: 19903 - DNA, 20 bp, Artificial Sequence
  Description of Artificial Sequence: Synthetic oligonucleotide
  Target: DMPK; (+) strand; PAM type: YTN; PAM sequence: CTC
caagggtgtgcaggatggtt

SEQ ID NO: 19904 - DNA, 20 bp, Artificial Sequence
  Description of Artificial Sequence: Synthetic oligonucleotide
  Target: DMPK; (+) strand; PAM type: YTN; PAM sequence: TTA
gggtggggtaacggagtctg

SEQ ID NO: 19905 - DNA, 20 bp, Artificial Sequence
  Description of Artificial Sequence: Synthetic oligonucleotide
  Target: DMPK; (+) strand; PAM type: YTN; PAM sequence: CTG
cagaaggacagaccctaaag

SEQ ID NO: 19906 - DNA, 20 bp, Artificial Sequence
  Description of Artificial Sequence: Synthetic oligonucleotide
  Target: DMPK; (+) strand; PAM type: YTN; PAM sequence: CTA
aagaacaaggggagaaggaa

SEQ ID NO: 19907 - DNA, 20 bp, Artificial Sequence
  Description of Artificial Sequence: Synthetic oligonucleotide
  Target: DMPK; (+) strand; PAM type: YTN; PAM sequence: TTC
ttccaccttccaccctgact

SEQ ID NO: 19908 - DNA, 20 bp, Artificial Sequence
  Description of Artificial Sequence: Synthetic oligonucleotide
  Target: DMPK; (+) strand; PAM type: YTN; PAM sequence: CTT
ccaccttccaccctgactcc

SEQ ID NO: 19909 - DNA, 20 bp, Artificial Sequence
  Description of Artificial Sequence: Synthetic oligonucleotide
  Target: DMPK; (+) strand; PAM type: YTN; PAM sequence: TTC
caccttccaccctgactcca

SEQ ID NO: 19910 - DNA, 20 bp, Artificial Sequence
  Description of Artificial Sequence: Synthetic oligonucleotide
  Target: DMPK; (+) strand; PAM type: YTN; PAM sequence: CTT
ccaccctgactccaggtgac

SEQ ID NO: 19911 - DNA, 20 bp, Artificial Sequence
  Description of Artificial Sequence: Synthetic oligonucleotide
  Target: DMPK; (+) strand; PAM type: YTN; PAM sequence: TTC
caccctgactccaggtgaca

SEQ ID NO: 19912 - DNA, 20 bp, Artificial Sequence
  Description of Artificial Sequence: Synthetic oligonucleotide
  Target: DMPK; (+) strand; PAM type: YTN; PAM sequence: CTG
actccaggtgacagttcagg

SEQ ID NO: 19913 - DNA, 20 bp, Artificial Sequence
  Description of Artificial Sequence: Synthetic oligonucleotide
  Target: DMPK; (+) strand; PAM type: YTN; PAM sequence: CTC
caggtgacagttcaggtgca

SEQ ID NO: 19914 - DNA, 20 bp, Artificial Sequence
  Description of Artificial Sequence: Synthetic oligonucleotide
  Target: DMPK; (+) strand; PAM type: YTN; PAM sequence: TTC
aggtgcagccagggccccac

SEQ ID NO: 19915 - DNA, 20 bp, Artificial Sequence
  Description of Artificial Sequence: Synthetic oligonucleotide
  Target: DMPK; (+) strand; PAM type: YTN; PAM sequence: TTC
tcatgtagaatgtcctgggt

SEQ ID NO: 19916 - DNA, 20 bp, Artificial Sequence
  Description of Artificial Sequence: Synthetic oligonucleotide
  Target: DMPK; (+) strand; PAM type: YTN; PAM sequence: CTC
atgtagaatgtcctgggtaa

SEQ ID NO: 19917 - DNA, 20 bp, Artificial Sequence
  Description of Artificial Sequence: Synthetic oligonucleotide
  Target: DMPK; (+) strand; PAM type: YTN; PAM sequence: CTG
ggtaacggcccagacgtggg

SEQ ID NO: 19918 - DNA, 20 bp, Artificial Sequence
  Description of Artificial Sequence: Synthetic oligonucleotide
  Target: DMPK; (+) strand; PAM type: YTN; PAM sequence: TTG
tatccagtacctctagattc

SEQ ID NO: 19919 - DNA, 20 bp, Artificial Sequence
  Description of Artificial Sequence: Synthetic oligonucleotide
  Target: DMPK; (+) strand; PAM type: YTN; PAM sequence: CTC
tagattcagatgcaggtggt

SEQ ID NO: 19920 - DNA, 20 bp, Artificial Sequence
  Description of Artificial Sequence: Synthetic oligonucleotide
  Target: DMPK; (+) strand; PAM type: YTN; PAM sequence: CTA
gattcagatgcaggtggttc

SEQ ID NO: 19921 - DNA, 20 bp, Artificial Sequence
  Description of Artificial Sequence: Synthetic oligonucleotide
  Target: DMPK; (+) strand; PAM type: YTN; PAM sequence: TTC
agatgcaggtggttcttgaa

SEQ ID NO: 19922 - DNA, 20 bp, Artificial Sequence
  Description of Artificial Sequence: Synthetic oligonucleotide
  Target: DMPK; (+) strand; PAM type: YTN; PAM sequence: TTC
ttgaaccacactttggaaaa

SEQ ID NO: 19923 - DNA, 20 bp, Artificial Sequence
  Description of Artificial Sequence: Synthetic oligonucleotide
  Target: DMPK; (+) strand; PAM type: YTN; PAM sequence: CTT
gaaccacactttggaaaacc

SEQ ID NO: 19924 - DNA, 20 bp, Artificial Sequence
  Description of Artificial Sequence: Synthetic oligonucleotide
  Target: DMPK; (+) strand; PAM type: YTN; PAM sequence: TTG
aaccacactttggaaaaccc

SEQ ID NO: 19925 - DNA, 20 bp, Artificial Sequence
  Description of Artificial Sequence: Synthetic oligonucleotide
  Target: DMPK; (+) strand; PAM type: YTN; PAM sequence: CTT
tggaaaaccctggatttggg

SEQ ID NO: 19926 - DNA, 20 bp, Artificial Sequence
  Description of Artificial Sequence: Synthetic oligonucleotide
  Target: DMPK; (+) strand; PAM type: YTN; PAM sequence: TTT
ggaaaaccctggatttgggg

SEQ ID NO: 19927 - DNA, 20 bp, Artificial Sequence
  Description of Artificial Sequence: Synthetic oligonucleotide
  Target: DMPK; (+) strand; PAM type: YTN; PAM sequence: TTG
gaaaaccctggatttggggc

SEQ ID NO: 19928 - DNA, 20 bp, Artificial Sequence
  Description of Artificial Sequence: Synthetic oligonucleotide
  Target: DMPK; (+) strand; PAM type: YTN; PAM sequence: CTG
gatttggggctgggggaagg

SEQ ID NO: 19929 - DNA, 20 bp, Artificial Sequence
  Description of Artificial Sequence: Synthetic oligonucleotide
  Target: DMPK; (+) strand; PAM type: YTN; PAM sequence: TTT
ggggctgggggaaggaacag

SEQ ID NO: 19930 - DNA, 20 bp, Artificial Sequence
  Description of Artificial Sequence: Synthetic oligonucleotide
  Target: DMPK; (+) strand; PAM type: YTN; PAM sequence: TTG
gggctgggggaaggaacagg

SEQ ID NO: 19931 - DNA, 20 bp, Artificial Sequence
  Description of Artificial Sequence: Synthetic oligonucleotide
  Target: DMPK; (+) strand; PAM type: YTN; PAM sequence: CTG
ggggaaggaacaggacaggg

SEQ ID NO: 19932 - DNA, 20 bp, Artificial Sequence
  Description of Artificial Sequence: Synthetic oligonucleotide
  Target: DMPK; (+) strand; PAM type: YTN; PAM sequence: CTC
aagtgctccggtccagccca

SEQ ID NO: 19933 - DNA, 20 bp, Artificial Sequence
  Description of Artificial Sequence: Synthetic oligonucleotide
  Target: DMPK; (+) strand; PAM type: YTN; PAM sequence: CTC
cggtccagcccatctctcag

SEQ ID NO: 19934 - DNA, 20 bp, Artificial Sequence
  Description of Artificial Sequence: Synthetic oligonucleotide
  Target: DMPK; (+) strand; PAM type: YTN; PAM sequence: CTC
tcagtcctccaggaggagtg

SEQ ID NO: 19935 - DNA, 20 bp, Artificial Sequence
  Description of Artificial Sequence: Synthetic oligonucleotide
  Target: DMPK; (+) strand; PAM type: YTN; PAM sequence: CTC
agtcctccaggaggagtgct

SEQ ID NO: 19936 - DNA, 20 bp, Artificial Sequence
  Description of Artificial Sequence: Synthetic oligonucleotide
  Target: DMPK; (+) strand; PAM type: YTN; PAM sequence: CTC
caggaggagtgctttagtcc

SEQ ID NO: 19937 - DNA, 20 bp, Artificial Sequence
  Description of Artificial Sequence: Synthetic oligonucleotide
  Target: DMPK; (+) strand; PAM type: YTN; PAM sequence: CTT
tagtcctaccccttatttac

SEQ ID NO: 19938 - DNA, 20 bp, Artificial Sequence
  Description of Artificial Sequence: Synthetic oligonucleotide
  Target: DMPK; (+) strand; PAM type: YTN; PAM sequence: TTT
agtcctaccccttatttaca

SEQ ID NO: 19939 - DNA, 20 bp, Artificial Sequence
  Description of Artificial Sequence: Synthetic oligonucleotide
  Target: DMPK; (+) strand; PAM type: YTN; PAM sequence: TTA
gtcctaccccttatttacag

SEQ ID NO: 19940 - DNA, 20 bp, Artificial Sequence
  Description of Artificial Sequence: Synthetic oligonucleotide
  Target: DMPK; (+) strand; PAM type: YTN; PAM sequence: CTA
ccccttatttacagatgaca

SEQ ID NO: 19941 - DNA, 20 bp, Artificial Sequence
  Description of Artificial Sequence: Synthetic oligonucleotide
  Target: DMPK; (+) strand; PAM type: YTN; PAM sequence: CTT
atttacagatgacaatcagg

SEQ ID NO: 19942 - DNA, 20 bp, Artificial Sequence
  Description of Artificial Sequence: Synthetic oligonucleotide
  Target: DMPK; (+) strand; PAM type: YTN; PAM sequence: TTA
tttacagatgacaatcaggc

SEQ ID NO: 19943 - DNA, 20 bp, Artificial Sequence
  Description of Artificial Sequence: Synthetic oligonucleotide
  Target: DMPK; (+) strand; PAM type: YTN; PAM sequence: TTT
acagatgacaatcaggcctc

SEQ ID NO: 19944 - DNA, 20 bp, Artificial Sequence
  Description of Artificial Sequence: Synthetic oligonucleotide
  Target: DMPK; (+) strand; PAM type: YTN; PAM sequence: TTA
cagatgacaatcaggcctct

SEQ ID NO: 19945 - DNA, 20 bp, Artificial Sequence
  Description of Artificial Sequence: Synthetic oligonucleotide
  Target: DMPK; (+) strand; PAM type: YTN; PAM sequence: CTC
tcagaagtcaaggtcctatg

SEQ ID NO: 19946 - DNA, 20 bp, Artificial Sequence
  Description of Artificial Sequence: Synthetic oligonucleotide
  Target: DMPK; (+) strand; PAM type: YTN; PAM sequence: CTC
agaagtcaaggtcctatgac

SEQ ID NO: 19947 - DNA, 20 bp, Artificial Sequence
  Description of Artificial Sequence: Synthetic oligonucleotide
  Target: DMPK; (+) strand; PAM type: YTN; PAM sequence: CTA
tgactaggaatgttaaactg

SEQ ID NO: 19948 - DNA, 20 bp, Artificial Sequence
  Description of Artificial Sequence: Synthetic oligonucleotide
  Target: DMPK; (+) strand; PAM type: YTN; PAM sequence: CTA
ggaatgttaaactgggcagc

SEQ ID NO: 19949 - DNA, 20 bp, Artificial Sequence
  Description of Artificial Sequence: Synthetic oligonucleotide
  Target: DMPK; (+) strand; PAM type: YTN; PAM sequence: TTA
aactgggcagcctgggtggg

SEQ ID NO: 19950 - DNA, 20 bp, Artificial Sequence
  Description of Artificial Sequence: Synthetic oligonucleotide
  Target: DMPK; (+) strand; PAM type: YTN; PAM sequence: CTG
ggcagcctgggtgggggacc

SEQ ID NO: 19951 - DNA, 20 bp, Artificial Sequence
  Description of Artificial Sequence: Synthetic oligonucleotide
  Target: DMPK; (+) strand; PAM type: YTN; PAM sequence: CTG
ggtgggggaccagctggggt

SEQ ID NO: 19952 - DNA, 20 bp, Artificial Sequence
  Description of Artificial Sequence: Synthetic oligonucleotide
  Target: DMPK; (+) strand; PAM type: YTN; PAM sequence: CTG
gggtggaggcttgtggctca

SEQ ID NO: 19953 - DNA, 20 bp, Artificial Sequence
  Description of Artificial Sequence: Synthetic oligonucleotide
  Target: DMPK; (+) strand; PAM type: YTN; PAM sequence: CTT
gtggctcagggactgtgggg

SEQ ID NO: 19954 - DNA, 20 bp, Artificial Sequence
  Description of Artificial Sequence: Synthetic oligonucleotide
  Target: DMPK; (+) strand; PAM type: YTN; PAM sequence: TTG
tggctcagggactgtgggga

SEQ ID NO: 19955 - DNA, 20 bp, Artificial Sequence
  Description of Artificial Sequence: Synthetic oligonucleotide
  Target: DMPK; (+) strand; PAM type: YTN; PAM sequence: CTC
agggactgtggggacaggga

SEQ ID NO: 19956 - DNA, 20 bp, Artificial Sequence
  Description of Artificial Sequence: Synthetic oligonucleotide
  Target: DMPK; (+) strand; PAM type: YTN; PAM sequence: CTG
tggggacagggaggcctgga

SEQ ID NO: 19957 - DNA, 20 bp, Artificial Sequence
  Description of Artificial Sequence: Synthetic oligonucleotide
  Target: DMPK; (+) strand; PAM type: YTN; PAM sequence: CTG
gactcccgggggtggaagaa

SEQ ID NO: 19958 - DNA, 20 bp, Artificial Sequence
  Description of Artificial Sequence: Synthetic oligonucleotide
  Target: DMPK; (+) strand; PAM type: YTN; PAM sequence: CTC
ccgggggtggaagaagtgga

SEQ ID NO: 19959 - DNA, 20 bp, Artificial Sequence
  Description of Artificial Sequence: Synthetic oligonucleotide
  Target: DMPK; (+) strand; PAM type: YTN; PAM sequence: TTC
tggaggaaagagaggggttc

SEQ ID NO: 19960 - DNA, 20 bp, Artificial Sequence
  Description of Artificial Sequence: Synthetic oligonucleotide
  Target: DMPK; (+) strand; PAM type: YTN; PAM sequence: CTG
gaggaaagagaggggttccg

SEQ ID NO: 19961 - DNA, 20 bp, Artificial Sequence
  Description of Artificial Sequence: Synthetic oligonucleotide
  Target: DMPK; (+) strand; PAM type: YTN; PAM sequence: TTC
cggggggttccgggagagtg

SEQ ID NO: 19962 - DNA, 20 bp, Artificial Sequence
  Description of Artificial Sequence: Synthetic oligonucleotide
  Target: DMPK; (+) strand; PAM type: YTN; PAM sequence: TTC
cgggagagtgggccagcagg

SEQ ID NO: 19963 - DNA, 20 bp, Artificial Sequence
  Description of Artificial Sequence: Synthetic oligonucleotide
  Target: DMPK; (+) strand; PAM type: YTN; PAM sequence: CTG
aggacgggggagggaggaga

SEQ ID NO: 19964 - DNA, 20 bp, Artificial Sequence
  Description of Artificial Sequence: Synthetic oligonucleotide
  Target: DMPK; (+) strand; PAM type: YTN; PAM sequence: TTG
agcccttttaaggcagcagg

SEQ ID NO: 19965 - DNA, 20 bp, Artificial Sequence
  Description of Artificial Sequence: Synthetic oligonucleotide
  Target: DMPK; (+) strand; PAM type: YTN; PAM sequence: CTT
ttaaggcagcaggaaccctg

SEQ ID NO: 19966 - DNA, 20 bp, Artificial Sequence
  Description of Artificial Sequence: Synthetic oligonucleotide
  Target: DMPK; (+) strand; PAM type: YTN; PAM sequence: TTT
taaggcagcaggaaccctgg

SEQ ID NO: 19967 - DNA, 20 bp, Artificial Sequence
  Description of Artificial Sequence: Synthetic oligonucleotide
  Target: DMPK; (+) strand; PAM type: YTN; PAM sequence: TTT
aaggcagcaggaaccctggc

SEQ ID NO: 19968 - DNA, 20 bp, Artificial Sequence
  Description of Artificial Sequence: Synthetic oligonucleotide
  Target: DMPK; (+) strand; PAM type: YTN; PAM sequence: TTA
aggcagcaggaaccctggcc

SEQ ID NO: 19969 - DNA, 20 bp, Artificial Sequence
  Description of Artificial Sequence: Synthetic oligonucleotide
  Target: DMPK; (+) strand; PAM type: YTN; PAM sequence: CTG
gccccctcccccgccccagg

SEQ ID NO: 19970 - DNA, 20 bp, Artificial Sequence
  Description of Artificial Sequence: Synthetic oligonucleotide
  Target: DMPK; (+) strand; PAM type: YTN; PAM sequence: CTC
ccccgccccaggcctggcag

SEQ ID NO: 19971 - DNA, 20 bp, Artificial Sequence
  Description of Artificial Sequence: Synthetic oligonucleotide
  Target: DMPK; (+) strand; PAM type: YTN; PAM sequence: CTG
gcaggggaggggccgcgaga

SEQ ID NO: 19972 - DNA, 20 bp, Artificial Sequence
  Description of Artificial Sequence: Synthetic oligonucleotide
  Target: DMPK; (+) strand; PAM type: YTN; PAM sequence: CTC
gggccacaaaaggagtgctc

SEQ ID NO: 19973 - DNA, 20 bp, Artificial Sequence
  Description of Artificial Sequence: Synthetic oligonucleotide
  Target: DMPK; (+) strand; PAM type: YTN; PAM sequence: CTC
ctcccgggagcgccagaccc

SEQ ID NO: 19974 - DNA, 20 bp, Artificial Sequence
  Description of Artificial Sequence: Synthetic oligonucleotide
  Target: DMPK; (+) strand; PAM type: YTN; PAM sequence: CTC
ccgggagcgccagaccccta

SEQ ID NO: 19975 - DNA, 20 bp, Artificial Sequence
  Description of Artificial Sequence: Synthetic oligonucleotide
  Target: DMPK; (+) strand; PAM type: YTN; PAM sequence: CTA
ccccacccggtctcagttta

SEQ ID NO: 19976 - DNA, 20 bp, Artificial Sequence
  Description of Artificial Sequence: Synthetic oligonucleotide
  Target: DMPK; (+) strand; PAM type: YTN; PAM sequence: CTC
agtttaccctgccaacccaa

SEQ ID NO: 19977 - DNA, 20 bp, Artificial Sequence
  Description of Artificial Sequence: Synthetic oligonucleotide
  Target: DMPK; (+) strand; PAM type: YTN; PAM sequence: TTT
accctgccaacccaacttca

SEQ ID NO: 19978 - DNA, 20 bp, Artificial Sequence
  Description of Artificial Sequence: Synthetic oligonucleotide
  Target: DMPK; (+) strand; PAM type: YTN; PAM sequence: TTA
ccctgccaacccaacttcat

SEQ ID NO: 19979 - DNA, 20 bp, Artificial Sequence
  Description of Artificial Sequence: Synthetic oligonucleotide
  Target: DMPK; (+) strand; PAM type: YTN; PAM sequence: CTG
ccaacccaacttcatcctct

SEQ ID NO: 19980 - DNA, 20 bp, Artificial Sequence
  Description of Artificial Sequence: Synthetic oligonucleotide
  Target: DMPK; (+) strand; PAM type: YTN; PAM sequence: CTT
catcctctactaaagggagg

SEQ ID NO: 19981 - DNA, 20 bp, Artificial Sequence
  Description of Artificial Sequence: Synthetic oligonucleotide
  Target: DMPK; (+) strand; PAM type: YTN; PAM sequence: TTC
atcctctactaaagggaggc

SEQ ID NO: 19982 - DNA, 20 bp, Artificial Sequence
  Description of Artificial Sequence: Synthetic oligonucleotide
  Target: DMPK; (+) strand; PAM type: YTN; PAM sequence: CTC
tactaaagggaggccaggag

SEQ ID NO: 19983 - DNA, 20 bp, Artificial Sequence
  Description of Artificial Sequence: Synthetic oligonucleotide
  Target: DMPK; (+) strand; PAM type: YTN; PAM sequence: CTA
ctaaagggaggccaggagag

SEQ ID NO: 19984 - DNA, 20 bp, Artificial Sequence
  Description of Artificial Sequence: Synthetic oligonucleotide
  Target: DMPK; (+) strand; PAM type: YTN; PAM sequence: CTA
aagggaggccaggagagtca

SEQ ID NO: 19985 - DNA, 20 bp, Artificial Sequence
  Description of Artificial Sequence: Synthetic oligonucleotide
  Target: DMPK; (+) strand; PAM type: YTN; PAM sequence: TTA
ggggctgtgggaggttggga

SEQ ID NO: 19986 - DNA, 20 bp, Artificial Sequence
  Description of Artificial Sequence: Synthetic oligonucleotide
  Target: DMPK; (+) strand; PAM type: YTN; PAM sequence: CTG
tgggaggttgggagaaggtt

SEQ ID NO: 19987 - DNA, 20 bp, Artificial Sequence
  Description of Artificial Sequence: Synthetic oligonucleotide
  Target: DMPK; (+) strand; PAM type: YTN; PAM sequence: TTG
ggagaaggtttttccagagg

SEQ ID NO: 19988 - DNA, 20 bp, Artificial Sequence
  Description of Artificial Sequence: Synthetic oligonucleotide
  Target: DMPK; (+) strand; PAM type: YTN; PAM sequence: TTT
ttccagaggctgaatggcct

SEQ ID NO: 19989 - DNA, 20 bp, Artificial Sequence
  Description of Artificial Sequence: Synthetic oligonucleotide
  Target: DMPK; (+) strand; PAM type: YTN; PAM sequence: TTT
tccagaggctgaatggcctg

SEQ ID NO: 19990 - DNA, 20 bp, Artificial Sequence
  Description of Artificial Sequence: Synthetic oligonucleotide
  Target: DMPK; (+) strand; PAM type: YTN; PAM sequence: TTT
ccagaggctgaatggcctgg

SEQ ID NO: 19991 - DNA, 20 bp, Artificial Sequence
  Description of Artificial Sequence: Synthetic oligonucleotide
  Target: DMPK; (+) strand; PAM type: YTN; PAM sequence: TTC
cagaggctgaatggcctggc

SEQ ID NO: 19992 - DNA, 20 bp, Artificial Sequence
  Description of Artificial Sequence: Synthetic oligonucleotide
  Target: DMPK; (+) strand; PAM type: YTN; PAM sequence: CTG
aatggcctggcccttcttgg

SEQ ID NO: 19993 - DNA, 20 bp, Artificial Sequence
  Description of Artificial Sequence: Synthetic oligonucleotide
  Target: DMPK; (+) strand; PAM type: YTN; PAM sequence: CTG
gcccttcttggcctccacct

SEQ ID NO: 19994 - DNA, 20 bp, Artificial Sequence
  Description of Artificial Sequence: Synthetic oligonucleotide
  Target: DMPK; (+) strand; PAM type: YTN; PAM sequence: CTT
cttggcctccaccttcccat

SEQ ID NO: 19995 - DNA, 20 bp, Artificial Sequence
  Description of Artificial Sequence: Synthetic oligonucleotide
  Target: DMPK; (+) strand; PAM type: YTN; PAM sequence: TTC
ttggcctccaccttcccatc

SEQ ID NO: 19996 - DNA, 20 bp, Artificial Sequence
  Description of Artificial Sequence: Synthetic oligonucleotide
  Target: DMPK; (+) strand; PAM type: YTN; PAM sequence: CTT
ggcctccaccttcccatctg

SEQ ID NO: 19997 - DNA, 20 bp, Artificial Sequence
  Description of Artificial Sequence: Synthetic oligonucleotide
  Target: DMPK; (+) strand; PAM type: YTN; PAM sequence: TTG
gcctccaccttcccatctgt

SEQ ID NO: 19998 - DNA, 20 bp, Artificial Sequence
  Description of Artificial Sequence: Synthetic oligonucleotide
  Target: DMPK; (+) strand; PAM type: YTN; PAM sequence: CTC
caccttcccatctgtgaaat

SEQ ID NO: 19999 - DNA, 20 bp, Artificial Sequence
  Description of Artificial Sequence: Synthetic oligonucleotide
  Target: DMPK; (+) strand; PAM type: YTN; PAM sequence: CTT
cccatctgtgaaatgggagg

SEQ ID NO: 20000 - DNA, 20 bp, Artificial Sequence
  Description of Artificial Sequence: Synthetic oligonucleotide
  Target: DMPK; (+) strand; PAM type: YTN; PAM sequence: TTC
ccatctgtgaaatgggagga

SEQ ID NO: 20001 - DNA, 20 bp, Artificial Sequence
  Description of Artificial Sequence: Synthetic oligonucleotide
  Target: DMPK; (+) strand; PAM type: YTN; PAM sequence: CTG
tgaaatgggaggaggaggga

SEQ ID NO: 20002 - DNA, 20 bp, Artificial Sequence
  Description of Artificial Sequence: Synthetic oligonucleotide
  Target: DMPK; (+) strand; PAM type: YTN; PAM sequence: CTG
ggtcagaaagagatggacac

SEQ ID NO: 20003 - DNA, 20 bp, Artificial Sequence
  Description of Artificial Sequence: Synthetic oligonucleotide
  Target: DMPK; (+) strand; PAM type: YTN; PAM sequence: TTT
gttacacacaggccaaaaac

SEQ ID NO: 20004 - DNA, 20 bp, Artificial Sequence
  Description of Artificial Sequence: Synthetic oligonucleotide
  Target: DMPK; (+) strand; PAM type: YTN; PAM sequence: TTG
ttacacacaggccaaaaacc

SEQ ID NO: 20005 - DNA, 20 bp, Artificial Sequence
  Description of Artificial Sequence: Synthetic oligonucleotide
  Target: DMPK; (+) strand; PAM type: YTN; PAM sequence: TTA
cacacaggccaaaaaccaaa

SEQ ID NO: 20006 - DNA, 20 bp, Artificial Sequence
  Description of Artificial Sequence: Synthetic oligonucleotide
  Target: DMPK; (+) strand; PAM type: YTN; PAM sequence: CTG
agggccagacatatgagggc

SEQ ID NO: 20007 - DNA, 20 bp, Artificial Sequence
  Description of Artificial Sequence: Synthetic oligonucleotide
  Target: DMPK; (+) strand; PAM type: YTN; PAM sequence: CTG
ggaatgaaagaaaccagtga

SEQ ID NO: 20008 - DNA, 20 bp, Artificial Sequence
  Description of Artificial Sequence: Synthetic oligonucleotide
  Target: DMPK; (+) strand; PAM type: YTN; PAM sequence: CTG
ggcttggggaggaggtgggc

SEQ ID NO: 20009 - DNA, 20 bp, Artificial Sequence
  Description of Artificial Sequence: Synthetic oligonucleotide
  Target: DMPK; (+) strand; PAM type: YTN; PAM sequence: CTT
ggggaggaggtgggcagaca

SEQ ID NO: 20010 - DNA, 20 bp, Artificial Sequence
  Description of Artificial Sequence: Synthetic oligonucleotide
  Target: DMPK; (+) strand; PAM type: YTN; PAM sequence: TTG
gggaggaggtgggcagacaa

SEQ ID NO: 20011 - DNA, 20 bp, Artificial Sequence
  Description of Artificial Sequence: Synthetic oligonucleotide
  Target: DMPK; (+) strand; PAM type: YTN; PAM sequence: CTG
gcagaagcggaagcatcctc

SEQ ID NO: 20012 - DNA, 20 bp, Artificial Sequence
  Description of Artificial Sequence: Synthetic oligonucleotide
  Target: DMPK; (+) strand; PAM type: YTN; PAM sequence: CTC
cttccagccctggccccagg

SEQ ID NO: 20013 - DNA, 20 bp, Artificial Sequence
  Description of Artificial Sequence: Synthetic oligonucleotide
  Target: DMPK; (+) strand; PAM type: YTN; PAM sequence: CTT
ccagccctggccccaggccc

SEQ ID NO: 20014 - DNA, 20 bp, Artificial Sequence
  Description of Artificial Sequence: Synthetic oligonucleotide
  Target: DMPK; (+) strand; PAM type: YTN; PAM sequence: TTC
cagccctggccccaggccct

SEQ ID NO: 20015 - DNA, 20 bp, Artificial Sequence
  Description of Artificial Sequence: Synthetic oligonucleotide
  Target: DMPK; (+) strand; PAM type: YTN; PAM sequence: CTG
gccccaggccctggaaagcc

SEQ ID NO: 20016 - DNA, 20 bp, Artificial Sequence
  Description of Artificial Sequence: Synthetic oligonucleotide
  Target: DMPK; (+) strand; PAM type: YTN; PAM sequence: CTG
gaaagcccttgcaagaaggg

SEQ ID NO: 20017 - DNA, 20 bp, Artificial Sequence
  Description of Artificial Sequence: Synthetic oligonucleotide
  Target: DMPK; (+) strand; PAM type: YTN; PAM sequence: CTT
gcaagaaggggttttgtggg

SEQ ID NO: 20018 - DNA, 20 bp, Artificial Sequence
  Description of Artificial Sequence: Synthetic oligonucleotide
  Target: DMPK; (+) strand; PAM type: YTN; PAM sequence: TTG
caagaaggggttttgtggga

SEQ ID NO: 20019 - DNA, 20 bp, Artificial Sequence
  Description of Artificial Sequence: Synthetic oligonucleotide
  Target: DMPK; (+) strand; PAM type: YTN; PAM sequence: TTT
tgtgggacagctggaaggtt

SEQ ID NO: 20020 - DNA, 20 bp, Artificial Sequence
  Description of Artificial Sequence: Synthetic oligonucleotide
  Target: DMPK; (+) strand; PAM type: YTN; PAM sequence: TTT
gtgggacagctggaaggttg

SEQ ID NO: 20021 - DNA, 20 bp, Artificial Sequence
  Description of Artificial Sequence: Synthetic oligonucleotide
  Target: DMPK; (+) strand; PAM type: YTN; PAM sequence: TTG
tgggacagctggaaggttgg

SEQ ID NO: 20022 - DNA, 20 bp, Artificial Sequence
  Description of Artificial Sequence: Synthetic oligonucleotide
  Target: DMPK; (+) strand; PAM type: YTN; PAM sequence: CTG
gaaggttggaggccctgggc

SEQ ID NO: 20023 - DNA, 20 bp, Artificial Sequence
  Description of Artificial Sequence: Synthetic oligonucleotide
  Target: DMPK; (+) strand; PAM type: YTN; PAM sequence: TTG
gaggccctgggccaggagaa

SEQ ID NO: 20024 - DNA, 20 bp, Artificial Sequence
  Description of Artificial Sequence: Synthetic oligonucleotide
  Target: DMPK; (+) strand; PAM type: YTN; PAM sequence: CTG
ggccaggagaactaaaggac

SEQ ID NO: 20025 - DNA, 20 bp, Artificial Sequence
  Description of Artificial Sequence: Synthetic oligonucleotide
  Target: DMPK; (+) strand; PAM type: YTN; PAM sequence: CTA
aaggacgcagggacccgggg

SEQ ID NO: 20026 - DNA, 20 bp, Artificial Sequence
  Description of Artificial Sequence: Synthetic oligonucleotide
  Target: DMPK; (+) strand; PAM type: YTN; PAM sequence: CTG
acccacacggctcataggaa

SEQ ID NO: 20027 - DNA, 20 bp, Artificial Sequence
  Description of Artificial Sequence: Synthetic oligonucleotide
  Target: DMPK; (+) strand; PAM type: YTN; PAM sequence: CTC
ataggaaccgagactttggg

SEQ ID NO: 20028 - DNA, 20 bp, Artificial Sequence
  Description of Artificial Sequence: Synthetic oligonucleotide
  Target: DMPK; (+) strand; PAM type: YTN; PAM sequence: CTT
tggggctgggggtgggggtg

SEQ ID NO: 20029 - DNA, 20 bp, Artificial Sequence
  Description of Artificial Sequence: Synthetic oligonucleotide
  Target: DMPK; (+) strand; PAM type: YTN; PAM sequence: TTT
ggggctgggggtgggggtgg

SEQ ID NO: 20030 - DNA, 20 bp, Artificial Sequence
  Description of Artificial Sequence: Synthetic oligonucleotide
  Target: DMPK; (+) strand; PAM type: YTN; PAM sequence: TTG
gggctgggggtgggggtggg

SEQ ID NO: 20031 - DNA, 20 bp, Artificial Sequence
  Description of Artificial Sequence: Synthetic oligonucleotide
  Target: DMPK; (+) strand; PAM type: YTN; PAM sequence: CTG
ggggtgggggtgggtgcaga

SEQ ID NO: 20032 - DNA, 20 bp, Artificial Sequence
  Description of Artificial Sequence: Synthetic oligonucleotide
  Target: DMPK; (+) strand; PAM type: YTN; PAM sequence: CTA
caaaagaaggagacacaccc

SEQ ID NO: 20033 - DNA, 20 bp, Artificial Sequence
  Description of Artificial Sequence: Synthetic oligonucleotide
  Target: DMPK; (+) strand; PAM type: YTN; PAM sequence: TTG
tccctcctggatcgcagagg

SEQ ID NO: 20034 - DNA, 20 bp, Artificial Sequence
  Description of Artificial Sequence: Synthetic oligonucleotide
  Target: DMPK; (+) strand; PAM type: YTN; PAM sequence: CTC
ctggatcgcagaggaggggg

SEQ ID NO: 20035 - DNA, 20 bp, Artificial Sequence
  Description of Artificial Sequence: Synthetic oligonucleotide
  Target: DMPK; (+) strand; PAM type: YTN; PAM sequence: CTG
gatcgcagaggagggggcac

SEQ ID NO: 20036 - DNA, 20 bp, Artificial Sequence
  Description of Artificial Sequence: Synthetic oligonucleotide
  Target: DMPK; (+) strand; PAM type: YTN; PAM sequence: CTG
gtggcgcctgtctgcaaagc

SEQ ID NO: 20037 - DNA, 20 bp, Artificial Sequence
  Description of Artificial Sequence: Synthetic oligonucleotide
  Target: DMPK; (+) strand; PAM type: YTN; PAM sequence: CTG
tctgcaaagctggttctccc

SEQ ID NO: 20038 - DNA, 20 bp, Artificial Sequence
  Description of Artificial Sequence: Synthetic oligonucleotide
  Target: DMPK; (+) strand; PAM type: YTN; PAM sequence: CTG
caaagctggttctcccacag

SEQ ID NO: 20039 - DNA, 20 bp, Artificial Sequence
  Description of Artificial Sequence: Synthetic oligonucleotide
  Target: DMPK; (+) strand; PAM type: YTN; PAM sequence: CTG
gttctcccacagggcccgcg

SEQ ID NO: 20040 - DNA, 20 bp, Artificial Sequence
  Description of Artificial Sequence: Synthetic oligonucleotide
  Target: DMPK; (+) strand; PAM type: YTN; PAM sequence: TTC
tcccacagggcccgcgtgag

SEQ ID NO: 20041 - DNA, 20 bp, Artificial Sequence
  Description of Artificial Sequence: Synthetic oligonucleotide
  Target: DMPK; (+) strand; PAM type: YTN; PAM sequence: CTC
ccacagggcccgcgtgagtc

SEQ ID NO: 20042 - DNA, 20 bp, Artificial Sequence
  Description of Artificial Sequence: Synthetic oligonucleotide
  Target: DMPK; (+) strand; PAM type: YTN; PAM sequence: CTC
ccagtgcctgggcacctgtt

SEQ ID NO: 20043 - DNA, 20 bp, Artificial Sequence
  Description of Artificial Sequence: Synthetic oligonucleotide
  Target: DMPK; (+) strand; PAM type: YTN; PAM sequence: CTG
ggcacctgttggggcagctg

SEQ ID NO: 20044 - DNA, 20 bp, Artificial Sequence
  Description of Artificial Sequence: Synthetic oligonucleotide
  Target: DMPK; (+) strand; PAM type: YTN; PAM sequence: CTG
ttggggcagctggagaggct

SEQ ID NO: 20045 - DNA, 20 bp, Artificial Sequence
  Description of Artificial Sequence: Synthetic oligonucleotide
  Target: DMPK; (+) strand; PAM type: YTN; PAM sequence: TTG
gggcagctggagaggctggc

SEQ ID NO: 20046 - DNA, 20 bp, Artificial Sequence
  Description of Artificial Sequence: Synthetic oligonucleotide
  Target: DMPK; (+) strand; PAM type: YTN; PAM sequence: CTG
gagaggctggcgccgaacac

SEQ ID NO: 20047 - DNA, 20 bp, Artificial Sequence
  Description of Artificial Sequence: Synthetic oligonucleotide
  Target: DMPK; (+) strand; PAM type: YTN; PAM sequence: CTG
gcgccgaacacctgcctgtc

SEQ ID NO: 20048 - DNA, 20 bp, Artificial Sequence
  Description of Artificial Sequence: Synthetic oligonucleotide
  Target: DMPK; (+) strand; PAM type: YTN; PAM sequence: CTG
cctgtcggctgcgcccctgg

SEQ ID NO: 20049 - DNA, 20 bp, Artificial Sequence
  Description of Artificial Sequence: Synthetic oligonucleotide
  Target: DMPK; (+) strand; PAM type: YTN; PAM sequence: CTG
tcggctgcgcccctggcagc

SEQ ID NO: 20050 - DNA, 20 bp, Artificial Sequence
  Description of Artificial Sequence: Synthetic oligonucleotide
  Target: DMPK; (+) strand; PAM type: YTN; PAM sequence: CTG
cgcccctggcagctgcccca

SEQ ID NO: 20051 - DNA, 20 bp, Artificial Sequence
  Description of Artificial Sequence: Synthetic oligonucleotide
  Target: DMPK; (+) strand; PAM type: YTN; PAM sequence: CTG
gcagctgccccatgctggcc

SEQ ID NO: 20052 - DNA, 20 bp, Artificial Sequence
  Description of Artificial Sequence: Synthetic oligonucleotide
  Target: DMPK; (+) strand; PAM type: YTN; PAM sequence: CTG
ccccatgctggccctcctgg

SEQ ID NO: 20053 - DNA, 20 bp, Artificial Sequence
  Description of Artificial Sequence: Synthetic oligonucleotide
  Target: DMPK; (+) strand; PAM type: YTN; PAM sequence: CTG
gccctcctggcttgccccag

SEQ ID NO: 20054 - DNA, 20 bp, Artificial Sequence
  Description of Artificial Sequence: Synthetic oligonucleotide
  Target: DMPK; (+) strand; PAM type: YTN; PAM sequence: CTC
ctggcttgccccaggccaca

SEQ ID NO: 20055 - DNA, 20 bp, Artificial Sequence
  Description of Artificial Sequence: Synthetic oligonucleotide
  Target: DMPK; (+) strand; PAM type: YTN; PAM sequence: CTG
gcttgccccaggccacagga

SEQ ID NO: 20056 - DNA, 20 bp, Artificial Sequence
  Description of Artificial Sequence: Synthetic oligonucleotide
  Target: DMPK; (+) strand; PAM type: YTN; PAM sequence: CTT
gccccaggccacaggaaacc

SEQ ID NO: 20057 - DNA, 20 bp, Artificial Sequence
  Description of Artificial Sequence: Synthetic oligonucleotide
  Target: DMPK; (+) strand; PAM type: YTN; PAM sequence: TTG
ccccaggccacaggaaacca

SEQ ID NO: 20058 - DNA, 20 bp, Artificial Sequence
  Description of Artificial Sequence: Synthetic oligonucleotide
  Target: DMPK; (+) strand; PAM type: YTN; PAM sequence: CTT
ttggggggagggtcctagga

SEQ ID NO: 20059 - DNA, 20 bp, Artificial Sequence
  Description of Artificial Sequence: Synthetic oligonucleotide
  Target: DMPK; (+) strand; PAM type: YTN; PAM sequence: TTT
tggggggagggtcctaggag

SEQ ID NO: 20060 - DNA, 20 bp, Artificial Sequence
  Description of Artificial Sequence: Synthetic oligonucleotide
  Target: DMPK; (+) strand; PAM type: YTN; PAM sequence: TTT
ggggggagggtcctaggaga

SEQ ID NO: 20061 - DNA, 20 bp, Artificial Sequence
  Description of Artificial Sequence: Synthetic oligonucleotide
  Target: DMPK; (+) strand; PAM type: YTN; PAM sequence: TTG
gggggagggtcctaggagag

SEQ ID NO: 20062 - DNA, 20 bp, Artificial Sequence
  Description of Artificial Sequence: Synthetic oligonucleotide
  Target: DMPK; (+) strand; PAM type: YTN; PAM sequence: CTA
ggagagggagctcccagcat

SEQ ID NO: 20063 - DNA, 20 bp, Artificial Sequence
  Description of Artificial Sequence: Synthetic oligonucleotide
  Target: DMPK; (+) strand; PAM type: YTN; PAM sequence: CTC
ccagcatgaccctgaccctg

SEQ ID NO: 20064 - DNA, 20 bp, Artificial Sequence
  Description of Artificial Sequence: Synthetic oligonucleotide
  Target: DMPK; (+) strand; PAM type: YTN; PAM sequence: CTG
accctgaccctgaggcgggg

SEQ ID NO: 20065 - DNA, 20 bp, Artificial Sequence
  Description of Artificial Sequence: Synthetic oligonucleotide
  Target: DMPK; (+) strand; PAM type: YTN; PAM sequence: CTG
accctgaggcggggtgcaga

SEQ ID NO: 20066 - DNA, 20 bp, Artificial Sequence
  Description of Artificial Sequence: Synthetic oligonucleotide
  Target: DMPK; (+) strand; PAM type: YTN; PAM sequence: CTG
aggcggggtgcagagaggcc

SEQ ID NO: 20067 - DNA, 20 bp, Artificial Sequence
  Description of Artificial Sequence: Synthetic oligonucleotide
  Target: DMPK; (+) strand; PAM type: YTN; PAM sequence: CTG
ttggcagcctagcctgctgt

SEQ ID NO: 20068 - DNA, 20 bp, Artificial Sequence
  Description of Artificial Sequence: Synthetic oligonucleotide
  Target: DMPK; (+) strand; PAM type: YTN; PAM sequence: TTG
gcagcctagcctgctgtgac

SEQ ID NO: 20069 - DNA, 20 bp, Artificial Sequence
  Description of Artificial Sequence: Synthetic oligonucleotide
  Target: DMPK; (+) strand; PAM type: YTN; PAM sequence: CTA
gcctgctgtgactcctaagc

SEQ ID NO: 20070 - DNA, 20 bp, Artificial Sequence
  Description of Artificial Sequence: Synthetic oligonucleotide
  Target: DMPK; (+) strand; PAM type: YTN; PAM sequence: CTG
ctgtgactcctaagccatgg

SEQ ID NO: 20071 - DNA, 20 bp, Artificial Sequence
  Description of Artificial Sequence: Synthetic oligonucleotide
  Target: DMPK; (+) strand; PAM type: YTN; PAM sequence: CTG
tgactcctaagccatggctc

SEQ ID NO: 20072 - DNA, 20 bp, Artificial Sequence
  Description of Artificial Sequence: Synthetic oligonucleotide
  Target: DMPK; (+) strand; PAM type: YTN; PAM sequence: CTC
ctaagccatggctctgagtc

SEQ ID NO: 20073 - DNA, 20 bp, Artificial Sequence
  Description of Artificial Sequence: Synthetic oligonucleotide
  Target: DMPK; (+) strand; PAM type: YTN; PAM sequence: CTA
agccatggctctgagtcaca

SEQ ID NO: 20074 - DNA, 20 bp, Artificial Sequence
  Description of Artificial Sequence: Synthetic oligonucleotide
  Target: DMPK; (+) strand; PAM type: YTN; PAM sequence: CTC
tgagtcacagccaccctagc

SEQ ID NO: 20075 - DNA, 20 bp, Artificial Sequence
  Description of Artificial Sequence: Synthetic oligonucleotide
  Target: DMPK; (+) strand; PAM type: YTN; PAM sequence: CTG
agtcacagccaccctagcct

SEQ ID NO: 20076 - DNA, 20 bp, Artificial Sequence
  Description of Artificial Sequence: Synthetic oligonucleotide
  Target: DMPK; (+) strand; PAM type: YTN; PAM sequence: CTA
gcctctgctgaccttactct

SEQ ID NO: 20077 - DNA, 20 bp, Artificial Sequence
  Description of Artificial Sequence: Synthetic oligonucleotide
  Target: DMPK; (+) strand; PAM type: YTN; PAM sequence: CTC
tgctgaccttactctgcccc

SEQ ID NO: 20078 - DNA, 20 bp, Artificial Sequence
  Description of Artificial Sequence: Synthetic oligonucleotide
  Target: DMPK; (+) strand; PAM type: YTN; PAM sequence: CTG
ctgaccttactctgcccctc

SEQ ID NO: 20079 - DNA, 20 bp, Artificial Sequence
  Description of Artificial Sequence: Synthetic oligonucleotide
  Target: DMPK; (+) strand; PAM type: YTN; PAM sequence: CTG
accttactctgcccctccag

SEQ ID NO: 20080 - DNA, 20 bp, Artificial Sequence
  Description of Artificial Sequence: Synthetic oligonucleotide
  Target: DMPK; (+) strand; PAM type: YTN; PAM sequence: CTT
actctgcccctccagagtgg

SEQ ID NO: 20081 - DNA, 20 bp, Artificial Sequence
  Description of Artificial Sequence: Synthetic oligonucleotide
  Target: DMPK; (+) strand; PAM type: YTN; PAM sequence: TTA
ctctgcccctccagagtggt

SEQ ID NO: 20082 - DNA, 20 bp, Artificial Sequence
  Description of Artificial Sequence: Synthetic oligonucleotide
  Target: DMPK; (+) strand; PAM type: YTN; PAM sequence: CTC
tgcccctccagagtggtggc

SEQ ID NO: 20083 - DNA, 20 bp, Artificial Sequence
  Description of Artificial Sequence: Synthetic oligonucleotide
  Target: DMPK; (+) strand; PAM type: YTN; PAM sequence: CTG
cccctccagagtggtggcat

SEQ ID NO: 20084 - DNA, 20 bp, Artificial Sequence
  Description of Artificial Sequence: Synthetic oligonucleotide
  Target: DMPK; (+) strand; PAM type: YTN; PAM sequence: CTC
cagagtggtggcataggaca

SEQ ID NO: 20085 - DNA, 20 bp, Artificial Sequence
  Description of Artificial Sequence: Synthetic oligonucleotide
  Target: DMPK; (+) strand; PAM type: YTN; PAM sequence: TTG
ccccagggcccaggtccaca

SEQ ID NO: 20086 - DNA, 20 bp, Artificial Sequence
  Description of Artificial Sequence: Synthetic oligonucleotide
  Target: DMPK; (+) strand; PAM type: YTN; PAM sequence: CTC
tgagccccaggatgggagga

SEQ ID NO: 20087 - DNA, 20 bp, Artificial Sequence
  Description of Artificial Sequence: Synthetic oligonucleotide
  Target: DMPK; (+) strand; PAM type: YTN; PAM sequence: CTG
agccccaggatgggaggatc

SEQ ID NO: 20088 - DNA, 20 bp, Artificial Sequence
  Description of Artificial Sequence: Synthetic oligonucleotide
  Target: DMPK; (+) strand; PAM type: YTN; PAM sequence: CTC
cccatgcccatcctgccatc

SEQ ID NO: 20089 - DNA, 20 bp, Artificial Sequence
  Description of Artificial Sequence: Synthetic oligonucleotide
  Target: DMPK; (+) strand; PAM type: YTN; PAM sequence: CTG
ccatcctgcccccccaacag

SEQ ID NO: 20090 - DNA, 20 bp, Artificial Sequence
  Description of Artificial Sequence: Synthetic oligonucleotide
  Target: DMPK; (+) strand; PAM type: YTN; PAM sequence: CTG
cccccccaacagccaggcct

SEQ ID NO: 20091 - DNA, 20 bp, Artificial Sequence
  Description of Artificial Sequence: Synthetic oligonucleotide
  Target: DMPK; (+) strand; PAM type: YTN; PAM sequence: CTC
tgtgcccagacctgtctcct

SEQ ID NO: 20092 - DNA, 20 bp, Artificial Sequence
  Description of Artificial Sequence: Synthetic oligonucleotide
  Target: DMPK; (+) strand; PAM type: YTN; PAM sequence: CTG
tgcccagacctgtctcctgc

SEQ ID NO: 20093 - DNA, 20 bp, Artificial Sequence
  Description of Artificial Sequence: Synthetic oligonucleotide
  Target: DMPK; (+) strand; PAM type: YTN; PAM sequence: CTG
tctcctgccccacccccacc

SEQ ID NO: 20094 - DNA, 20 bp, Artificial Sequence
  Description of Artificial Sequence: Synthetic oligonucleotide
  Target: DMPK; (+) strand; PAM type: YTN; PAM sequence: CTC
ctgccccacccccaccccat

SEQ ID NO: 20095 - DNA, 20 bp, Artificial Sequence
  Description of Artificial Sequence: Synthetic oligonucleotide
  Target: DMPK; (+) strand; PAM type: YTN; PAM sequence: CTG
ccccacccccaccccatctg

SEQ ID NO: 20096 - DNA, 20 bp, Artificial Sequence
  Description of Artificial Sequence: Synthetic oligonucleotide
  Target: DMPK; (+) strand; PAM type: YTN; PAM sequence: CTG
caggagccccgagggtaggc

SEQ ID NO: 20097 - DNA, 20 bp, Artificial Sequence
  Description of Artificial Sequence: Synthetic oligonucleotide
  Target: DMPK; (+) strand; PAM type: YTN; PAM sequence: CTC
accccactgcaagaagtcgg

SEQ ID NO: 20098 - DNA, 20 bp, Artificial Sequence
  Description of Artificial Sequence: Synthetic oligonucleotide
  Target: DMPK; (+) strand; PAM type: YTN; PAM sequence: CTG
caagaagtcggccacgtact

SEQ ID NO: 20099 - DNA, 20 bp, Artificial Sequence
  Description of Artificial Sequence: Synthetic oligonucleotide
  Target: DMPK; (+) strand; PAM type: YTN; PAM sequence: CTT
gtcctgggccagttcggagg

SEQ ID NO: 20100 - DNA, 20 bp, Artificial Sequence
  Description of Artificial Sequence: Synthetic oligonucleotide
  Target: DMPK; (+) strand; PAM type: YTN; PAM sequence: TTG
tcctgggccagttcggaggc

SEQ ID NO: 20101 - DNA, 20 bp, Artificial Sequence
  Description of Artificial Sequence: Synthetic oligonucleotide
  Target: DMPK; (+) strand; PAM type: YTN; PAM sequence: CTG
ggccagttcggaggcgccca

SEQ ID NO: 20102 - DNA, 20 bp, Artificial Sequence
  Description of Artificial Sequence: Synthetic oligonucleotide
  Target: DMPK; (+) strand; PAM type: YTN; PAM sequence: TTC
ggaggcgcccagctcctggt

SEQ ID NO: 20103 - DNA, 20 bp, Artificial Sequence
  Description of Artificial Sequence: Synthetic oligonucleotide
  Target: DMPK; (+) strand; PAM type: YTN; PAM sequence: CTC
ctggtggacgcccaggagaa

SEQ ID NO: 20104 - DNA, 20 bp, Artificial Sequence
  Description of Artificial Sequence: Synthetic oligonucleotide
  Target: DMPK; (+) strand; PAM type: YTN; PAM sequence: CTG
gtggacgcccaggagaaggt

SEQ ID NO: 20105 - DNA, 20 bp, Artificial Sequence
  Description of Artificial Sequence: Synthetic oligonucleotide
  Target: DMPK; (+) strand; PAM type: YTN; PAM sequence: CTC
cagccccaggaagcccgggt

SEQ ID NO: 20106 - DNA, 20 bp, Artificial Sequence
  Description of Artificial Sequence: Synthetic oligonucleotide
  Target: DMPK; (+) strand; PAM type: YTN; PAM sequence: CTG
ctggagccgcctcagccgca

SEQ ID NO: 20107 - DNA, 20 bp, Artificial Sequence
  Description of Artificial Sequence: Synthetic oligonucleotide
  Target: DMPK; (+) strand; PAM type: YTN; PAM sequence: CTG
gagccgcctcagccgcacct

SEQ ID NO: 20108 - DNA, 20 bp, Artificial Sequence
  Description of Artificial Sequence: Synthetic oligonucleotide
  Target: DMPK; (+) strand; PAM type: YTN; PAM sequence: CTC
agccgcacctcggctgacat

SEQ ID NO: 20109 - DNA, 20 bp, Artificial Sequence
  Description of Artificial Sequence: Synthetic oligonucleotide
  Target: DMPK; (+) strand; PAM type: YTN; PAM sequence: CTC
ggctgacatgttggacaggc

SEQ ID NO: 20110 - DNA, 20 bp, Artificial Sequence
  Description of Artificial Sequence: Synthetic oligonucleotide
  Target: DMPK; (+) strand; PAM type: YTN; PAM sequence: CTG
acatgttggacaggcagcac

SEQ ID NO: 20111 - DNA, 20 bp, Artificial Sequence
  Description of Artificial Sequence: Synthetic oligonucleotide
  Target: DMPK; (+) strand; PAM type: YTN; PAM sequence: TTG
gacaggcagcaccatggccc

SEQ ID NO: 20112 - DNA, 20 bp, Artificial Sequence
  Description of Artificial Sequence: Synthetic oligonucleotide
  Target: DMPK; (+) strand; PAM type: YTN; PAM sequence: CTC
cccgggccgggggctcgggg

SEQ ID NO: 20113 - DNA, 20 bp, Artificial Sequence
  Description of Artificial Sequence: Synthetic oligonucleotide
  Target: DMPK; (+) strand; PAM type: YTN; PAM sequence: CTC
ggggtcctcctgtcacaggg

SEQ ID NO: 20114 - DNA, 20 bp, Artificial Sequence
  Description of Artificial Sequence: Synthetic oligonucleotide
  Target: DMPK; (+) strand; PAM type: YTN; PAM sequence: CTC
ctgtcacagggcctggcagc

SEQ ID NO: 20115 - DNA, 20 bp, Artificial Sequence
  Description of Artificial Sequence: Synthetic oligonucleotide
  Target: DMPK; (+) strand; PAM type: YTN; PAM sequence: CTG
tcacagggcctggcagcccc

SEQ ID NO: 20116 - DNA, 20 bp, Artificial Sequence
  Description of Artificial Sequence: Synthetic oligonucleotide
  Target: DMPK; (+) strand; PAM type: YTN; PAM sequence: CTG
gcagcccctgtccaggccct

SEQ ID NO: 20117 - DNA, 20 bp, Artificial Sequence
  Description of Artificial Sequence: Synthetic oligonucleotide
  Target: DMPK; (+) strand; PAM type: YTN; PAM sequence: CTG
tccaggccctggagccctgg

SEQ ID NO: 20118 - DNA, 20 bp, Artificial Sequence
  Description of Artificial Sequence: Synthetic oligonucleotide
  Target: DMPK; (+) strand; PAM type: YTN; PAM sequence: CTG
gagccctggctgcatgtctg

SEQ ID NO: 20119 - DNA, 20 bp, Artificial Sequence
  Description of Artificial Sequence: Synthetic oligonucleotide
  Target: DMPK; (+) strand; PAM type: YTN; PAM sequence: CTG
gctgcatgtctgcctgtccc

SEQ ID NO: 20120 - DNA, 20 bp, Artificial Sequence
  Description of Artificial Sequence: Synthetic oligonucleotide
  Target: DMPK; (+) strand; PAM type: YTN; PAM sequence: CTG
catgtctgcctgtccctggc

SEQ ID NO: 20121 - DNA, 20 bp, Artificial Sequence
  Description of Artificial Sequence: Synthetic oligonucleotide
  Target: DMPK; (+) strand; PAM type: YTN; PAM sequence: CTG
cctgtccctggctgtcccct

SEQ ID NO: 20122 - DNA, 20 bp, Artificial Sequence
  Description of Artificial Sequence: Synthetic oligonucleotide
  Target: DMPK; (+) strand; PAM type: YTN; PAM sequence: CTG
tccctggctgtcccctgggc

SEQ ID NO: 20123 - DNA, 20 bp, Artificial Sequence
  Description of Artificial Sequence: Synthetic oligonucleotide
  Target: DMPK; (+) strand; PAM type: YTN; PAM sequence: CTG
gctgtcccctgggcctctct

SEQ ID NO: 20124 - DNA, 20 bp, Artificial Sequence
  Description of Artificial Sequence: Synthetic oligonucleotide
  Target: DMPK; (+) strand; PAM type: YTN; PAM sequence: CTG
tcccctgggcctctctggcc

SEQ ID NO: 20125 - DNA, 20 bp, Artificial Sequence
  Description of Artificial Sequence: Synthetic oligonucleotide
  Target: DMPK; (+) strand; PAM type: YTN; PAM sequence: CTG
ggcctctctggccacttctc

SEQ ID NO: 20126 - DNA, 20 bp, Artificial Sequence
  Description of Artificial Sequence: Synthetic oligonucleotide
  Target: DMPK; (+) strand; PAM type: YTN; PAM sequence: CTC
tctggccacttctctctgcg

SEQ ID NO: 20127 - DNA, 20 bp, Artificial Sequence
  Description of Artificial Sequence: Synthetic oligonucleotide
  Target: DMPK; (+) strand; PAM type: YTN; PAM sequence: CTC
tggccacttctctctgcggc

SEQ ID NO: 20128 - DNA, 20 bp, Artificial Sequence
  Description of Artificial Sequence: Synthetic oligonucleotide
  Target: DMPK; (+) strand; PAM type: YTN; PAM sequence: CTG
gccacttctctctgcggccg

SEQ ID NO: 20129 - DNA, 20 bp, Artificial Sequence
  Description of Artificial Sequence: Synthetic oligonucleotide
  Target: DMPK; (+) strand; PAM type: YTN; PAM sequence: CTT
ctctctgcggccggccgagg

SEQ ID NO: 20130 - DNA, 20 bp, Artificial Sequence
  Description of Artificial Sequence: Synthetic oligonucleotide
  Target: DMPK; (+) strand; PAM type: YTN; PAM sequence: TTC
tctctgcggccggccgaggc

SEQ ID NO: 20131 - DNA, 20 bp, Artificial Sequence
  Description of Artificial Sequence: Synthetic oligonucleotide
  Target: DMPK; (+) strand; PAM type: YTN; PAM sequence: CTC
tctgcggccggccgaggcct

SEQ ID NO: 20132 - DNA, 20 bp, Artificial Sequence
  Description of Artificial Sequence: Synthetic oligonucleotide
  Target: DMPK; (+) strand; PAM type: YTN; PAM sequence: CTC
tgcggccggccgaggcctcc

SEQ ID NO: 20133 - DNA, 20 bp, Artificial Sequence
  Description of Artificial Sequence: Synthetic oligonucleotide
  Target: DMPK; (+) strand; PAM type: YTN; PAM sequence: CTG
cggccggccgaggcctcctc

SEQ ID NO: 20134 - DNA, 20 bp, Artificial Sequence
  Description of Artificial Sequence: Synthetic oligonucleotide
  Target: DMPK; (+) strand; PAM type: YTN; PAM sequence: CTC
ctccccttctccccacccct

SEQ ID NO: 20135 - DNA, 20 bp, Artificial Sequence
  Description of Artificial Sequence: Synthetic oligonucleotide
  Target: DMPK; (+) strand; PAM type: YTN; PAM sequence: CTC
cccttctccccaccccttgg

SEQ ID NO: 20136 - DNA, 20 bp, Artificial Sequence
  Description of Artificial Sequence: Synthetic oligonucleotide
  Target: DMPK; (+) strand; PAM type: YTN; PAM sequence: CTT
ctccccaccccttggtccag

SEQ ID NO: 20137 - DNA, 20 bp, Artificial Sequence
  Description of Artificial Sequence: Synthetic oligonucleotide
  Target: DMPK; (+) strand; PAM type: YTN; PAM sequence: TTC
tccccaccccttggtccagc

SEQ ID NO: 20138 - DNA, 20 bp, Artificial Sequence
  Description of Artificial Sequence: Synthetic oligonucleotide
  Target: DMPK; (+) strand; PAM type: YTN; PAM sequence: CTC
cccaccccttggtccagccc

SEQ ID NO: 20139 - DNA, 20 bp, Artificial Sequence
  Description of Artificial Sequence: Synthetic oligonucleotide
  Target: DMPK; (+) strand; PAM type: YTN; PAM sequence: CTT
ggtccagcccccctcccgcc

SEQ ID NO: 20140 - DNA, 20 bp, Artificial Sequence
  Description of Artificial Sequence: Synthetic oligonucleotide
  Target: DMPK; (+) strand; PAM type: YTN; PAM sequence: TTG
gtccagcccccctcccgcct

SEQ ID NO: 20141 - DNA, 20 bp, Artificial Sequence
  Description of Artificial Sequence: Synthetic oligonucleotide
  Target: DMPK; (+) strand; PAM type: YTN; PAM sequence: CTC
ccgcctcccagccttaaccc

SEQ ID NO: 20142 - DNA, 20 bp, Artificial Sequence
  Description of Artificial Sequence: Synthetic oligonucleotide
  Target: DMPK; (+) strand; PAM type: YTN; PAM sequence: CTC
ccagccttaacccctcacaa

SEQ ID NO: 20143 - DNA, 20 bp, Artificial Sequence
  Description of Artificial Sequence: Synthetic oligonucleotide
  Target: DMPK; (+) strand; PAM type: YTN; PAM sequence: CTT
aacccctcacaagccagccc

SEQ ID NO: 20144 - DNA, 20 bp, Artificial Sequence
  Description of Artificial Sequence: Synthetic oligonucleotide
  Target: DMPK; (+) strand; PAM type: YTN; PAM sequence: TTA
acccctcacaagccagcccc

SEQ ID NO: 20145 - DNA, 20 bp, Artificial Sequence
  Description of Artificial Sequence: Synthetic oligonucleotide
  Target: DMPK; (+) strand; PAM type: YTN; PAM sequence: CTC
acaagccagccccccaagct

SEQ ID NO: 20146 - DNA, 20 bp, Artificial Sequence
  Description of Artificial Sequence: Synthetic oligonucleotide
  Target: DMPK; (+) strand; PAM type: YTN; PAM sequence: CTC
cctccttccagggcccttca

SEQ ID NO: 20147 - DNA, 20 bp, Artificial Sequence
  Description of Artificial Sequence: Synthetic oligonucleotide
  Target: DMPK; (+) strand; PAM type: YTN; PAM sequence: CTC
cttccagggcccttcagaac

SEQ ID NO: 20148 - DNA, 20 bp, Artificial Sequence
  Description of Artificial Sequence: Synthetic oligonucleotide
  Target: DMPK; (+) strand; PAM type: YTN; PAM sequence: CTT
ccagggcccttcagaaccct

SEQ ID NO: 20149 - DNA, 20 bp, Artificial Sequence
  Description of Artificial Sequence: Synthetic oligonucleotide
  Target: DMPK; (+) strand; PAM type: YTN; PAM sequence: TTC
cagggcccttcagaaccctt

SEQ ID NO: 20150 - DNA, 20 bp, Artificial Sequence
  Description of Artificial Sequence: Synthetic oligonucleotide
  Target: DMPK; (+) strand; PAM type: YTN; PAM sequence: CTT
cagaacccttcagtgctaga

SEQ ID NO: 20151 - DNA, 20 bp, Artificial Sequence
  Description of Artificial Sequence: Synthetic oligonucleotide
  Target: DMPK; (+) strand; PAM type: YTN; PAM sequence: TTC
agaacccttcagtgctagag

SEQ ID NO: 20152 - DNA, 20 bp, Artificial Sequence
  Description of Artificial Sequence: Synthetic oligonucleotide
  Target: DMPK; (+) strand; PAM type: YTN; PAM sequence: CTT
cagtgctagagtagggggaa

SEQ ID NO: 20153 - DNA, 20 bp, Artificial Sequence
  Description of Artificial Sequence: Synthetic oligonucleotide
  Target: DMPK; (+) strand; PAM type: YTN; PAM sequence: TTC
agtgctagagtagggggaat

SEQ ID NO: 20154 - DNA, 20 bp, Artificial Sequence
  Description of Artificial Sequence: Synthetic oligonucleotide
  Target: DMPK; (+) strand; PAM type: YTN; PAM sequence: CTA
gagtagggggaatgcatgga

SEQ ID NO: 20155 - DNA, 20 bp, Artificial Sequence
  Description of Artificial Sequence: Synthetic oligonucleotide
  Target: DMPK; (+) strand; PAM type: YTN; PAM sequence: CTC
agctgtcacactgtcacccc

SEQ ID NO: 20156 - DNA, 20 bp, Artificial Sequence
  Description of Artificial Sequence: Synthetic oligonucleotide
  Target: DMPK; (+) strand; PAM type: YTN; PAM sequence: CTG
tcacactgtcaccccaataa

SEQ ID NO: 20157 - DNA, 20 bp, Artificial Sequence
  Description of Artificial Sequence: Synthetic oligonucleotide
  Target: DMPK; (+) strand; PAM type: YTN; PAM sequence: CTG
tcaccccaataaaaaggtag

SEQ ID NO: 20158 - DNA, 20 bp, Artificial Sequence
  Description of Artificial Sequence: Synthetic oligonucleotide
  Target: DMPK; (+) strand; PAM type: YTN; PAM sequence: TTT
caagaagaacctgcccattg

SEQ ID NO: 20159 - DNA, 20 bp, Artificial Sequence
  Description of Artificial Sequence: Synthetic oligonucleotide
  Target: DMPK; (+) strand; PAM type: YTN; PAM sequence: TTC
aagaagaacctgcccattgc

SEQ ID NO: 20160 - DNA, 20 bp, Artificial Sequence
  Description of Artificial Sequence: Synthetic oligonucleotide
  Target: DMPK; (+) strand; PAM type: YTN; PAM sequence: CTG
cccattgctgaaacagggcc

SEQ ID NO: 20161 - DNA, 20 bp, Artificial Sequence
  Description of Artificial Sequence: Synthetic oligonucleotide
  Target: DMPK; (+) strand; PAM type: YTN; PAM sequence: TTG
ctgaaacagggccaattgag

SEQ ID NO: 20162 - DNA, 20 bp, Artificial Sequence
  Description of Artificial Sequence: Synthetic oligonucleotide
  Target: DMPK; (+) strand; PAM type: YTN; PAM sequence: CTG
aaacagggccaattgaggct

SEQ ID NO: 20163 - DNA, 20 bp, Artificial Sequence
  Description of Artificial Sequence: Synthetic oligonucleotide
  Target: DMPK; (+) strand; PAM type: YTN; PAM sequence: TTG
aggctgagtgacccagtagc

SEQ ID NO: 20164 - DNA, 20 bp, Artificial Sequence
  Description of Artificial Sequence: Synthetic oligonucleotide
  Target: DMPK; (+) strand; PAM type: YTN; PAM sequence: CTG
agtgacccagtagcaaccac

SEQ ID NO: 20165 - DNA, 20 bp, Artificial Sequence
  Description of Artificial Sequence: Synthetic oligonucleotide
  Target: DMPK; (+) strand; PAM type: YTN; PAM sequence: CTT
gctcccgacaagctccagaa

SEQ ID NO: 20166 - DNA, 20 bp, Artificial Sequence
  Description of Artificial Sequence: Synthetic oligonucleotide
  Target: DMPK; (+) strand; PAM type: YTN; PAM sequence: TTG
ctcccgacaagctccagaac

SEQ ID NO: 20167 - DNA, 20 bp, Artificial Sequence
  Description of Artificial Sequence: Synthetic oligonucleotide
  Target: DMPK; (+) strand; PAM type: YTN; PAM sequence: CTC
ccgacaagctccagaactgg

SEQ ID NO: 20168 - DNA, 20 bp, Artificial Sequence
  Description of Artificial Sequence: Synthetic oligonucleotide
  Target: DMPK; (+) strand; PAM type: YTN; PAM sequence: CTC
cagaactgggggctaggggg

SEQ ID NO: 20169 - DNA, 20 bp, Artificial Sequence
  Description of Artificial Sequence: Synthetic oligonucleotide
  Target: DMPK; (+) strand; PAM type: YTN; PAM sequence: CTG
ggggctagggggtgagggct

SEQ ID NO: 20170 - DNA, 20 bp, Artificial Sequence
  Description of Artificial Sequence: Synthetic oligonucleotide
  Target: DMPK; (+) strand; PAM type: YTN; PAM sequence: CTA
gggggtgagggctgggggtt

SEQ ID NO: 20171 - DNA, 20 bp, Artificial Sequence
  Description of Artificial Sequence: Synthetic oligonucleotide
  Target: DMPK; (+) strand; PAM type: YTN; PAM sequence: CTG
ggggttggggctgggtggga

SEQ ID NO: 20172 - DNA, 20 bp, Artificial Sequence
  Description of Artificial Sequence: Synthetic oligonucleotide
  Target: DMPK; (+) strand; PAM type: YTN; PAM sequence: TTG
gggctgggtgggagaaaggg

SEQ ID NO: 20173 - DNA, 20 bp, Artificial Sequence
  Description of Artificial Sequence: Synthetic oligonucleotide
  Target: DMPK; (+) strand; PAM type: YTN; PAM sequence: CTG
ggtgggagaaaggggttgag

SEQ ID NO: 20174 - DNA, 20 bp, Artificial Sequence
  Description of Artificial Sequence: Synthetic oligonucleotide
  Target: DMPK; (+) strand; PAM type: YTN; PAM sequence: TTG
aggcctgggaaggggacggg

SEQ ID NO: 20175 - DNA, 20 bp, Artificial Sequence
  Description of Artificial Sequence: Synthetic oligonucleotide
  Target: DMPK; (+) strand; PAM type: YTN; PAM sequence: CTG
ggaaggggacgggaggccag

SEQ ID NO: 20176 - DNA, 20 bp, Artificial Sequence
  Description of Artificial Sequence: Synthetic oligonucleotide
  Target: DMPK; (+) strand; PAM type: YTN; PAM sequence: CTT
cttgggtgactcagagatgg

SEQ ID NO: 20177 - DNA, 20 bp, Artificial Sequence
  Description of Artificial Sequence: Synthetic oligonucleotide
  Target: DMPK; (+) strand; PAM type: YTN; PAM sequence: TTC
ttgggtgactcagagatgga

SEQ ID NO: 20178 - DNA, 20 bp, Artificial Sequence
  Description of Artificial Sequence: Synthetic oligonucleotide
  Target: DMPK; (+) strand; PAM type: YTN; PAM sequence: CTT
gggtgactcagagatggatt

SEQ ID NO: 20179 - DNA, 20 bp, Artificial Sequence
  Description of Artificial Sequence: Synthetic oligonucleotide
  Target: DMPK; (+) strand; PAM type: YTN; PAM sequence: TTG
ggtgactcagagatggattc

SEQ ID NO: 20180 - DNA, 20 bp, Artificial Sequence
  Description of Artificial Sequence: Synthetic oligonucleotide
  Target: DMPK; (+) strand; PAM type: YTN; PAM sequence: CTC
agagatggattccgactcgg

SEQ ID NO: 20181 - DNA, 20 bp, Artificial Sequence
  Description of Artificial Sequence: Synthetic oligonucleotide
  Target: DMPK; (+) strand; PAM type: YTN; PAM sequence: TTC
cgactcggacagttaaattt

SEQ ID NO: 20182 - DNA, 20 bp, Artificial Sequence
  Description of Artificial Sequence: Synthetic oligonucleotide
  Target: DMPK; (+) strand; PAM type: YTN; PAM sequence: CTC
ggacagttaaatttagccct

SEQ ID NO: 20183 - DNA, 20 bp, Artificial Sequence
  Description of Artificial Sequence: Synthetic oligonucleotide
  Target: DMPK; (+) strand; PAM type: YTN; PAM sequence: TTA
aatttagccctcaggctctc

SEQ ID NO: 20184 - DNA, 20 bp, Artificial Sequence
  Description of Artificial Sequence: Synthetic oligonucleotide
  Target: DMPK; (+) strand; PAM type: YTN; PAM sequence: TTT
agccctcaggctctctgctt

SEQ ID NO: 20185 - DNA, 20 bp, Artificial Sequence
  Description of Artificial Sequence: Synthetic oligonucleotide
  Target: DMPK; (+) strand; PAM type: YTN; PAM sequence: TTA
gccctcaggctctctgcttt

SEQ ID NO: 20186 - DNA, 20 bp, Artificial Sequence
  Description of Artificial Sequence: Synthetic oligonucleotide
  Target: DMPK; (+) strand; PAM type: YTN; PAM sequence: CTC
aggctctctgctttatacca

SEQ ID NO: 20187 - DNA, 20 bp, Artificial Sequence
  Description of Artificial Sequence: Synthetic oligonucleotide
  Target: DMPK; (+) strand; PAM type: YTN; PAM sequence: CTC
tctgctttataccagctttt

SEQ ID NO: 20188 - DNA, 20 bp, Artificial Sequence
  Description of Artificial Sequence: Synthetic oligonucleotide
  Target: DMPK; (+) strand; PAM type: YTN; PAM sequence: CTC
tgctttataccagctttttt

SEQ ID NO: 20189 - DNA, 20 bp, Artificial Sequence
  Description of Artificial Sequence: Synthetic oligonucleotide
  Target: DMPK; (+) strand; PAM type: YTN; PAM sequence: CTG
ctttataccagctttttttt

SEQ ID NO: 20190 - DNA, 20 bp, Artificial Sequence
  Description of Artificial Sequence: Synthetic oligonucleotide
  Target: DMPK; (+) strand; PAM type: YTN; PAM sequence: CTT
tataccagcttttttttttt

SEQ ID NO: 20191 - DNA, 20 bp, Artificial Sequence
  Description of Artificial Sequence: Synthetic oligonucleotide
  Target: DMPK; (+) strand; PAM type: YTN; PAM sequence: TTT
ataccagctttttttttttt

SEQ ID NO: 20192 - DNA, 20 bp, Artificial Sequence
  Description of Artificial Sequence: Synthetic oligonucleotide
  Target: DMPK; (+) strand; PAM type: YTN; PAM sequence: TTA
taccagcttttttttttttt

SEQ ID NO: 20193 - DNA, 20 bp, Artificial Sequence
  Description of Artificial Sequence: Synthetic oligonucleotide
  Target: DMPK; (+) strand; PAM type: YTN; PAM sequence: CTT
tttttttttttttttttttt

SEQ ID NO: 20194 - DNA, 20 bp, Artificial Sequence
  Description of Artificial Sequence: Synthetic oligonucleotide
  Target: DMPK; (+) strand; PAM type: YTN; PAM sequence: TTT
tttttttttttttttttttt

SEQ ID NO: 20195 - DNA, 20 bp, Artificial Sequence
  Description of Artificial Sequence: Synthetic oligonucleotide
  Target: DMPK; (+) strand; PAM type: YTN; PAM sequence: TTT
tttttttttttttttttttt

SEQ ID NO: 20196 - DNA, 20 bp, Artificial Sequence
  Description of Artificial Sequence: Synthetic oligonucleotide
  Target: DMPK; (+) strand; PAM type: YTN; PAM sequence: TTT
tttttttttttttttttttt

SEQ ID NO: 20197 - DNA, 20 bp, Artificial Sequence
  Description of Artificial Sequence: Synthetic oligonucleotide
  Target: DMPK; (+) strand; PAM type: YTN; PAM sequence: TTT
tttttttttttttttttttc

SEQ ID NO: 20198 - DNA, 20 bp, Artificial Sequence
  Description of Artificial Sequence: Synthetic oligonucleotide
  Target: DMPK; (+) strand; PAM type: YTN; PAM sequence: TTT
ttttttttttttttttttcc

SEQ ID NO: 20199 - DNA, 20 bp, Artificial Sequence
  Description of Artificial Sequence: Synthetic oligonucleotide
  Target: DMPK; (+) strand; PAM type: YTN; PAM sequence: TTT
tttttttttttttttttccc

SEQ ID NO: 20200 - DNA, 20 bp, Artificial Sequence
  Description of Artificial Sequence: Synthetic oligonucleotide
  Target: DMPK; (+) strand; PAM type: YTN; PAM sequence: TTT
ttttttttttttttttccca

SEQ ID NO: 20201 - DNA, 20 bp, Artificial Sequence
  Description of Artificial Sequence: Synthetic oligonucleotide
  Target: DMPK; (+) strand; PAM type: YTN; PAM sequence: TTT
tttttttttttttttcccag

SEQ ID NO: 20202 - DNA, 20 bp, Artificial Sequence
  Description of Artificial Sequence: Synthetic oligonucleotide
  Target: DMPK; (+) strand; PAM type: YTN; PAM sequence: TTT
ttttttttttttttcccagg

SEQ ID NO: 20203 - DNA, 20 bp, Artificial Sequence
  Description of Artificial Sequence: Synthetic oligonucleotide
  Target: DMPK; (+) strand; PAM type: YTN; PAM sequence: TTT
tttttttttttttcccagga

SEQ ID NO: 20204 - DNA, 20 bp, Artificial Sequence
  Description of Artificial Sequence: Synthetic oligonucleotide
  Target: DMPK; (+) strand; PAM type: YTN; PAM sequence: TTT
ttttttttttttcccaggag

SEQ ID NO: 20205 - DNA, 20 bp, Artificial Sequence
  Description of Artificial Sequence: Synthetic oligonucleotide
  Target: DMPK; (+) strand; PAM type: YTN; PAM sequence: TTT
tttttttttttcccaggagg

SEQ ID NO: 20206 - DNA, 20 bp, Artificial Sequence
  Description of Artificial Sequence: Synthetic oligonucleotide
  Target: DMPK; (+) strand; PAM type: YTN; PAM sequence: TTT
ttttttttttcccaggaggt

SEQ ID NO: 20207 - DNA, 20 bp, Artificial Sequence
  Description of Artificial Sequence: Synthetic oligonucleotide
  Target: DMPK; (+) strand; PAM type: YTN; PAM sequence: TTT
tttttttttcccaggaggtg

SEQ ID NO: 20208 - DNA, 20 bp, Artificial Sequence
  Description of Artificial Sequence: Synthetic oligonucleotide
  Target: DMPK; (+) strand; PAM type: YTN; PAM sequence: TTT
ttttttttcccaggaggtgg

SEQ ID NO: 20209 - DNA, 20 bp, Artificial Sequence
  Description of Artificial Sequence: Synthetic oligonucleotide
  Target: DMPK; (+) strand; PAM type: YTN; PAM sequence: TTT
tttttttcccaggaggtggg

SEQ ID NO: 20210 - DNA, 20 bp, Artificial Sequence
  Description of Artificial Sequence: Synthetic oligonucleotide
  Target: DMPK; (+) strand; PAM type: YTN; PAM sequence: TTT
ttttttcccaggaggtgggg

SEQ ID NO: 20211 - DNA, 20 bp, Artificial Sequence
  Description of Artificial Sequence: Synthetic oligonucleotide
  Target: DMPK; (+) strand; PAM type: YTN; PAM sequence: TTT
tttttcccaggaggtgggga

SEQ ID NO: 20212 - DNA, 20 bp, Artificial Sequence
  Description of Artificial Sequence: Synthetic oligonucleotide
  Target: DMPK; (+) strand; PAM type: YTN; PAM sequence: TTT
ttttcccaggaggtggggaa

SEQ ID NO: 20213 - DNA, 20 bp, Artificial Sequence
  Description of Artificial Sequence: Synthetic oligonucleotide
  Target: DMPK; (+) strand; PAM type: YTN; PAM sequence: TTT
tttcccaggaggtggggaag

SEQ ID NO: 20214 - DNA, 20 bp, Artificial Sequence
  Description of Artificial Sequence: Synthetic oligonucleotide
  Target: DMPK; (+) strand; PAM type: YTN; PAM sequence: TTT
ttcccaggaggtggggaagg

SEQ ID NO: 20215 - DNA, 20 bp, Artificial Sequence
  Description of Artificial Sequence: Synthetic oligonucleotide
  Target: DMPK; (+) strand; PAM type: YTN; PAM sequence: TTT
tcccaggaggtggggaaggg

SEQ ID NO: 20216 - DNA, 20 bp, Artificial Sequence
  Description of Artificial Sequence: Synthetic oligonucleotide
  Target: DMPK; (+) strand; PAM type: YTN; PAM sequence: TTT
cccaggaggtggggaagggg

SEQ ID NO: 20217 - DNA, 20 bp, Artificial Sequence
  Description of Artificial Sequence: Synthetic oligonucleotide
  Target: DMPK; (+) strand; PAM type: YTN; PAM sequence: TTC
ccaggaggtggggaaggggt

SEQ ID NO: 20218 - DNA, 20 bp, Artificial Sequence
  Description of Artificial Sequence: Synthetic oligonucleotide
  Target: DMPK; (+) strand; PAM type: YTN; PAM sequence: CTC
agagcctgaacaggggtgac

SEQ ID NO: 20219 - DNA, 20 bp, Artificial Sequence
  Description of Artificial Sequence: Synthetic oligonucleotide
  Target: DMPK; (+) strand; PAM type: YTN; PAM sequence: CTG
aacaggggtgacctgctgcc

SEQ ID NO: 20220 - DNA, 20 bp, Artificial Sequence
  Description of Artificial Sequence: Synthetic oligonucleotide
  Target: DMPK; (+) strand; PAM type: YTN; PAM sequence: CTG
ctgcccaaaggctgggggag

SEQ ID NO: 20221 - DNA, 20 bp, Artificial Sequence
  Description of Artificial Sequence: Synthetic oligonucleotide
  Target: DMPK; (+) strand; PAM type: YTN; PAM sequence: CTG
cccaaaggctgggggaggaa

SEQ ID NO: 20222 - DNA, 20 bp, Artificial Sequence
  Description of Artificial Sequence: Synthetic oligonucleotide
  Target: DMPK; (+) strand; PAM type: YTN; PAM sequence: CTG
ggggaggaaagtggtggagc

SEQ ID NO: 20223 - DNA, 20 bp, Artificial Sequence
  Description of Artificial Sequence: Synthetic oligonucleotide
  Target: DMPK; (+) strand; PAM type: YTN; PAM sequence: CTC
cctgggcaaacgagacccca

SEQ ID NO: 20224 - DNA, 20 bp, Artificial Sequence
  Description of Artificial Sequence: Synthetic oligonucleotide
  Target: DMPK; (+) strand; PAM type: YTN; PAM sequence: CTG
ggcaaacgagaccccaaaat

SEQ ID NO: 20225 - DNA, 20 bp, Artificial Sequence
  Description of Artificial Sequence: Synthetic oligonucleotide
  Target: DMPK; (+) strand; PAM type: YTN; PAM sequence: CTC
cttggcccctggccggggag

SEQ ID NO: 20226 - DNA, 20 bp, Artificial Sequence
  Description of Artificial Sequence: Synthetic oligonucleotide
  Target: DMPK; (+) strand; PAM type: YTN; PAM sequence: CTT
ggcccctggccggggagcca

SEQ ID NO: 20227 - DNA, 20 bp, Artificial Sequence
  Description of Artificial Sequence: Synthetic oligonucleotide
  Target: DMPK; (+) strand; PAM type: YTN; PAM sequence: TTG
gcccctggccggggagccac

SEQ ID NO: 20228 - DNA, 20 bp, Artificial Sequence
  Description of Artificial Sequence: Synthetic oligonucleotide
  Target: DMPK; (+) strand; PAM type: YTN; PAM sequence: CTG
gccggggagccacattcctg

SEQ ID NO: 20229 - DNA, 20 bp, Artificial Sequence
  Description of Artificial Sequence: Synthetic oligonucleotide
  Target: DMPK; (+) strand; PAM type: YTN; PAM sequence: TTC
ctgcccaggctgggattaga

SEQ ID NO: 20230 - DNA, 20 bp, Artificial Sequence
  Description of Artificial Sequence: Synthetic oligonucleotide
  Target: DMPK; (+) strand; PAM type: YTN; PAM sequence: CTG
cccaggctgggattagaaac

SEQ ID NO: 20231 - DNA, 20 bp, Artificial Sequence
  Description of Artificial Sequence: Synthetic oligonucleotide
  Target: DMPK; (+) strand; PAM type: YTN; PAM sequence: CTG
ggattagaaacagaaacatt

SEQ ID NO: 20232 - DNA, 20 bp, Artificial Sequence
  Description of Artificial Sequence: Synthetic oligonucleotide
  Target: DMPK; (+) strand; PAM type: YTN; PAM sequence: TTA
gaaacagaaacatttcgggg

SEQ ID NO: 20233 - DNA, 20 bp, Artificial Sequence
  Description of Artificial Sequence: Synthetic oligonucleotide
  Target: DMPK; (+) strand; PAM type: YTN; PAM sequence: TTT
cggggggtggagggtggcgc

SEQ ID NO: 20234 - DNA, 20 bp, Artificial Sequence
  Description of Artificial Sequence: Synthetic oligonucleotide
  Target: DMPK; (+) strand; PAM type: YTN; PAM sequence: TTC
ggggggtggagggtggcgcg

SEQ ID NO: 20235 - DNA, 20 bp, Artificial Sequence
  Description of Artificial Sequence: Synthetic oligonucleotide
  Target: DMPK; (+) strand; PAM type: YTN; PAM sequence: CTC
cctgcggctccgagagccaa

SEQ ID NO: 20236 - DNA, 20 bp, Artificial Sequence
  Description of Artificial Sequence: Synthetic oligonucleotide
  Target: DMPK; (+) strand; PAM type: YTN; PAM sequence: CTG
cggctccgagagccaagagg

SEQ ID NO: 20237 - DNA, 20 bp, Artificial Sequence
  Description of Artificial Sequence: Synthetic oligonucleotide
  Target: DMPK; (+) strand; PAM type: YTN; PAM sequence: CTC
cgagagccaagaggaatctg

SEQ ID NO: 20238 - DNA, 20 bp, Artificial Sequence
  Description of Artificial Sequence: Synthetic oligonucleotide
  Target: DMPK; (+) strand; PAM type: YTN; PAM sequence: CTG
agctcttctttccagggtgg

SEQ ID NO: 20239 - DNA, 20 bp, Artificial Sequence
  Description of Artificial Sequence: Synthetic oligonucleotide
  Target: DMPK; (+) strand; PAM type: YTN; PAM sequence: CTC
ttctttccagggtggacggt

SEQ ID NO: 20240 - DNA, 20 bp, Artificial Sequence
  Description of Artificial Sequence: Synthetic oligonucleotide
  Target: DMPK; (+) strand; PAM type: YTN; PAM sequence: CTT
ctttccagggtggacggttc

SEQ ID NO: 20241 - DNA, 20 bp, Artificial Sequence
  Description of Artificial Sequence: Synthetic oligonucleotide
  Target: DMPK; (+) strand; PAM type: YTN; PAM sequence: TTC
tttccagggtggacggttct

SEQ ID NO: 20242 - DNA, 20 bp, Artificial Sequence
  Description of Artificial Sequence: Synthetic oligonucleotide
  Target: DMPK; (+) strand; PAM type: YTN; PAM sequence: CTT
tccagggtggacggttctcc

SEQ ID NO: 20243 - DNA, 20 bp, Artificial Sequence
  Description of Artificial Sequence: Synthetic oligonucleotide
  Target: DMPK; (+) strand; PAM type: YTN; PAM sequence: TTT
ccagggtggacggttctcca

SEQ ID NO: 20244 - DNA, 20 bp, Artificial Sequence
  Description of Artificial Sequence: Synthetic oligonucleotide
  Target: DMPK; (+) strand; PAM type: YTN; PAM sequence: TTC
cagggtggacggttctccag

SEQ ID NO: 20245 - DNA, 20 bp, Artificial Sequence
  Description of Artificial Sequence: Synthetic oligonucleotide
  Target: DMPK; (+) strand; PAM type: YTN; PAM sequence: TTC
tccagagtggaagtcggggc

SEQ ID NO: 20246 - DNA, 20 bp, Artificial Sequence
  Description of Artificial Sequence: Synthetic oligonucleotide
  Target: DMPK; (+) strand; PAM type: YTN; PAM sequence: CTC
cagagtggaagtcggggcct

SEQ ID NO: 20247 - DNA, 20 bp, Artificial Sequence
  Description of Artificial Sequence: Synthetic oligonucleotide
  Target: DMPK; (+) strand; PAM type: YTN; PAM sequence: CTC
caaccggcctggggtgcctg

SEQ ID NO: 20248 - DNA, 20 bp, Artificial Sequence
  Description of Artificial Sequence: Synthetic oligonucleotide
  Target: DMPK; (+) strand; PAM type: YTN; PAM sequence: CTG
gggtgcctgggccttgagag

SEQ ID NO: 20249 - DNA, 20 bp, Artificial Sequence
  Description of Artificial Sequence: Synthetic oligonucleotide
  Target: DMPK; (+) strand; PAM type: YTN; PAM sequence: CTG
ggccttgagagggccaggcc

SEQ ID NO: 20250 - DNA, 20 bp, Artificial Sequence
  Description of Artificial Sequence: Synthetic oligonucleotide
  Target: DMPK; (+) strand; PAM type: YTN; PAM sequence: CTT
gagagggccaggcctgagaa

SEQ ID NO: 20251 - DNA, 20 bp, Artificial Sequence
  Description of Artificial Sequence: Synthetic oligonucleotide
  Target: DMPK; (+) strand; PAM type: YTN; PAM sequence: TTG
agagggccaggcctgagaaa

SEQ ID NO: 20252 - DNA, 20 bp, Artificial Sequence
  Description of Artificial Sequence: Synthetic oligonucleotide
  Target: DMPK; (+) strand; PAM type: YTN; PAM sequence: CTG
agaaactaggaggcaaggac

SEQ ID NO: 20253 - DNA, 20 bp, Artificial Sequence
  Description of Artificial Sequence: Synthetic oligonucleotide
  Target: DMPK; (+) strand; PAM type: YTN; PAM sequence: CTA
ggaggcaaggaccgaggagt

SEQ ID NO: 20254 - DNA, 20 bp, Artificial Sequence
  Description of Artificial Sequence: Synthetic oligonucleotide
  Target: DMPK; (+) strand; PAM type: YTN; PAM sequence: CTG
ggcagggcctgggaaacgtg

SEQ ID NO: 20255 - DNA, 20 bp, Artificial Sequence
  Description of Artificial Sequence: Synthetic oligonucleotide
  Target: DMPK; (+) strand; PAM type: YTN; PAM sequence: CTG
ggaaacgtggtcctgggcag

SEQ ID NO: 20256 - DNA, 20 bp, Artificial Sequence
  Description of Artificial Sequence: Synthetic oligonucleotide
  Target: DMPK; (+) strand; PAM type: YTN; PAM sequence: CTG
ggcagttctgataatttaaa

SEQ ID NO: 20257 - DNA, 20 bp, Artificial Sequence
  Description of Artificial Sequence: Synthetic oligonucleotide
  Target: DMPK; (+) strand; PAM type: YTN; PAM sequence: TTC
tgataatttaaaaaacaccg

SEQ ID NO: 20258 - DNA, 20 bp, Artificial Sequence
  Description of Artificial Sequence: Synthetic oligonucleotide
  Target: DMPK; (+) strand; PAM type: YTN; PAM sequence: CTG
ataatttaaaaaacaccgag

SEQ ID NO: 20259 - DNA, 20 bp, Artificial Sequence
  Description of Artificial Sequence: Synthetic oligonucleotide
  Target: DMPK; (+) strand; PAM type: YTN; PAM sequence: TTT
aaaaaacaccgaggactttg

SEQ ID NO: 20260 - DNA, 20 bp, Artificial Sequence
  Description of Artificial Sequence: Synthetic oligonucleotide
  Target: DMPK; (+) strand; PAM type: YTN; PAM sequence: TTA
aaaaacaccgaggactttga

SEQ ID NO: 20261 - DNA, 20 bp, Artificial Sequence
  Description of Artificial Sequence: Synthetic oligonucleotide
  Target: DMPK; (+) strand; PAM type: YTN; PAM sequence: CTT
tgatgaggggccctggctgc

SEQ ID NO: 20262 - DNA, 20 bp, Artificial Sequence
  Description of Artificial Sequence: Synthetic oligonucleotide
  Target: DMPK; (+) strand; PAM type: YTN; PAM sequence: TTT
gatgaggggccctggctgcg

SEQ ID NO: 20263 - DNA, 20 bp, Artificial Sequence
  Description of Artificial Sequence: Synthetic oligonucleotide
  Target: DMPK; (+) strand; PAM type: YTN; PAM sequence: TTG
atgaggggccctggctgcgg

SEQ ID NO: 20264 - DNA, 20 bp, Artificial Sequence
  Description of Artificial Sequence: Synthetic oligonucleotide
  Target: DMPK; (+) strand; PAM type: YTN; PAM sequence: CTG
gctgcgggcaggatgctctt

SEQ ID NO: 20265 - DNA, 20 bp, Artificial Sequence
  Description of Artificial Sequence: Synthetic oligonucleotide
  Target: DMPK; (+) strand; PAM type: YTN; PAM sequence: CTG
cgggcaggatgctcttctcc

SEQ ID NO: 20266 - DNA, 20 bp, Artificial Sequence
  Description of Artificial Sequence: Synthetic oligonucleotide
  Target: DMPK; (+) strand; PAM type: YTN; PAM sequence: CTC
ttctccccaagagggtcctg

SEQ ID NO: 20267 - DNA, 20 bp, Artificial Sequence
  Description of Artificial Sequence: Synthetic oligonucleotide
  Target: DMPK; (+) strand; PAM type: YTN; PAM sequence: CTT
ctccccaagagggtcctgct

SEQ ID NO: 20268 - DNA, 20 bp, Artificial Sequence
  Description of Artificial Sequence: Synthetic oligonucleotide
  Target: DMPK; (+) strand; PAM type: YTN; PAM sequence: TTC
tccccaagagggtcctgctc

SEQ ID NO: 20269 - DNA, 20 bp, Artificial Sequence
  Description of Artificial Sequence: Synthetic oligonucleotide
  Target: DMPK; (+) strand; PAM type: YTN; PAM sequence: CTC
cccaagagggtcctgctcca

SEQ ID NO: 20270 - DNA, 20 bp, Artificial Sequence
  Description of Artificial Sequence: Synthetic oligonucleotide
  Target: DMPK; (+) strand; PAM type: YTN; PAM sequence: CTG
ctccagccgctggtgtgggt

SEQ ID NO: 20271 - DNA, 20 bp, Artificial Sequence
  Description of Artificial Sequence: Synthetic oligonucleotide
  Target: DMPK; (+) strand; PAM type: YTN; PAM sequence: CTC
cagccgctggtgtgggtcac

SEQ ID NO: 20272 - DNA, 20 bp, Artificial Sequence
  Description of Artificial Sequence: Synthetic oligonucleotide
  Target: DMPK; (+) strand; PAM type: YTN; PAM sequence: CTG
gtgtgggtcaccagttgtgt

SEQ ID NO: 20273 - DNA, 20 bp, Artificial Sequence
  Description of Artificial Sequence: Synthetic oligonucleotide
  Target: DMPK; (+) strand; PAM type: YTN; PAM sequence: TTG
tgtgactcgcaggtccgttc

SEQ ID NO: 20274 - DNA, 20 bp, Artificial Sequence
  Description of Artificial Sequence: Synthetic oligonucleotide
  Target: DMPK; (+) strand; PAM type: YTN; PAM sequence: CTC
gcaggtccgttccctccctg

SEQ ID NO: 20275 - DNA, 20 bp, Artificial Sequence
  Description of Artificial Sequence: Synthetic oligonucleotide
  Target: DMPK; (+) strand; PAM type: YTN; PAM sequence: TTC
cctccctgggctccggcttt

SEQ ID NO: 20276 - DNA, 20 bp, Artificial Sequence
  Description of Artificial Sequence: Synthetic oligonucleotide
  Target: DMPK; (+) strand; PAM type: YTN; PAM sequence: CTC
cctgggctccggcttttcct

SEQ ID NO: 20277 - DNA, 20 bp, Artificial Sequence
  Description of Artificial Sequence: Synthetic oligonucleotide
  Target: DMPK; (+) strand; PAM type: YTN; PAM sequence: CTG
ggctccggcttttcctgcta

SEQ ID NO: 20278 - DNA, 20 bp, Artificial Sequence
  Description of Artificial Sequence: Synthetic oligonucleotide
  Target: DMPK; (+) strand; PAM type: YTN; PAM sequence: CTC
cggcttttcctgctatgaaa

SEQ ID NO: 20279 - DNA, 20 bp, Artificial Sequence
  Description of Artificial Sequence: Synthetic oligonucleotide
  Target: DMPK; (+) strand; PAM type: YTN; PAM sequence: CTT
ttcctgctatgaaaaggggt

SEQ ID NO: 20280 - DNA, 20 bp, Artificial Sequence
  Description of Artificial Sequence: Synthetic oligonucleotide
  Target: DMPK; (+) strand; PAM type: YTN; PAM sequence: TTT
tcctgctatgaaaaggggtg

SEQ ID NO: 20281 - DNA, 20 bp, Artificial Sequence
  Description of Artificial Sequence: Synthetic oligonucleotide
  Target: DMPK; (+) strand; PAM type: YTN; PAM sequence: TTT
cctgctatgaaaaggggtgg

SEQ ID NO: 20282 - DNA, 20 bp, Artificial Sequence
  Description of Artificial Sequence: Synthetic oligonucleotide
  Target: DMPK; (+) strand; PAM type: YTN; PAM sequence: TTC
ctgctatgaaaaggggtggg

SEQ ID NO: 20283 - DNA, 20 bp, Artificial Sequence
  Description of Artificial Sequence: Synthetic oligonucleotide
  Target: DMPK; (+) strand; PAM type: YTN; PAM sequence: CTG
ctatgaaaaggggtgggagg

SEQ ID NO: 20284 - DNA, 20 bp, Artificial Sequence
  Description of Artificial Sequence: Synthetic oligonucleotide
  Target: DMPK; (+) strand; PAM type: YTN; PAM sequence: CTA
tgaaaaggggtgggaggcgc

SEQ ID NO: 20285 - DNA, 20 bp, Artificial Sequence
  Description of Artificial Sequence: Synthetic oligonucleotide
  Target: DMPK; (+) strand; PAM type: YTN; PAM sequence: CTG
ggctgggagcaggcctgcac

SEQ ID NO: 20286 - DNA, 20 bp, Artificial Sequence
  Description of Artificial Sequence: Synthetic oligonucleotide
  Target: DMPK; (+) strand; PAM type: YTN; PAM sequence: CTG
ggagcaggcctgcactcctc

SEQ ID NO: 20287 - DNA, 20 bp, Artificial Sequence
  Description of Artificial Sequence: Synthetic oligonucleotide
  Target: DMPK; (+) strand; PAM type: YTN; PAM sequence: CTG
cactcctcctctggggaaag

SEQ ID NO: 20288 - DNA, 20 bp, Artificial Sequence
  Description of Artificial Sequence: Synthetic oligonucleotide
  Target: DMPK; (+) strand; PAM type: YTN; PAM sequence: CTC
ctcctctggggaaagcggac

SEQ ID NO: 20289 - DNA, 20 bp, Artificial Sequence
  Description of Artificial Sequence: Synthetic oligonucleotide
  Target: DMPK; (+) strand; PAM type: YTN; PAM sequence: CTC
ctctggggaaagcggactgc

SEQ ID NO: 20290 - DNA, 20 bp, Artificial Sequence
  Description of Artificial Sequence: Synthetic oligonucleotide
  Target: DMPK; (+) strand; PAM type: YTN; PAM sequence: CTC
tggggaaagcggactgccta

SEQ ID NO: 20291 - DNA, 20 bp, Artificial Sequence
  Description of Artificial Sequence: Synthetic oligonucleotide
  Target: DMPK; (+) strand; PAM type: YTN; PAM sequence: CTG
gggaaagcggactgcctaga

SEQ ID NO: 20292 - DNA, 20 bp, Artificial Sequence
  Description of Artificial Sequence: Synthetic oligonucleotide
  Target: DMPK; (+) strand; PAM type: YTN; PAM sequence: CTG
cctagaaccacagagtacac

SEQ ID NO: 20293 - DNA, 20 bp, Artificial Sequence
  Description of Artificial Sequence: Synthetic oligonucleotide
  Target: DMPK; (+) strand; PAM type: YTN; PAM sequence: CTA
gaaccacagagtacacacac

SEQ ID NO: 20294 - DNA, 20 bp, Artificial Sequence
  Description of Artificial Sequence: Synthetic oligonucleotide
  Target: DMPK; (+) strand; PAM type: YTN; PAM sequence: CTC
tacatcatctcctccgaagg

SEQ ID NO: 20295 - DNA, 20 bp, Artificial Sequence
  Description of Artificial Sequence: Synthetic oligonucleotide
  Target: DMPK; (+) strand; PAM type: YTN; PAM sequence: CTA
catcatctcctccgaagggg

SEQ ID NO: 20296 - DNA, 20 bp, Artificial Sequence
  Description of Artificial Sequence: Synthetic oligonucleotide
  Target: DMPK; (+) strand; PAM type: YTN; PAM sequence: CTC
ctccgaaggggacagacccg

SEQ ID NO: 20297 - DNA, 20 bp, Artificial Sequence
  Description of Artificial Sequence: Synthetic oligonucleotide
  Target: DMPK; (+) strand; PAM type: YTN; PAM sequence: CTC
cgaaggggacagacccgctg

SEQ ID NO: 20298 - DNA, 20 bp, Artificial Sequence
  Description of Artificial Sequence: Synthetic oligonucleotide
  Target: DMPK; (+) strand; PAM type: YTN; PAM sequence: CTG
agaaaacagggaactttagt

SEQ ID NO: 20299 - DNA, 20 bp, Artificial Sequence
  Description of Artificial Sequence: Synthetic oligonucleotide
  Target: DMPK; (+) strand; PAM type: YTN; PAM sequence: CTT
tagtataaataagaggtcct

SEQ ID NO: 20300 - DNA, 20 bp, Artificial Sequence
  Description of Artificial Sequence: Synthetic oligonucleotide
  Target: DMPK; (+) strand; PAM type: YTN; PAM sequence: TTT
agtataaataagaggtcctg

SEQ ID NO: 20301 - DNA, 20 bp, Artificial Sequence
  Description of Artificial Sequence: Synthetic oligonucleotide
  Target: DMPK; (+) strand; PAM type: YTN; PAM sequence: TTA
gtataaataagaggtcctgc

SEQ ID NO: 20302 - DNA, 20 bp, Artificial Sequence
  Description of Artificial Sequence: Synthetic oligonucleotide
  Target: DMPK; (+) strand; PAM type: YTN; PAM sequence: CTG
cgggacagggaggaacctga

SEQ ID NO: 20303 - DNA, 20 bp, Artificial Sequence
  Description of Artificial Sequence: Synthetic oligonucleotide
  Target: DMPK; (+) strand; PAM type: YTN; PAM sequence: CTG
aggggcttccataatttaac

SEQ ID NO: 20304 - DNA, 20 bp, Artificial Sequence
  Description of Artificial Sequence: Synthetic oligonucleotide
  Target: DMPK; (+) strand; PAM type: YTN; PAM sequence: CTT
ccataatttaacactcttca

SEQ ID NO: 20305 - DNA, 20 bp, Artificial Sequence
  Description of Artificial Sequence: Synthetic oligonucleotide
  Target: DMPK; (+) strand; PAM type: YTN; PAM sequence: TTC
cataatttaacactcttcaa

SEQ ID NO: 20306 - DNA, 20 bp, Artificial Sequence
  Description of Artificial Sequence: Synthetic oligonucleotide
  Target: DMPK; (+) strand; PAM type: YTN; PAM sequence: TTT
aacactcttcaaaagcacag

SEQ ID NO: 20307 - DNA, 20 bp, Artificial Sequence
  Description of Artificial Sequence: Synthetic oligonucleotide
  Target: DMPK; (+) strand; PAM type: YTN; PAM sequence: TTA
acactcttcaaaagcacaga

SEQ ID NO: 20308 - DNA, 20 bp, Artificial Sequence
  Description of Artificial Sequence: Synthetic oligonucleotide
  Target: DMPK; (+) strand; PAM type: YTN; PAM sequence: CTC
ttcaaaagcacagacaatag

SEQ ID NO: 20309 - DNA, 20 bp, Artificial Sequence
  Description of Artificial Sequence: Synthetic oligonucleotide
  Target: DMPK; (+) strand; PAM type: YTN; PAM sequence: CTT
caaaagcacagacaatagca

SEQ ID NO: 20310 - DNA, 20 bp, Artificial Sequence
  Description of Artificial Sequence: Synthetic oligonucleotide
  Target: DMPK; (+) strand; PAM type: YTN; PAM sequence: TTC
aaaagcacagacaatagcaa

SEQ ID NO: 20311 - DNA, 20 bp, Artificial Sequence
  Description of Artificial Sequence: Synthetic oligonucleotide
  Target: DMPK; (+) strand; PAM type: YTN; PAM sequence: CTG
gggtgggggccgggcgaggg

SEQ ID NO: 20312 - DNA, 20 bp, Artificial Sequence
  Description of Artificial Sequence: Synthetic oligonucleotide
  Target: DMPK; (+) strand; PAM type: YTN; PAM sequence: CTG
gaccacccccggccctgccc

SEQ ID NO: 20313 - DNA, 20 bp, Artificial Sequence
  Description of Artificial Sequence: Synthetic oligonucleotide
  Target: DMPK; (+) strand; PAM type: YTN; PAM sequence: CTG
cccactcaactgaggggcac

SEQ ID NO: 20314 - DNA, 20 bp, Artificial Sequence
  Description of Artificial Sequence: Synthetic oligonucleotide
  Target: DMPK; (+) strand; PAM type: YTN; PAM sequence: CTC
aactgaggggcacactgcag

SEQ ID NO: 20315 - DNA, 20 bp, Artificial Sequence
  Description of Artificial Sequence: Synthetic oligonucleotide
  Target: DMPK; (+) strand; PAM type: YTN; PAM sequence: CTG
aggggcacactgcagacctg

SEQ ID NO: 20316 - DNA, 20 bp, Artificial Sequence
  Description of Artificial Sequence: Synthetic oligonucleotide
  Target: DMPK; (+) strand; PAM type: YTN; PAM sequence: CTG
cagacctggggctcttgtgg

SEQ ID NO: 20317 - DNA, 20 bp, Artificial Sequence
  Description of Artificial Sequence: Synthetic oligonucleotide
  Target: DMPK; (+) strand; PAM type: YTN; PAM sequence: CTG
gggctcttgtggcaggggcg

SEQ ID NO: 20318 - DNA, 20 bp, Artificial Sequence
  Description of Artificial Sequence: Synthetic oligonucleotide
  Target: DMPK; (+) strand; PAM type: YTN; PAM sequence: CTC
ttgtggcaggggcggggagt

SEQ ID NO: 20319 - DNA, 20 bp, Artificial Sequence
  Description of Artificial Sequence: Synthetic oligonucleotide
  Target: DMPK; (+) strand; PAM type: YTN; PAM sequence: CTT
gtggcaggggcggggagtct

SEQ ID NO: 20320 - DNA, 20 bp, Artificial Sequence
  Description of Artificial Sequence: Synthetic oligonucleotide
  Target: DMPK; (+) strand; PAM type: YTN; PAM sequence: TTG
tggcaggggcggggagtctc

SEQ ID NO: 20321 - DNA, 20 bp, Artificial Sequence
  Description of Artificial Sequence: Synthetic oligonucleotide
  Target: DMPK; (+) strand; PAM type: YTN; PAM sequence: CTC
tccccaggagtgaccagtca

SEQ ID NO: 20322 - DNA, 20 bp, Artificial Sequence
  Description of Artificial Sequence: Synthetic oligonucleotide
  Target: DMPK; (+) strand; PAM type: YTN; PAM sequence: CTC
cccaggagtgaccagtcaca

SEQ ID NO: 20323 - DNA, 20 bp, Artificial Sequence
  Description of Artificial Sequence: Synthetic oligonucleotide
  Target: DMPK; (+) strand; PAM type: YTN; PAM sequence: CTG
gggacagggatgagggtaac

SEQ ID NO: 20324 - DNA, 20 bp, Artificial Sequence
  Description of Artificial Sequence: Synthetic oligonucleotide
  Target: DMPK; (+) strand; PAM type: YTN; PAM sequence: CTG
atgtttcagaggaagaggtc

SEQ ID NO: 20325 - DNA, 20 bp, Artificial Sequence
  Description of Artificial Sequence: Synthetic oligonucleotide
  Target: DMPK; (+) strand; PAM type: YTN; PAM sequence: TTT
cagaggaagaggtcattgta

SEQ ID NO: 20326 - DNA, 20 bp, Artificial Sequence
  Description of Artificial Sequence: Synthetic oligonucleotide
  Target: DMPK; (+) strand; PAM type: YTN; PAM sequence: TTC
agaggaagaggtcattgtac

SEQ ID NO: 20327 - DNA, 20 bp, Artificial Sequence
  Description of Artificial Sequence: Synthetic oligonucleotide
  Target: DMPK; (+) strand; PAM type: YTN; PAM sequence: TTG
tacttggcagtgggtggggg

SEQ ID NO: 20328 - DNA, 20 bp, Artificial Sequence
  Description of Artificial Sequence: Synthetic oligonucleotide
  Target: DMPK; (+) strand; PAM type: YTN; PAM sequence: CTT
ggcagtgggtgggggacaag

SEQ ID NO: 20329 - DNA, 20 bp, Artificial Sequence
  Description of Artificial Sequence: Synthetic oligonucleotide
  Target: DMPK; (+) strand; PAM type: YTN; PAM sequence: TTG
gcagtgggtgggggacaagg

SEQ ID NO: 20330 - DNA, 20 bp, Artificial Sequence
  Description of Artificial Sequence: Synthetic oligonucleotide
  Target: DMPK; (+) strand; PAM type: YTN; PAM sequence: CTG
aggccacaagggctattaca

SEQ ID NO: 20331 - DNA, 20 bp, Artificial Sequence
  Description of Artificial Sequence: Synthetic oligonucleotide
  Target: DMPK; (+) strand; PAM type: YTN; PAM sequence: CTA
ttacatcgcccgtgtccggg

SEQ ID NO: 20332 - DNA, 20 bp, Artificial Sequence
  Description of Artificial Sequence: Synthetic oligonucleotide
  Target: DMPK; (+) strand; PAM type: YTN; PAM sequence: TTA
catcgcccgtgtccgggcca

SEQ ID NO: 20333 - DNA, 20 bp, Artificial Sequence
  Description of Artificial Sequence: Synthetic oligonucleotide
  Target: DMPK; (+) strand; PAM type: YTN; PAM sequence: CTG
gggggcccccaaattttgtg

SEQ ID NO: 20334 - DNA, 20 bp, Artificial Sequence
  Description of Artificial Sequence: Synthetic oligonucleotide
  Target: DMPK; (+) strand; PAM type: YTN; PAM sequence: TTT
tgtgcaggtggggggactgg

SEQ ID NO: 20335 - DNA, 20 bp, Artificial Sequence
  Description of Artificial Sequence: Synthetic oligonucleotide
  Target: DMPK; (+) strand; PAM type: YTN; PAM sequence: TTT
gtgcaggtggggggactgga

SEQ ID NO: 20336 - DNA, 20 bp, Artificial Sequence
  Description of Artificial Sequence: Synthetic oligonucleotide
  Target: DMPK; (+) strand; PAM type: YTN; PAM sequence: TTG
tgcaggtggggggactggag

SEQ ID NO: 20337 - DNA, 20 bp, Artificial Sequence
  Description of Artificial Sequence: Synthetic oligonucleotide
  Target: DMPK; (+) strand; PAM type: YTN; PAM sequence: CTG
gagcagtccatccatcatgg

SEQ ID NO: 20338 - DNA, 20 bp, Artificial Sequence
  Description of Artificial Sequence: Synthetic oligonucleotide
  Target: DMPK; (+) strand; PAM type: YTN; PAM sequence: TTA
gtcttgttaatacgttgatc

SEQ ID NO: 20339 - DNA, 20 bp, Artificial Sequence
  Description of Artificial Sequence: Synthetic oligonucleotide
  Target: DMPK; (+) strand; PAM type: YTN; PAM sequence: CTT
gttaatacgttgatctgtga

SEQ ID NO: 20340 - DNA, 20 bp, Artificial Sequence
  Description of Artificial Sequence: Synthetic oligonucleotide
  Target: DMPK; (+) strand; PAM type: YTN; PAM sequence: TTG
ttaatacgttgatctgtgag

SEQ ID NO: 20341 - DNA, 20 bp, Artificial Sequence
  Description of Artificial Sequence: Synthetic oligonucleotide
  Target: DMPK; (+) strand; PAM type: YTN; PAM sequence: TTA
atacgttgatctgtgaggtc

SEQ ID NO: 20342 - DNA, 20 bp, Artificial Sequence
  Description of Artificial Sequence: Synthetic oligonucleotide
  Target: DMPK; (+) strand; PAM type: YTN; PAM sequence: TTG
atctgtgaggtcagcaggga

SEQ ID NO: 20343 - DNA, 20 bp, Artificial Sequence
  Description of Artificial Sequence: Synthetic oligonucleotide
  Target: DMPK; (+) strand; PAM type: YTN; PAM sequence: CTG
tgaggtcagcagggagggtt

SEQ ID NO: 20344 - DNA, 20 bp, Artificial Sequence
  Description of Artificial Sequence: Synthetic oligonucleotide
  Target: DMPK; (+) strand; PAM type: YTN; PAM sequence: TTA
tggctaggaggctgggggca

SEQ ID NO: 20345 - DNA, 20 bp, Artificial Sequence
  Description of Artificial Sequence: Synthetic oligonucleotide
  Target: DMPK; (+) strand; PAM type: YTN; PAM sequence: CTA
ggaggctgggggcatggggt

SEQ ID NO: 20346 - DNA, 20 bp, Artificial Sequence
  Description of Artificial Sequence: Synthetic oligonucleotide
  Target: DMPK; (+) strand; PAM type: YTN; PAM sequence: CTG
ggggcatggggttggggggg

SEQ ID NO: 20347 - DNA, 20 bp, Artificial Sequence
  Description of Artificial Sequence: Synthetic oligonucleotide
  Target: DMPK; (+) strand; PAM type: YTN; PAM sequence: TTG
ggggggcccgatatccatgg

SEQ ID NO: 20348 - DNA, 20 bp, Artificial Sequence
  Description of Artificial Sequence: Synthetic oligonucleotide
  Target: DMPK; (+) strand; PAM type: YTN; PAM sequence: CTT
cacaccactgtgccactcgg

SEQ ID NO: 20349 - DNA, 20 bp, Artificial Sequence
  Description of Artificial Sequence: Synthetic oligonucleotide
  Target: DMPK; (+) strand; PAM type: YTN; PAM sequence: TTC
acaccactgtgccactcggg

SEQ ID NO: 20350 - DNA, 20 bp, Artificial Sequence
  Description of Artificial Sequence: Synthetic oligonucleotide
  Target: DMPK; (+) strand; PAM type: YTN; PAM sequence: CTG
tgccactcggggagttgcct

SEQ ID NO: 20351 - DNA, 20 bp, Artificial Sequence
  Description of Artificial Sequence: Synthetic oligonucleotide
  Target: DMPK; (+) strand; PAM type: YTN; PAM sequence: CTC
ggggagttgcctggttggga

SEQ ID NO: 20352 - DNA, 20 bp, Artificial Sequence
  Description of Artificial Sequence: Synthetic oligonucleotide
  Target: DMPK; (+) strand; PAM type: YTN; PAM sequence: TTG
cctggttgggaggagatgcc

SEQ ID NO: 20353 - DNA, 20 bp, Artificial Sequence
  Description of Artificial Sequence: Synthetic oligonucleotide
  Target: DMPK; (+) strand; PAM type: YTN; PAM sequence: CTG
gttgggaggagatgccctgg

SEQ ID NO: 20354 - DNA, 20 bp, Artificial Sequence
  Description of Artificial Sequence: Synthetic oligonucleotide
  Target: DMPK; (+) strand; PAM type: YTN; PAM sequence: TTG
ggaggagatgccctggggaa

SEQ ID NO: 20355 - DNA, 20 bp, Artificial Sequence
  Description of Artificial Sequence: Synthetic oligonucleotide
  Target: DMPK; (+) strand; PAM type: YTN; PAM sequence: CTG
gggaagatgagagggagaga

SEQ ID NO: 20356 - DNA, 20 bp, Artificial Sequence
  Description of Artificial Sequence: Synthetic oligonucleotide
  Target: DMPK; (+) strand; PAM type: YTN; PAM sequence: TTA
gagaccacctgggcttcagc

SEQ ID NO: 20357 - DNA, 20 bp, Artificial Sequence
  Description of Artificial Sequence: Synthetic oligonucleotide
  Target: DMPK; (+) strand; PAM type: YTN; PAM sequence: CTG
ggcttcagccagtgtcaagg

SEQ ID NO: 20358 - DNA, 20 bp, Artificial Sequence
  Description of Artificial Sequence: Synthetic oligonucleotide
  Target: DMPK; (+) strand; PAM type: YTN; PAM sequence: CTT
cagccagtgtcaaggggagg

SEQ ID NO: 20359 - DNA, 20 bp, Artificial Sequence
  Description of Artificial Sequence: Synthetic oligonucleotide
  Target: DMPK; (+) strand; PAM type: YTN; PAM sequence: TTC
agccagtgtcaaggggaggg

SEQ ID NO: 20360 - DNA, 20 bp, Artificial Sequence
  Description of Artificial Sequence: Synthetic oligonucleotide
  Target: DMPK; (+) strand; PAM type: YTN; PAM sequence: CTG
ctgccaccctggccttgccc

SEQ ID NO: 20361 - DNA, 20 bp, Artificial Sequence
  Description of Artificial Sequence: Synthetic oligonucleotide
  Target: DMPK; (+) strand; PAM type: YTN; PAM sequence: CTG
ccaccctggccttgcccttg

SEQ ID NO: 20362 - DNA, 20 bp, Artificial Sequence
  Description of Artificial Sequence: Synthetic oligonucleotide
  Target: DMPK; (+) strand; PAM type: YTN; PAM sequence: CTG
gccttgcccttgggtccgcc

SEQ ID NO: 20363 - DNA, 20 bp, Artificial Sequence
  Description of Artificial Sequence: Synthetic oligonucleotide
  Target: DMPK; (+) strand; PAM type: YTN; PAM sequence: CTT
gcccttgggtccgccctaga

SEQ ID NO: 20364 - DNA, 20 bp, Artificial Sequence
  Description of Artificial Sequence: Synthetic oligonucleotide
  Target: DMPK; (+) strand; PAM type: YTN; PAM sequence: TTG
cccttgggtccgccctagac

SEQ ID NO: 20365 - DNA, 20 bp, Artificial Sequence
  Description of Artificial Sequence: Synthetic oligonucleotide
  Target: DMPK; (+) strand; PAM type: YTN; PAM sequence: CTT
gggtccgccctagacccccc

SEQ ID NO: 20366 - DNA, 20 bp, Artificial Sequence
  Description of Artificial Sequence: Synthetic oligonucleotide
  Target: DMPK; (+) strand; PAM type: YTN; PAM sequence: TTG
ggtccgccctagacccccca

SEQ ID NO: 20367 - DNA, 20 bp, Artificial Sequence
  Description of Artificial Sequence: Synthetic oligonucleotide
  Target: DMPK; (+) strand; PAM type: YTN; PAM sequence: CTA
gaccccccagaggccactgc

SEQ ID NO: 20368 - DNA, 20 bp, Artificial Sequence
  Description of Artificial Sequence: Synthetic oligonucleotide
  Target: DMPK; (+) strand; PAM type: YTN; PAM sequence: CTG
ctctaggctgggaacttgca

SEQ ID NO: 20369 - DNA, 20 bp, Artificial Sequence
  Description of Artificial Sequence: Synthetic oligonucleotide
  Target: DMPK; (+) strand; PAM type: YTN; PAM sequence: CTC
taggctgggaacttgcatct

SEQ ID NO: 20370 - DNA, 20 bp, Artificial Sequence
  Description of Artificial Sequence: Synthetic oligonucleotide
  Target: DMPK; (+) strand; PAM type: YTN; PAM sequence: CTA
ggctgggaacttgcatctta

SEQ ID NO: 20371 - DNA, 20 bp, Artificial Sequence
  Description of Artificial Sequence: Synthetic oligonucleotide
  Target: DMPK; (+) strand; PAM type: YTN; PAM sequence: CTG
ggaacttgcatcttagctag

SEQ ID NO: 20372 - DNA, 20 bp, Artificial Sequence
  Description of Artificial Sequence: Synthetic oligonucleotide
  Target: DMPK; (+) strand; PAM type: YTN; PAM sequence: CTT
gcatcttagctagcttcctg

SEQ ID NO: 20373 - DNA, 20 bp, Artificial Sequence
  Description of Artificial Sequence: Synthetic oligonucleotide
  Target: DMPK; (+) strand; PAM type: YTN; PAM sequence: TTG
catcttagctagcttcctgt

SEQ ID NO: 20374 - DNA, 20 bp, Artificial Sequence
  Description of Artificial Sequence: Synthetic oligonucleotide
  Target: DMPK; (+) strand; PAM type: YTN; PAM sequence: CTT
agctagcttcctgtcctggc

SEQ ID NO: 20375 - DNA, 20 bp, Artificial Sequence
  Description of Artificial Sequence: Synthetic oligonucleotide
  Target: DMPK; (+) strand; PAM type: YTN; PAM sequence: TTA
gctagcttcctgtcctggca

SEQ ID NO: 20376 - DNA, 20 bp, Artificial Sequence
  Description of Artificial Sequence: Synthetic oligonucleotide
  Target: DMPK; (+) strand; PAM type: YTN; PAM sequence: CTA
gcttcctgtcctggcagtca

SEQ ID NO: 20377 - DNA, 20 bp, Artificial Sequence
  Description of Artificial Sequence: Synthetic oligonucleotide
  Target: DMPK; (+) strand; PAM type: YTN; PAM sequence: CTT
cctgtcctggcagtcagcac

SEQ ID NO: 20378 - DNA, 20 bp, Artificial Sequence
  Description of Artificial Sequence: Synthetic oligonucleotide
  Target: DMPK; (+) strand; PAM type: YTN; PAM sequence: TTC
ctgtcctggcagtcagcact

SEQ ID NO: 20379 - DNA, 20 bp, Artificial Sequence
  Description of Artificial Sequence: Synthetic oligonucleotide
  Target: DMPK; (+) strand; PAM type: YTN; PAM sequence: CTG
tcctggcagtcagcactttc

SEQ ID NO: 20380 - DNA, 20 bp, Artificial Sequence
  Description of Artificial Sequence: Synthetic oligonucleotide
  Target: DMPK; (+) strand; PAM type: YTN; PAM sequence: CTG
gcagtcagcactttcacgca

SEQ ID NO: 20381 - DNA, 20 bp, Artificial Sequence
  Description of Artificial Sequence: Synthetic oligonucleotide
  Target: DMPK; (+) strand; PAM type: YTN; PAM sequence: CTT
tcacgcaataatcaaagtcc

SEQ ID NO: 20382 - DNA, 20 bp, Artificial Sequence
  Description of Artificial Sequence: Synthetic oligonucleotide
  Target: DMPK; (+) strand; PAM type: YTN; PAM sequence: TTT
cacgcaataatcaaagtcct

SEQ ID NO: 20383 - DNA, 20 bp, Artificial Sequence
  Description of Artificial Sequence: Synthetic oligonucleotide
  Target: DMPK; (+) strand; PAM type: YTN; PAM sequence: TTC
acgcaataatcaaagtcctt

SEQ ID NO: 20384 - DNA, 20 bp, Artificial Sequence
  Description of Artificial Sequence: Synthetic oligonucleotide
  Target: DMPK; (+) strand; PAM type: YTN; PAM sequence: CTT
ggcggatcctgagtgagacc

SEQ ID NO: 20385 - DNA, 20 bp, Artificial Sequence
  Description of Artificial Sequence: Synthetic oligonucleotide
  Target: DMPK; (+) strand; PAM type: YTN; PAM sequence: TTG
gcggatcctgagtgagacca

SEQ ID NO: 20386 - DNA, 20 bp, Artificial Sequence
  Description of Artificial Sequence: Synthetic oligonucleotide
  Target: DMPK; (+) strand; PAM type: YTN; PAM sequence: CTG
agtgagaccatggggtaagg

SEQ ID NO: 20387 - DNA, 20 bp, Artificial Sequence
  Description of Artificial Sequence: Synthetic oligonucleotide
  Target: DMPK; (+) strand; PAM type: YTN; PAM sequence: CTG
gagctcccttctaacttggg

SEQ ID NO: 20388 - DNA, 20 bp, Artificial Sequence
  Description of Artificial Sequence: Synthetic oligonucleotide
  Target: DMPK; (+) strand; PAM type: YTN; PAM sequence: CTC
ccttctaacttgggagggac

SEQ ID NO: 20389 - DNA, 20 bp, Artificial Sequence
  Description of Artificial Sequence: Synthetic oligonucleotide
  Target: DMPK; (+) strand; PAM type: YTN; PAM sequence: CTT
ctaacttgggagggaccctg

SEQ ID NO: 20390 - DNA, 20 bp, Artificial Sequence
  Description of Artificial Sequence: Synthetic oligonucleotide
  Target: DMPK; (+) strand; PAM type: YTN; PAM sequence: TTC
taacttgggagggaccctga

SEQ ID NO: 20391 - DNA, 20 bp, Artificial Sequence
  Description of Artificial Sequence: Synthetic oligonucleotide
  Target: DMPK; (+) strand; PAM type: YTN; PAM sequence: CTA
acttgggagggaccctgagg

SEQ ID NO: 20392 - DNA, 20 bp, Artificial Sequence
  Description of Artificial Sequence: Synthetic oligonucleotide
  Target: DMPK; (+) strand; PAM type: YTN; PAM sequence: CTT
gggagggaccctgaggtgct

SEQ ID NO: 20393 - DNA, 20 bp, Artificial Sequence
  Description of Artificial Sequence: Synthetic oligonucleotide
  Target: DMPK; (+) strand; PAM type: YTN; PAM sequence: TTG
ggagggaccctgaggtgctg

SEQ ID NO: 20394 - DNA, 20 bp, Artificial Sequence
  Description of Artificial Sequence: Synthetic oligonucleotide
  Target: DMPK; (+) strand; PAM type: YTN; PAM sequence: CTG
aggtgctggggaaagaactc

SEQ ID NO: 20395 - DNA, 20 bp, Artificial Sequence
  Description of Artificial Sequence: Synthetic oligonucleotide
  Target: DMPK; (+) strand; PAM type: YTN; PAM sequence: CTG
gggaaagaactcagggacag

SEQ ID NO: 20396 - DNA, 20 bp, Artificial Sequence
  Description of Artificial Sequence: Synthetic oligonucleotide
  Target: DMPK; (+) strand; PAM type: YTN; PAM sequence: CTC
agggacagtcctacctctac

SEQ ID NO: 20397 - DNA, 20 bp, Artificial Sequence
  Description of Artificial Sequence: Synthetic oligonucleotide
  Target: DMPK; (+) strand; PAM type: YTN; PAM sequence: CTA
cctctaccactgacttgctg

SEQ ID NO: 20398 - DNA, 20 bp, Artificial Sequence
  Description of Artificial Sequence: Synthetic oligonucleotide
  Target: DMPK; (+) strand; PAM type: YTN; PAM sequence: CTC
taccactgacttgctgggtg

SEQ ID NO: 20399 - DNA, 20 bp, Artificial Sequence
  Description of Artificial Sequence: Synthetic oligonucleotide
  Target: DMPK; (+) strand; PAM type: YTN; PAM sequence: CTA
ccactgacttgctgggtgac

SEQ ID NO: 20400 - DNA, 20 bp, Artificial Sequence
  Description of Artificial Sequence: Synthetic oligonucleotide
  Target: DMPK; (+) strand; PAM type: YTN; PAM sequence: CTG
acttgctgggtgacctgggc

SEQ ID NO: 20401 - DNA, 20 bp, Artificial Sequence
  Description of Artificial Sequence: Synthetic oligonucleotide
  Target: DMPK; (+) strand; PAM type: YTN; PAM sequence: CTT
gctgggtgacctgggccaac

SEQ ID NO: 20402 - DNA, 20 bp, Artificial Sequence
  Description of Artificial Sequence: Synthetic oligonucleotide
  Target: DMPK; (+) strand; PAM type: YTN; PAM sequence: TTG
ctgggtgacctgggccaact

SEQ ID NO: 20403 - DNA, 20 bp, Artificial Sequence
  Description of Artificial Sequence: Synthetic oligonucleotide
  Target: DMPK; (+) strand; PAM type: YTN; PAM sequence: CTG
ggtgacctgggccaacttcc

SEQ ID NO: 20404 - DNA, 20 bp, Artificial Sequence
  Description of Artificial Sequence: Synthetic oligonucleotide
  Target: DMPK; (+) strand; PAM type: YTN; PAM sequence: CTG
ggccaacttccttcccctgt

SEQ ID NO: 20405 - DNA, 20 bp, Artificial Sequence
  Description of Artificial Sequence: Synthetic oligonucleotide
  Target: DMPK; (+) strand; PAM type: YTN; PAM sequence: CTT
ccttcccctgtctgggcctc

SEQ ID NO: 20406 - DNA, 20 bp, Artificial Sequence
  Description of Artificial Sequence: Synthetic oligonucleotide
  Target: DMPK; (+) strand; PAM type: YTN; PAM sequence: TTC
cttcccctgtctgggcctcg

SEQ ID NO: 20407 - DNA, 20 bp, Artificial Sequence
  Description of Artificial Sequence: Synthetic oligonucleotide
  Target: DMPK; (+) strand; PAM type: YTN; PAM sequence: CTT
cccctgtctgggcctcggtc

SEQ ID NO: 20408 - DNA, 20 bp, Artificial Sequence
  Description of Artificial Sequence: Synthetic oligonucleotide
  Target: DMPK; (+) strand; PAM type: YTN; PAM sequence: TTC
ccctgtctgggcctcggtct

SEQ ID NO: 20409 - DNA, 20 bp, Artificial Sequence
  Description of Artificial Sequence: Synthetic oligonucleotide
  Target: DMPK; (+) strand; PAM type: YTN; PAM sequence: CTG
tctgggcctcggtctcctcg

SEQ ID NO: 20410 - DNA, 20 bp, Artificial Sequence
  Description of Artificial Sequence: Synthetic oligonucleotide
  Target: DMPK; (+) strand; PAM type: YTN; PAM sequence: CTG
ggcctcggtctcctcgtctg

SEQ ID NO: 20411 - DNA, 20 bp, Artificial Sequence
  Description of Artificial Sequence: Synthetic oligonucleotide
  Target: DMPK; (+) strand; PAM type: YTN; PAM sequence: CTC
ggtctcctcgtctgtgaact

SEQ ID NO: 20412 - DNA, 20 bp, Artificial Sequence
  Description of Artificial Sequence: Synthetic oligonucleotide
  Target: DMPK; (+) strand; PAM type: YTN; PAM sequence: CTC
ctcgtctgtgaactacggag

SEQ ID NO: 20413 - DNA, 20 bp, Artificial Sequence
  Description of Artificial Sequence: Synthetic oligonucleotide
  Target: DMPK; (+) strand; PAM type: YTN; PAM sequence: CTC
gtctgtgaactacggagaca

SEQ ID NO: 20414 - DNA, 20 bp, Artificial Sequence
  Description of Artificial Sequence: Synthetic oligonucleotide
  Target: DMPK; (+) strand; PAM type: YTN; PAM sequence: CTG
tgaactacggagacagaggg

SEQ ID NO: 20415 - DNA, 20 bp, Artificial Sequence
  Description of Artificial Sequence: Synthetic oligonucleotide
  Target: DMPK; (+) strand; PAM type: YTN; PAM sequence: CTA
cggagacagaggggtctctt

SEQ ID NO: 20416 - DNA, 20 bp, Artificial Sequence
  Description of Artificial Sequence: Synthetic oligonucleotide
  Target: DMPK; (+) strand; PAM type: YTN; PAM sequence: CTC
ttttaggactcaaccagact

SEQ ID NO: 20417 - DNA, 20 bp, Artificial Sequence
  Description of Artificial Sequence: Synthetic oligonucleotide
  Target: DMPK; (+) strand; PAM type: YTN; PAM sequence: CTT
ttaggactcaaccagactcc

SEQ ID NO: 20418 - DNA, 20 bp, Artificial Sequence
  Description of Artificial Sequence: Synthetic oligonucleotide
  Target: DMPK; (+) strand; PAM type: YTN; PAM sequence: TTT
taggactcaaccagactccc

SEQ ID NO: 20419 - DNA, 20 bp, Artificial Sequence
  Description of Artificial Sequence: Synthetic oligonucleotide
  Target: DMPK; (+) strand; PAM type: YTN; PAM sequence: TTT
aggactcaaccagactcccc

SEQ ID NO: 20420 - DNA, 20 bp, Artificial Sequence
  Description of Artificial Sequence: Synthetic oligonucleotide
  Target: DMPK; (+) strand; PAM type: YTN; PAM sequence: TTA
ggactcaaccagactcccca

SEQ ID NO: 20421 - DNA, 20 bp, Artificial Sequence
  Description of Artificial Sequence: Synthetic oligonucleotide
  Target: DMPK; (+) strand; PAM type: YTN; PAM sequence: CTC
aaccagactccccaaatccc

SEQ ID NO: 20422 - DNA, 20 bp, Artificial Sequence
  Description of Artificial Sequence: Synthetic oligonucleotide
  Target: DMPK; (+) strand; PAM type: YTN; PAM sequence: CTC
cccaaatcccaccactcttg

SEQ ID NO: 20423 - DNA, 20 bp, Artificial Sequence
  Description of Artificial Sequence: Synthetic oligonucleotide
  Target: DMPK; (+) strand; PAM type: YTN; PAM sequence: CTC
ttgcctctgagtcactcaga

SEQ ID NO: 20424 - DNA, 20 bp, Artificial Sequence
  Description of Artificial Sequence: Synthetic oligonucleotide
  Target: DMPK; (+) strand; PAM type: YTN; PAM sequence: CTT
gcctctgagtcactcagact

SEQ ID NO: 20425 - DNA, 20 bp, Artificial Sequence
  Description of Artificial Sequence: Synthetic oligonucleotide
  Target: DMPK; (+) strand; PAM type: YTN; PAM sequence: TTG
cctctgagtcactcagactg

SEQ ID NO: 20426 - DNA, 20 bp, Artificial Sequence
  Description of Artificial Sequence: Synthetic oligonucleotide
  Target: DMPK; (+) strand; PAM type: YTN; PAM sequence: CTC
tgagtcactcagactgtgct

SEQ ID NO: 20427 - DNA, 20 bp, Artificial Sequence
  Description of Artificial Sequence: Synthetic oligonucleotide
  Target: DMPK; (+) strand; PAM type: YTN; PAM sequence: CTG
agtcactcagactgtgctct

SEQ ID NO: 20428 - DNA, 20 bp, Artificial Sequence
  Description of Artificial Sequence: Synthetic oligonucleotide
  Target: DMPK; (+) strand; PAM type: YTN; PAM sequence: CTC
agactgtgctctcaagttct

SEQ ID NO: 20429 - DNA, 20 bp, Artificial Sequence
  Description of Artificial Sequence: Synthetic oligonucleotide
  Target: DMPK; (+) strand; PAM type: YTN; PAM sequence: CTG
tgctctcaagttctagggac

SEQ ID NO: 20430 - DNA, 20 bp, Artificial Sequence
  Description of Artificial Sequence: Synthetic oligonucleotide
  Target: DMPK; (+) strand; PAM type: YTN; PAM sequence: CTC
tcaagttctagggactcagg

SEQ ID NO: 20431 - DNA, 20 bp, Artificial Sequence
  Description of Artificial Sequence: Synthetic oligonucleotide
  Target: DMPK; (+) strand; PAM type: YTN; PAM sequence: CTC
aagttctagggactcaggac

SEQ ID NO: 20432 - DNA, 20 bp, Artificial Sequence
  Description of Artificial Sequence: Synthetic oligonucleotide
  Target: DMPK; (+) strand; PAM type: YTN; PAM sequence: TTC
tagggactcaggactctacg

SEQ ID NO: 20433 - DNA, 20 bp, Artificial Sequence
  Description of Artificial Sequence: Synthetic oligonucleotide
  Target: DMPK; (+) strand; PAM type: YTN; PAM sequence: CTA
gggactcaggactctacgat

SEQ ID NO: 20434 - DNA, 20 bp, Artificial Sequence
  Description of Artificial Sequence: Synthetic oligonucleotide
  Target: DMPK; (+) strand; PAM type: YTN; PAM sequence: CTC
aggactctacgattccaaaa

SEQ ID NO: 20435 - DNA, 20 bp, Artificial Sequence
  Description of Artificial Sequence: Synthetic oligonucleotide
  Target: DMPK; (+) strand; PAM type: YTN; PAM sequence: CTC
tacgattccaaaactgagga

SEQ ID NO: 20436 - DNA, 20 bp, Artificial Sequence
  Description of Artificial Sequence: Synthetic oligonucleotide
  Target: DMPK; (+) strand; PAM type: YTN; PAM sequence: CTA
cgattccaaaactgaggatc

SEQ ID NO: 20437 - DNA, 20 bp, Artificial Sequence
  Description of Artificial Sequence: Synthetic oligonucleotide
  Target: DMPK; (+) strand; PAM type: YTN; PAM sequence: TTC
caaaactgaggatctgagga

SEQ ID NO: 20438 - DNA, 20 bp, Artificial Sequence
  Description of Artificial Sequence: Synthetic oligonucleotide
  Target: DMPK; (+) strand; PAM type: YTN; PAM sequence: CTG
aggatctgaggaaccaagcc

SEQ ID NO: 20439 - DNA, 20 bp, Artificial Sequence
  Description of Artificial Sequence: Synthetic oligonucleotide
  Target: DMPK; (+) strand; PAM type: YTN; PAM sequence: CTG
aggaaccaagccacggcctc

SEQ ID NO: 20440 - DNA, 20 bp, Artificial Sequence
  Description of Artificial Sequence: Synthetic oligonucleotide
  Target: DMPK; (+) strand; PAM type: YTN; PAM sequence: CTC
caggaccctgggcaactgag

SEQ ID NO: 20441 - DNA, 20 bp, Artificial Sequence
  Description of Artificial Sequence: Synthetic oligonucleotide
  Target: DMPK; (+) strand; PAM type: YTN; PAM sequence: CTG
ggcaactgagtccaagccct

SEQ ID NO: 20442 - DNA, 20 bp, Artificial Sequence
  Description of Artificial Sequence: Synthetic oligonucleotide
  Target: DMPK; (+) strand; PAM type: YTN; PAM sequence: CTG
agtccaagccctaagaagct

SEQ ID NO: 20443 - DNA, 20 bp, Artificial Sequence
  Description of Artificial Sequence: Synthetic oligonucleotide
  Target: DMPK; (+) strand; PAM type: YTN; PAM sequence: CTA
agaagctgagacacccaaga

SEQ ID NO: 20444 - DNA, 20 bp, Artificial Sequence
  Description of Artificial Sequence: Synthetic oligonucleotide
  Target: DMPK; (+) strand; PAM type: YTN; PAM sequence: CTG
agacacccaagacgagctcc

SEQ ID NO: 20445 - DNA, 20 bp, Artificial Sequence
  Description of Artificial Sequence: Synthetic oligonucleotide
  Target: DMPK; (+) strand; PAM type: YTN; PAM sequence: CTC
cgaacttacaagatgccagg

SEQ ID NO: 20446 - DNA, 20 bp, Artificial Sequence
  Description of Artificial Sequence: Synthetic oligonucleotide
  Target: DMPK; (+) strand; PAM type: YTN; PAM sequence: CTT
acaagatgccaggcctgatt

SEQ ID NO: 20447 - DNA, 20 bp, Artificial Sequence
  Description of Artificial Sequence: Synthetic oligonucleotide
  Target: DMPK; (+) strand; PAM type: YTN; PAM sequence: TTA
caagatgccaggcctgattc

SEQ ID NO: 20448 - DNA, 20 bp, Artificial Sequence
  Description of Artificial Sequence: Synthetic oligonucleotide
  Target: DMPK; (+) strand; PAM type: YTN; PAM sequence: CTG
attcgcctactatgaccttc

SEQ ID NO: 20449 - DNA, 20 bp, Artificial Sequence
  Description of Artificial Sequence: Synthetic oligonucleotide
  Target: DMPK; (+) strand; PAM type: YTN; PAM sequence: TTC
gcctactatgaccttcccaa

SEQ ID NO: 20450 - DNA, 20 bp, Artificial Sequence
  Description of Artificial Sequence: Synthetic oligonucleotide
  Target: DMPK; (+) strand; PAM type: YTN; PAM sequence: CTA
ctatgaccttcccaacgcca

SEQ ID NO: 20451 - DNA, 20 bp, Artificial Sequence
  Description of Artificial Sequence: Synthetic oligonucleotide
  Target: DMPK; (+) strand; PAM type: YTN; PAM sequence: CTA
tgaccttcccaacgccacag

SEQ ID NO: 20452 - DNA, 20 bp, Artificial Sequence
  Description of Artificial Sequence: Synthetic oligonucleotide
  Target: DMPK; (+) strand; PAM type: YTN; PAM sequence: CTT
cccaacgccacagcccaccc

SEQ ID NO: 20453 - DNA, 20 bp, Artificial Sequence
  Description of Artificial Sequence: Synthetic oligonucleotide
  Target: DMPK; (+) strand; PAM type: YTN; PAM sequence: TTC
ccaacgccacagcccaccca

SEQ ID NO: 20454 - DNA, 20 bp, Artificial Sequence
  Description of Artificial Sequence: Synthetic oligonucleotide
  Target: DMPK; (+) strand; PAM type: YTN; PAM sequence: CTG
cccatcctacaggctctgtt

SEQ ID NO: 20455 - DNA, 20 bp, Artificial Sequence
  Description of Artificial Sequence: Synthetic oligonucleotide
  Target: DMPK; (+) strand; PAM type: YTN; PAM sequence: CTA
caggctctgttctaagaggt

SEQ ID NO: 20456 - DNA, 20 bp, Artificial Sequence
  Description of Artificial Sequence: Synthetic oligonucleotide
  Target: DMPK; (+) strand; PAM type: YTN; PAM sequence: CTC
tgttctaagaggtgatgagt

SEQ ID NO: 20457 - DNA, 20 bp, Artificial Sequence
  Description of Artificial Sequence: Synthetic oligonucleotide
  Target: DMPK; (+) strand; PAM type: YTN; PAM sequence: CTG
ttctaagaggtgatgagttg

SEQ ID NO: 20458 - DNA, 20 bp, Artificial Sequence
  Description of Artificial Sequence: Synthetic oligonucleotide
  Target: DMPK; (+) strand; PAM type: YTN; PAM sequence: TTC
taagaggtgatgagttggag

SEQ ID NO: 20459 - DNA, 20 bp, Artificial Sequence
  Description of Artificial Sequence: Synthetic oligonucleotide
  Target: DMPK; (+) strand; PAM type: YTN; PAM sequence: CTA
agaggtgatgagttggaggt

SEQ ID NO: 20460 - DNA, 20 bp, Artificial Sequence
  Description of Artificial Sequence: Synthetic oligonucleotide
  Target: DMPK; (+) strand; PAM type: YTN; PAM sequence: TTG
gaggtcagagggggcagtga

SEQ ID NO: 20461 - DNA, 20 bp, Artificial Sequence
  Description of Artificial Sequence: Synthetic oligonucleotide
  Target: DMPK; (+) strand; PAM type: YTN; PAM sequence: CTT
gtccagggtcacagagggag

SEQ ID NO: 20462 - DNA, 20 bp, Artificial Sequence
  Description of Artificial Sequence: Synthetic oligonucleotide
  Target: DMPK; (+) strand; PAM type: YTN; PAM sequence: TTG
tccagggtcacagagggagt

SEQ ID NO: 20463 - DNA, 20 bp, Artificial Sequence
  Description of Artificial Sequence: Synthetic oligonucleotide
  Target: DMPK; (+) strand; PAM type: YTN; PAM sequence: CTG
gaacccaggcctgggattcc

SEQ ID NO: 20464 - DNA, 20 bp, Artificial Sequence
  Description of Artificial Sequence: Synthetic oligonucleotide
  Target: DMPK; (+) strand; PAM type: YTN; PAM sequence: CTG
ggattcccagcctgtgcctt

SEQ ID NO: 20465 - DNA, 20 bp, Artificial Sequence
  Description of Artificial Sequence: Synthetic oligonucleotide
  Target: DMPK; (+) strand; PAM type: YTN; PAM sequence: TTC
ccagcctgtgccttcagcag

SEQ ID NO: 20466 - DNA, 20 bp, Artificial Sequence
  Description of Artificial Sequence: Synthetic oligonucleotide
  Target: DMPK; (+) strand; PAM type: YTN; PAM sequence: CTG
tgccttcagcaggaggctca

SEQ ID NO: 20467 - DNA, 20 bp, Artificial Sequence
  Description of Artificial Sequence: Synthetic oligonucleotide
  Target: DMPK; (+) strand; PAM type: YTN; PAM sequence: CTT
cagcaggaggctcagatcct

SEQ ID NO: 20468 - DNA, 20 bp, Artificial Sequence
  Description of Artificial Sequence: Synthetic oligonucleotide
  Target: DMPK; (+) strand; PAM type: YTN; PAM sequence: TTC
agcaggaggctcagatcctg

SEQ ID NO: 20469 - DNA, 20 bp, Artificial Sequence
  Description of Artificial Sequence: Synthetic oligonucleotide
  Target: DMPK; (+) strand; PAM type: YTN; PAM sequence: CTC
agatcctgagtcccagaccc

SEQ ID NO: 20470 - DNA, 20 bp, Artificial Sequence
  Description of Artificial Sequence: Synthetic oligonucleotide
  Target: DMPK; (+) strand; PAM type: YTN; PAM sequence: CTG
agtcccagacccaggctggc

SEQ ID NO: 20471 - DNA, 20 bp, Artificial Sequence
  Description of Artificial Sequence: Synthetic oligonucleotide
  Target: DMPK; (+) strand; PAM type: YTN; PAM sequence: CTG
gcagccatgcccacaggctt

SEQ ID NO: 20472 - DNA, 20 bp, Artificial Sequence
  Description of Artificial Sequence: Synthetic oligonucleotide
  Target: DMPK; (+) strand; PAM type: YTN; PAM sequence: CTT
gagctcgcccctagttttgg

SEQ ID NO: 20473 - DNA, 20 bp, Artificial Sequence
  Description of Artificial Sequence: Synthetic oligonucleotide
  Target: DMPK; (+) strand; PAM type: YTN; PAM sequence: TTG
agctcgcccctagttttggc

SEQ ID NO: 20474 - DNA, 20 bp, Artificial Sequence
  Description of Artificial Sequence: Synthetic oligonucleotide
  Target: DMPK; (+) strand; PAM type: YTN; PAM sequence: CTC
gcccctagttttggcctgaa

SEQ ID NO: 20475 - DNA, 20 bp, Artificial Sequence
  Description of Artificial Sequence: Synthetic oligonucleotide
  Target: DMPK; (+) strand; PAM type: YTN; PAM sequence: CTA
gttttggcctgaagtactca

SEQ ID NO: 20476 - DNA, 20 bp, Artificial Sequence
  Description of Artificial Sequence: Synthetic oligonucleotide
  Target: DMPK; (+) strand; PAM type: YTN; PAM sequence: TTT
tggcctgaagtactcaaaaa

SEQ ID NO: 20477 - DNA, 20 bp, Artificial Sequence
  Description of Artificial Sequence: Synthetic oligonucleotide
  Target: DMPK; (+) strand; PAM type: YTN; PAM sequence: TTT
ggcctgaagtactcaaaaaa

SEQ ID NO: 20478 - DNA, 20 bp, Artificial Sequence
  Description of Artificial Sequence: Synthetic oligonucleotide
  Target: DMPK; (+) strand; PAM type: YTN; PAM sequence: TTG
gcctgaagtactcaaaaaag

SEQ ID NO: 20479 - DNA, 20 bp, Artificial Sequence
  Description of Artificial Sequence: Synthetic oligonucleotide
  Target: DMPK; (+) strand; PAM type: YTN; PAM sequence: CTG
aagtactcaaaaaagtttca

SEQ ID NO: 20480 - DNA, 20 bp, Artificial Sequence
  Description of Artificial Sequence: Synthetic oligonucleotide
  Target: DMPK; (+) strand; PAM type: YTN; PAM sequence: CTC
aaaaaagtttcacgatttaa

SEQ ID NO: 20481 - DNA, 20 bp, Artificial Sequence
  Description of Artificial Sequence: Synthetic oligonucleotide
  Target: DMPK; (+) strand; PAM type: YTN; PAM sequence: TTT
cacgatttaaaaaacagatg

SEQ ID NO: 20482 - DNA, 20 bp, Artificial Sequence
  Description of Artificial Sequence: Synthetic oligonucleotide
  Target: DMPK; (+) strand; PAM type: YTN; PAM sequence: TTC
acgatttaaaaaacagatgt

SEQ ID NO: 20483 - DNA, 20 bp, Artificial Sequence
  Description of Artificial Sequence: Synthetic oligonucleotide
  Target: DMPK; (+) strand; PAM type: YTN; PAM sequence: TTT
aaaaaacagatgttcaacag

SEQ ID NO: 20484 - DNA, 20 bp, Artificial Sequence
  Description of Artificial Sequence: Synthetic oligonucleotide
  Target: DMPK; (+) strand; PAM type: YTN; PAM sequence: TTA
aaaaacagatgttcaacaga

SEQ ID NO: 20485 - DNA, 20 bp, Artificial Sequence
  Description of Artificial Sequence: Synthetic oligonucleotide
  Target: DMPK; (+) strand; PAM type: YTN; PAM sequence: TTC
aacagaaatagattctggtt

SEQ ID NO: 20486 - DNA, 20 bp, Artificial Sequence
  Description of Artificial Sequence: Synthetic oligonucleotide
  Target: DMPK; (+) strand; PAM type: YTN; PAM sequence: TTC
tggttcgagtgacaggcagt

SEQ ID NO: 20487 - DNA, 20 bp, Artificial Sequence
  Description of Artificial Sequence: Synthetic oligonucleotide
  Target: DMPK; (+) strand; PAM type: YTN; PAM sequence: CTG
gttcgagtgacaggcagtaa

SEQ ID NO: 20488 - DNA, 20 bp, Artificial Sequence
  Description of Artificial Sequence: Synthetic oligonucleotide
  Target: DMPK; (+) strand; PAM type: YTN; PAM sequence: TTC
gagtgacaggcagtaagacc

SEQ ID NO: 20489 - DNA, 20 bp, Artificial Sequence
  Description of Artificial Sequence: Synthetic oligonucleotide
  Target: DMPK; (+) strand; PAM type: YTN; PAM sequence: CTG
gccatgtggggcccatctgc

SEQ ID NO: 20490 - DNA, 20 bp, Artificial Sequence
  Description of Artificial Sequence: Synthetic oligonucleotide
  Target: DMPK; (+) strand; PAM type: YTN; PAM sequence: CTG
ctgcccttcagacggccagc

SEQ ID NO: 20491 - DNA, 20 bp, Artificial Sequence
  Description of Artificial Sequence: Synthetic oligonucleotide
  Target: DMPK; (+) strand; PAM type: YTN; PAM sequence: CTG
cccttcagacggccagcctt

SEQ ID NO: 20492 - DNA, 20 bp, Artificial Sequence
  Description of Artificial Sequence: Synthetic oligonucleotide
  Target: DMPK; (+) strand; PAM type: YTN; PAM sequence: CTT
cagacggccagccttggatg

SEQ ID NO: 20493 - DNA, 20 bp, Artificial Sequence
  Description of Artificial Sequence: Synthetic oligonucleotide
  Target: DMPK; (+) strand; PAM type: YTN; PAM sequence: TTC
agacggccagccttggatgc

SEQ ID NO: 20494 - DNA, 20 bp, Artificial Sequence
  Description of Artificial Sequence: Synthetic oligonucleotide
  Target: DMPK; (+) strand; PAM type: YTN; PAM sequence: CTT
ggatgccccaattcctagct

SEQ ID NO: 20495 - DNA, 20 bp, Artificial Sequence
  Description of Artificial Sequence: Synthetic oligonucleotide
  Target: DMPK; (+) strand; PAM type: YTN; PAM sequence: TTG
gatgccccaattcctagctg

SEQ ID NO: 20496 - DNA, 20 bp, Artificial Sequence
  Description of Artificial Sequence: Synthetic oligonucleotide
  Target: DMPK; (+) strand; PAM type: YTN; PAM sequence: TTC
ctagctggctctcacaccca

SEQ ID NO: 20497 - DNA, 20 bp, Artificial Sequence
  Description of Artificial Sequence: Synthetic oligonucleotide
  Target: DMPK; (+) strand; PAM type: YTN; PAM sequence: CTA
gctggctctcacacccaccc

SEQ ID NO: 20498 - DNA, 20 bp, Artificial Sequence
  Description of Artificial Sequence: Synthetic oligonucleotide
  Target: DMPK; (+) strand; PAM type: YTN; PAM sequence: CTG
gctctcacacccacccctct

SEQ ID NO: 20499 - DNA, 20 bp, Artificial Sequence
  Description of Artificial Sequence: Synthetic oligonucleotide
  Target: DMPK; (+) strand; PAM type: YTN; PAM sequence: CTC
tcacacccacccctctttct

SEQ ID NO: 20500 - DNA, 20 bp, Artificial Sequence
  Description of Artificial Sequence: Synthetic oligonucleotide
  Target: DMPK; (+) strand; PAM type: YTN; PAM sequence: CTC
acacccacccctctttctgc

SEQ ID NO: 20501 - DNA, 20 bp, Artificial Sequence
  Description of Artificial Sequence: Synthetic oligonucleotide
  Target: DMPK; (+) strand; PAM type: YTN; PAM sequence: CTC
tttctgctgcctgctgccta

SEQ ID NO: 20502 - DNA, 20 bp, Artificial Sequence
  Description of Artificial Sequence: Synthetic oligonucleotide
  Target: DMPK; (+) strand; PAM type: YTN; PAM sequence: CTT
tctgctgcctgctgcctagg

SEQ ID NO: 20503 - DNA, 20 bp, Artificial Sequence
  Description of Artificial Sequence: Synthetic oligonucleotide
  Target: DMPK; (+) strand; PAM type: YTN; PAM sequence: TTT
ctgctgcctgctgcctaggg

SEQ ID NO: 20504 - DNA, 20 bp, Artificial Sequence
  Description of Artificial Sequence: Synthetic oligonucleotide
  Target: DMPK; (+) strand; PAM type: YTN; PAM sequence: TTC
tgctgcctgctgcctagggc

SEQ ID NO: 20505 - DNA, 20 bp, Artificial Sequence
  Description of Artificial Sequence: Synthetic oligonucleotide
  Target: DMPK; (+) strand; PAM type: YTN; PAM sequence: CTG
ctgcctgctgcctagggcta

SEQ ID NO: 20506 - DNA, 20 bp, Artificial Sequence
  Description of Artificial Sequence: Synthetic oligonucleotide
  Target: DMPK; (+) strand; PAM type: YTN; PAM sequence: CTG
cctgctgcctagggctagac

SEQ ID NO: 20507 - DNA, 20 bp, Artificial Sequence
  Description of Artificial Sequence: Synthetic oligonucleotide
  Target: DMPK; (+) strand; PAM type: YTN; PAM sequence: CTG
ctgcctagggctagaccccc

SEQ ID NO: 20508 - DNA, 20 bp, Artificial Sequence
  Description of Artificial Sequence: Synthetic oligonucleotide
  Target: DMPK; (+) strand; PAM type: YTN; PAM sequence: CTG
cctagggctagaccccctca

SEQ ID NO: 20509 - DNA, 20 bp, Artificial Sequence
  Description of Artificial Sequence: Synthetic oligonucleotide
  Target: DMPK; (+) strand; PAM type: YTN; PAM sequence: CTA
gggctagaccccctcactct

SEQ ID NO: 20510 - DNA, 20 bp, Artificial Sequence
  Description of Artificial Sequence: Synthetic oligonucleotide
  Target: DMPK; (+) strand; PAM type: YTN; PAM sequence: CTA
gaccccctcactctaaggat

SEQ ID NO: 20511 - DNA, 20 bp, Artificial Sequence
  Description of Artificial Sequence: Synthetic oligonucleotide
  Target: DMPK; (+) strand; PAM type: YTN; PAM sequence: CTC
actctaaggatctgagaggt

SEQ ID NO: 20512 - DNA, 20 bp, Artificial Sequence
  Description of Artificial Sequence: Synthetic oligonucleotide
  Target: DMPK; (+) strand; PAM type: YTN; PAM sequence: CTC
taaggatctgagaggtcttg

SEQ ID NO: 20513 - DNA, 20 bp, Artificial Sequence
  Description of Artificial Sequence: Synthetic oligonucleotide
  Target: DMPK; (+) strand; PAM type: YTN; PAM sequence: CTA
aggatctgagaggtcttgta

SEQ ID NO: 20514 - DNA, 20 bp, Artificial Sequence
  Description of Artificial Sequence: Synthetic oligonucleotide
  Target: DMPK; (+) strand; PAM type: YTN; PAM sequence: CTG
agaggtcttgtactgagaca

SEQ ID NO: 20515 - DNA, 20 bp, Artificial Sequence
  Description of Artificial Sequence: Synthetic oligonucleotide
  Target: DMPK; (+) strand; PAM type: YTN; PAM sequence: CTT
gtactgagacactaagattt

SEQ ID NO: 20516 - DNA, 20 bp, Artificial Sequence
  Description of Artificial Sequence: Synthetic oligonucleotide
  Target: DMPK; (+) strand; PAM type: YTN; PAM sequence: TTG
tactgagacactaagatttc

SEQ ID NO: 20517 - DNA, 20 bp, Artificial Sequence
  Description of Artificial Sequence: Synthetic oligonucleotide
  Target: DMPK; (+) strand; PAM type: YTN; PAM sequence: CTG
agacactaagatttccctgg

SEQ ID NO: 20518 - DNA, 20 bp, Artificial Sequence
  Description of Artificial Sequence: Synthetic oligonucleotide
  Target: DMPK; (+) strand; PAM type: YTN; PAM sequence: CTA
agatttccctggcttcccct

SEQ ID NO: 20519 - DNA, 20 bp, Artificial Sequence
  Description of Artificial Sequence: Synthetic oligonucleotide
  Target: DMPK; (+) strand; PAM type: YTN; PAM sequence: TTT
ccctggcttcccctcacccc

SEQ ID NO: 20520 - DNA, 20 bp, Artificial Sequence
  Description of Artificial Sequence: Synthetic oligonucleotide
  Target: DMPK; (+) strand; PAM type: YTN; PAM sequence: TTC
cctggcttcccctcacccca

SEQ ID NO: 20521 - DNA, 20 bp, Artificial Sequence
  Description of Artificial Sequence: Synthetic oligonucleotide
  Target: DMPK; (+) strand; PAM type: YTN; PAM sequence: CTG
gcttcccctcaccccacgga

SEQ ID NO: 20522 - DNA, 20 bp, Artificial Sequence
  Description of Artificial Sequence: Synthetic oligonucleotide
  Target: DMPK; (+) strand; PAM type: YTN; PAM sequence: CTT
cccctcaccccacggagcca

SEQ ID NO: 20523 - DNA, 20 bp, Artificial Sequence
  Description of Artificial Sequence: Synthetic oligonucleotide
  Target: DMPK; (+) strand; PAM type: YTN; PAM sequence: TTC
ccctcaccccacggagccag

SEQ ID NO: 20524 - DNA, 20 bp, Artificial Sequence
  Description of Artificial Sequence: Synthetic oligonucleotide
  Target: DMPK; (+) strand; PAM type: YTN; PAM sequence: CTC
accccacggagccagaggct

SEQ ID NO: 20525 - DNA, 20 bp, Artificial Sequence
  Description of Artificial Sequence: Synthetic oligonucleotide
  Target: DMPK; (+) strand; PAM type: YTN; PAM sequence: CTG
tgacagcaacaaagccctct

SEQ ID NO: 20526 - DNA, 20 bp, Artificial Sequence
  Description of Artificial Sequence: Synthetic oligonucleotide
  Target: DMPK; (+) strand; PAM type: YTN; PAM sequence: CTC
tctctgccaatgcctgcctc

SEQ ID NO: 20527 - DNA, 20 bp, Artificial Sequence
  Description of Artificial Sequence: Synthetic oligonucleotide
  Target: DMPK; (+) strand; PAM type: YTN; PAM sequence: CTC
tctgccaatgcctgcctctt

SEQ ID NO: 20528 - DNA, 20 bp, Artificial Sequence
  Description of Artificial Sequence: Synthetic oligonucleotide
  Target: DMPK; (+) strand; PAM type: YTN; PAM sequence: CTC
tgccaatgcctgcctcttcc

SEQ ID NO: 20529 - DNA, 20 bp, Artificial Sequence
  Description of Artificial Sequence: Synthetic oligonucleotide
  Target: DMPK; (+) strand; PAM type: YTN; PAM sequence: CTG
ccaatgcctgcctcttccca

SEQ ID NO: 20530 - DNA, 20 bp, Artificial Sequence
  Description of Artificial Sequence: Synthetic oligonucleotide
  Target: DMPK; (+) strand; PAM type: YTN; PAM sequence: CTG
cctcttcccacgaaaggtcc

SEQ ID NO: 20531 - DNA, 20 bp, Artificial Sequence
  Description of Artificial Sequence: Synthetic oligonucleotide
  Target: DMPK; (+) strand; PAM type: YTN; PAM sequence: CTC
ttcccacgaaaggtcctgcc

SEQ ID NO: 20532 - DNA, 20 bp, Artificial Sequence
  Description of Artificial Sequence: Synthetic oligonucleotide
  Target: DMPK; (+) strand; PAM type: YTN; PAM sequence: CTT
cccacgaaaggtcctgccag

SEQ ID NO: 20533 - DNA, 20 bp, Artificial Sequence
  Description of Artificial Sequence: Synthetic oligonucleotide
  Target: DMPK; (+) strand; PAM type: YTN; PAM sequence: TTC
ccacgaaaggtcctgccagg

SEQ ID NO: 20534 - DNA, 20 bp, Artificial Sequence
  Description of Artificial Sequence: Synthetic oligonucleotide
  Target: DMPK; (+) strand; PAM type: YTN; PAM sequence: CTG
ccaggtccccggcaggctgg

SEQ ID NO: 20535 - DNA, 20 bp, Artificial Sequence
  Description of Artificial Sequence: Synthetic oligonucleotide
  Target: DMPK; (+) strand; PAM type: YTN; PAM sequence: CTG
gtgtggggccactcaccgcc

SEQ ID NO: 20536 - DNA, 20 bp, Artificial Sequence
  Description of Artificial Sequence: Synthetic oligonucleotide
  Target: DMPK; (+) strand; PAM type: YTN; PAM sequence: CTC
accgccttgcccggccgggc

SEQ ID NO: 20537 - DNA, 20 bp, Artificial Sequence
  Description of Artificial Sequence: Synthetic oligonucleotide
  Target: DMPK; (+) strand; PAM type: YTN; PAM sequence: CTT
gcccggccgggcccaggtgc

SEQ ID NO: 20538 - DNA, 20 bp, Artificial Sequence
  Description of Artificial Sequence: Synthetic oligonucleotide
  Target: DMPK; (+) strand; PAM type: YTN; PAM sequence: TTG
cccggccgggcccaggtgca

SEQ ID NO: 20539 - DNA, 20 bp, Artificial Sequence
  Description of Artificial Sequence: Synthetic oligonucleotide
  Target: DMPK; (+) strand; PAM type: YTN; PAM sequence: CTC
ctggcaggcagtgatgatgc

SEQ ID NO: 20540 - DNA, 20 bp, Artificial Sequence
  Description of Artificial Sequence: Synthetic oligonucleotide
  Target: DMPK; (+) strand; PAM type: YTN; PAM sequence: CTG
gcaggcagtgatgatgcagt

SEQ ID NO: 20541 - DNA, 20 bp, Artificial Sequence
  Description of Artificial Sequence: Synthetic oligonucleotide
  Target: DMPK; (+) strand; PAM type: YTN; PAM sequence: CTC
caggaacaggaggactgtga

SEQ ID NO: 20542 - DNA, 20 bp, Artificial Sequence
  Description of Artificial Sequence: Synthetic oligonucleotide
  Target: DMPK; (+) strand; PAM type: YTN; PAM sequence: CTG
tgagccgctcctgggcgatc

SEQ ID NO: 20543 - DNA, 20 bp, Artificial Sequence
  Description of Artificial Sequence: Synthetic oligonucleotide
  Target: DMPK; (+) strand; PAM type: YTN; PAM sequence: CTC
ctgggcgatcttcttgcaca

SEQ ID NO: 20544 - DNA, 20 bp, Artificial Sequence
  Description of Artificial Sequence: Synthetic oligonucleotide
  Target: DMPK; (+) strand; PAM type: YTN; PAM sequence: CTG
ggcgatcttcttgcacacaa

SEQ ID NO: 20545 - DNA, 20 bp, Artificial Sequence
  Description of Artificial Sequence: Synthetic oligonucleotide
  Target: DMPK; (+) strand; PAM type: YTN; PAM sequence: CTT
cttgcacacaaggggctcca

SEQ ID NO: 20546 - DNA, 20 bp, Artificial Sequence
  Description of Artificial Sequence: Synthetic oligonucleotide
  Target: DMPK; (+) strand; PAM type: YTN; PAM sequence: TTC
ttgcacacaaggggctccag

SEQ ID NO: 20547 - DNA, 20 bp, Artificial Sequence
  Description of Artificial Sequence: Synthetic oligonucleotide
  Target: DMPK; (+) strand; PAM type: YTN; PAM sequence: CTT
gcacacaaggggctccagca

SEQ ID NO: 20548 - DNA, 20 bp, Artificial Sequence
  Description of Artificial Sequence: Synthetic oligonucleotide
  Target: DMPK; (+) strand; PAM type: YTN; PAM sequence: TTG
cacacaaggggctccagcag

SEQ ID NO: 20549 - DNA, 20 bp, Artificial Sequence
  Description of Artificial Sequence: Synthetic oligonucleotide
  Target: DMPK; (+) strand; PAM type: YTN; PAM sequence: CTC
cagcaggggcacctcgtgga

SEQ ID NO: 20550 - DNA, 20 bp, Artificial Sequence
  Description of Artificial Sequence: Synthetic oligonucleotide
  Target: DMPK; (+) strand; PAM type: YTN; PAM sequence: CTC
gtggatgcgcgggcacagcg

SEQ ID NO: 20551 - DNA, 20 bp, Artificial Sequence
  Description of Artificial Sequence: Synthetic oligonucleotide
  Target: DMPK; (+) strand; PAM type: YTN; PAM sequence: CTT
ggcggggtccaggcggctgc

SEQ ID NO: 20552 - DNA, 20 bp, Artificial Sequence
  Description of Artificial Sequence: Synthetic oligonucleotide
  Target: DMPK; (+) strand; PAM type: YTN; PAM sequence: TTG
gcggggtccaggcggctgcg

SEQ ID NO: 20553 - DNA, 20 bp, Artificial Sequence
  Description of Artificial Sequence: Synthetic oligonucleotide
  Target: DMPK; (+) strand; PAM type: YTN; PAM sequence: CTG
cggggaacagggccgctggg

SEQ ID NO: 20554 - DNA, 20 bp, Artificial Sequence
  Description of Artificial Sequence: Synthetic oligonucleotide
  Target: DMPK; (+) strand; PAM type: YTN; PAM sequence: CTG
ggcttctccccaccactgcc

SEQ ID NO: 20555 - DNA, 20 bp, Artificial Sequence
  Description of Artificial Sequence: Synthetic oligonucleotide
  Target: DMPK; (+) strand; PAM type: YTN; PAM sequence: CTT
ctccccaccactgccactgc

SEQ ID NO: 20556 - DNA, 20 bp, Artificial Sequence
  Description of Artificial Sequence: Synthetic oligonucleotide
  Target: DMPK; (+) strand; PAM type: YTN; PAM sequence: TTC
tccccaccactgccactgcc

SEQ ID NO: 20557 - DNA, 20 bp, Artificial Sequence
  Description of Artificial Sequence: Synthetic oligonucleotide
  Target: DMPK; (+) strand; PAM type: YTN; PAM sequence: CTC
cccaccactgccactgccgc

SEQ ID NO: 20558 - DNA, 20 bp, Artificial Sequence
  Description of Artificial Sequence: Synthetic oligonucleotide
  Target: DMPK; (+) strand; PAM type: YTN; PAM sequence: CTG
ccactgccgccactgccacc

SEQ ID NO: 20559 - DNA, 20 bp, Artificial Sequence
  Description of Artificial Sequence: Synthetic oligonucleotide
  Target: DMPK; (+) strand; PAM type: YTN; PAM sequence: CTG
ccgccactgccaccccggct

SEQ ID NO: 20560 - DNA, 20 bp, Artificial Sequence
  Description of Artificial Sequence: Synthetic oligonucleotide
  Target: DMPK; (+) strand; PAM type: YTN; PAM sequence: CTG
ccaccccggctgatgttgcc

SEQ ID NO: 20561 - DNA, 20 bp, Artificial Sequence
  Description of Artificial Sequence: Synthetic oligonucleotide
  Target: DMPK; (+) strand; PAM type: YTN; PAM sequence: CTG
atgttgcccaggctgtggta

SEQ ID NO: 20562 - DNA, 20 bp, Artificial Sequence
  Description of Artificial Sequence: Synthetic oligonucleotide
  Target: DMPK; (+) strand; PAM type: YTN; PAM sequence: TTG
cccaggctgtggtagcgctt

SEQ ID NO: 20563 - DNA, 20 bp, Artificial Sequence
  Description of Artificial Sequence: Synthetic oligonucleotide
  Target: DMPK; (+) strand; PAM type: YTN; PAM sequence: CTG
tggtagcgcttgtgctcctt

SEQ ID NO: 20564 - DNA, 20 bp, Artificial Sequence
  Description of Artificial Sequence: Synthetic oligonucleotide
  Target: DMPK; (+) strand; PAM type: YTN; PAM sequence: CTT
gtgctccttctctgcccccc

SEQ ID NO: 20565 - DNA, 20 bp, Artificial Sequence
  Description of Artificial Sequence: Synthetic oligonucleotide
  Target: DMPK; (+) strand; PAM type: YTN; PAM sequence: TTG
tgctccttctctgccccccg

SEQ ID NO: 20566 - DNA, 20 bp, Artificial Sequence
  Description of Artificial Sequence: Synthetic oligonucleotide
  Target: DMPK; (+) strand; PAM type: YTN; PAM sequence: CTC
cttctctgccccccggtccc

SEQ ID NO: 20567 - DNA, 20 bp, Artificial Sequence
  Description of Artificial Sequence: Synthetic oligonucleotide
  Target: DMPK; (+) strand; PAM type: YTN; PAM sequence: CTT
ctctgccccccggtcccgcc

SEQ ID NO: 20568 - DNA, 20 bp, Artificial Sequence
  Description of Artificial Sequence: Synthetic oligonucleotide
  Target: DMPK; (+) strand; PAM type: YTN; PAM sequence: TTC
tctgccccccggtcccgccg

SEQ ID NO: 20569 - DNA, 20 bp, Artificial Sequence
  Description of Artificial Sequence: Synthetic oligonucleotide
  Target: DMPK; (+) strand; PAM type: YTN; PAM sequence: CTC
tgccccccggtcccgccgct

SEQ ID NO: 20570 - DNA, 20 bp, Artificial Sequence
  Description of Artificial Sequence: Synthetic oligonucleotide
  Target: DMPK; (+) strand; PAM type: YTN; PAM sequence: CTG
ccccccggtcccgccgctcc

SEQ ID NO: 20571 - DNA, 20 bp, Artificial Sequence
  Description of Artificial Sequence: Synthetic oligonucleotide
  Target: DMPK; (+) strand; PAM type: YTN; PAM sequence: CTC
ctgcagtgtgagcgtggcga

SEQ ID NO: 20572 - DNA, 20 bp, Artificial Sequence
  Description of Artificial Sequence: Synthetic oligonucleotide
  Target: DMPK; (+) strand; PAM type: YTN; PAM sequence: CTG
cagtgtgagcgtggcgaagc

SEQ ID NO: 20573 - DNA, 20 bp, Artificial Sequence
  Description of Artificial Sequence: Synthetic oligonucleotide
  Target: DMPK; (+) strand; PAM type: YTN; PAM sequence: CTG
aatggtgtgccaggctctgc

SEQ ID NO: 20574 - DNA, 20 bp, Artificial Sequence
  Description of Artificial Sequence: Synthetic oligonucleotide
  Target: DMPK; (+) strand; PAM type: YTN; PAM sequence: CTC
tgccgccacacccgggccgc

SEQ ID NO: 20575 - DNA, 20 bp, Artificial Sequence
  Description of Artificial Sequence: Synthetic oligonucleotide
  Target: DMPK; (+) strand; PAM type: YTN; PAM sequence: CTG
ccgccacacccgggccgccc

SEQ ID NO: 20576 - DNA, 20 bp, Artificial Sequence
  Description of Artificial Sequence: Synthetic oligonucleotide
  Target: DMPK; (+) strand; PAM type: YTN; PAM sequence: CTT
gcccccgccagctgggtgcg

SEQ ID NO: 20577 - DNA, 20 bp, Artificial Sequence
  Description of Artificial Sequence: Synthetic oligonucleotide
  Target: DMPK; (+) strand; PAM type: YTN; PAM sequence: TTG
cccccgccagctgggtgcgg

SEQ ID NO: 20578 - DNA, 20 bp, Artificial Sequence
  Description of Artificial Sequence: Synthetic oligonucleotide
  Target: DMPK; (+) strand; PAM type: YTN; PAM sequence: CTG
ggtgcgggagactgttggag

SEQ ID NO: 20579 - DNA, 20 bp, Artificial Sequence
  Description of Artificial Sequence: Synthetic oligonucleotide
  Target: DMPK; (+) strand; PAM type: YTN; PAM sequence: CTG
ttggagcgggacagcgagcg

SEQ ID NO: 20580 - DNA, 20 bp, Artificial Sequence
  Description of Artificial Sequence: Synthetic oligonucleotide
  Target: DMPK; (+) strand; PAM type: YTN; PAM sequence: TTG
gagcgggacagcgagcgagg

SEQ ID NO: 20581 - DNA, 20 bp, Artificial Sequence
  Description of Artificial Sequence: Synthetic oligonucleotide
  Target: DMPK; (+) strand; PAM type: YTN; PAM sequence: CTG
ggccaggctcgccacccctc

SEQ ID NO: 20582 - DNA, 20 bp, Artificial Sequence
  Description of Artificial Sequence: Synthetic oligonucleotide
  Target: DMPK; (+) strand; PAM type: YTN; PAM sequence: CTC
gccacccctcgagctgctgg

SEQ ID NO: 20583 - DNA, 20 bp, Artificial Sequence
  Description of Artificial Sequence: Synthetic oligonucleotide
  Target: DMPK; (+) strand; PAM type: YTN; PAM sequence: CTC
gagctgctggcggccggtgg

SEQ ID NO: 20584 - DNA, 20 bp, Artificial Sequence
  Description of Artificial Sequence: Synthetic oligonucleotide
  Target: DMPK; (+) strand; PAM type: YTN; PAM sequence: CTG
ctggcggccggtggcgtggt

SEQ ID NO: 20585 - DNA, 20 bp, Artificial Sequence
  Description of Artificial Sequence: Synthetic oligonucleotide
  Target: DMPK; (+) strand; PAM type: YTN; PAM sequence: CTG
gcggccggtggcgtggtgcc

SEQ ID NO: 20586 - DNA, 20 bp, Artificial Sequence
  Description of Artificial Sequence: Synthetic oligonucleotide
  Target: DMPK; (+) strand; PAM type: YTN; PAM sequence: CTT
cagtgaggtcccacaggcag

SEQ ID NO: 20587 - DNA, 20 bp, Artificial Sequence
  Description of Artificial Sequence: Synthetic oligonucleotide
  Target: DMPK; (+) strand; PAM type: YTN; PAM sequence: TTC
agtgaggtcccacaggcaga

SEQ ID NO: 20588 - DNA, 20 bp, Artificial Sequence
  Description of Artificial Sequence: Synthetic oligonucleotide
  Target: DMPK; (+) strand; PAM type: YTN; PAM sequence: CTG
cgtgtcctggcccgccgagc

SEQ ID NO: 20589 - DNA, 20 bp, Artificial Sequence
  Description of Artificial Sequence: Synthetic oligonucleotide
  Target: DMPK; (+) strand; PAM type: YTN; PAM sequence: CTG
gcccgccgagccaaagcggt

SEQ ID NO: 20590 - DNA, 20 bp, Artificial Sequence
  Description of Artificial Sequence: Synthetic oligonucleotide
  Target: DMPK; (+) strand; PAM type: YTN; PAM sequence: CTT
gggcagtggagagagcgggg

SEQ ID NO: 20591 - DNA, 20 bp, Artificial Sequence
  Description of Artificial Sequence: Synthetic oligonucleotide
  Target: DMPK; (+) strand; PAM type: YTN; PAM sequence: TTG
ggcagtggagagagcggggc

SEQ ID NO: 20592 - DNA, 20 bp, Artificial Sequence
  Description of Artificial Sequence: Synthetic oligonucleotide
  Target: DMPK; (+) strand; PAM type: YTN; PAM sequence: CTG
tgcccgcagcctcgggctcc

SEQ ID NO: 20593 - DNA, 20 bp, Artificial Sequence
  Description of Artificial Sequence: Synthetic oligonucleotide
  Target: DMPK; (+) strand; PAM type: YTN; PAM sequence: CTC
gggctcctcctcctcctctt

SEQ ID NO: 20594 - DNA, 20 bp, Artificial Sequence
  Description of Artificial Sequence: Synthetic oligonucleotide
  Target: DMPK; (+) strand; PAM type: YTN; PAM sequence: CTC
ctcctcctcctcttcgccgc

SEQ ID NO: 20595 - DNA, 20 bp, Artificial Sequence
  Description of Artificial Sequence: Synthetic oligonucleotide
  Target: DMPK; (+) strand; PAM type: YTN; PAM sequence: CTC
ctcctcctcttcgccgctcc

SEQ ID NO: 20596 - DNA, 20 bp, Artificial Sequence
  Description of Artificial Sequence: Synthetic oligonucleotide
  Target: DMPK; (+) strand; PAM type: YTN; PAM sequence: CTC
ctcctcttcgccgctccgct

SEQ ID NO: 20597 - DNA, 20 bp, Artificial Sequence
  Description of Artificial Sequence: Synthetic oligonucleotide
  Target: DMPK; (+) strand; PAM type: YTN; PAM sequence: CTC
ctcttcgccgctccgctccc

SEQ ID NO: 20598 - DNA, 20 bp, Artificial Sequence
  Description of Artificial Sequence: Synthetic oligonucleotide
  Target: DMPK; (+) strand; PAM type: YTN; PAM sequence: CTC
ttcgccgctccgctccccat

SEQ ID NO: 20599 - DNA, 20 bp, Artificial Sequence
  Description of Artificial Sequence: Synthetic oligonucleotide
  Target: DMPK; (+) strand; PAM type: YTN; PAM sequence: CTT
cgccgctccgctccccatca

SEQ ID NO: 20600 - DNA, 20 bp, Artificial Sequence
  Description of Artificial Sequence: Synthetic oligonucleotide
  Target: DMPK; (+) strand; PAM type: YTN; PAM sequence: TTC
gccgctccgctccccatcag

SEQ ID NO: 20601 - DNA, 20 bp, Artificial Sequence
  Description of Artificial Sequence: Synthetic oligonucleotide
  Target: DMPK; (+) strand; PAM type: YTN; PAM sequence: CTC
cgctccccatcagcaccggc

SEQ ID NO: 20602 - DNA, 20 bp, Artificial Sequence
  Description of Artificial Sequence: Synthetic oligonucleotide
  Target: DMPK; (+) strand; PAM type: YTN; PAM sequence: CTC
cccatcagcaccggctgctg

SEQ ID NO: 20603 - DNA, 20 bp, Artificial Sequence
  Description of Artificial Sequence: Synthetic oligonucleotide
  Target: DMPK; (+) strand; PAM type: YTN; PAM sequence: CTG
ctgtcgccgcctcctctgcc

SEQ ID NO: 20604 - DNA, 20 bp, Artificial Sequence
  Description of Artificial Sequence: Synthetic oligonucleotide
  Target: DMPK; (+) strand; PAM type: YTN; PAM sequence: CTG
tcgccgcctcctctgccctt

SEQ ID NO: 20605 - DNA, 20 bp, Artificial Sequence
  Description of Artificial Sequence: Synthetic oligonucleotide
  Target: DMPK; (+) strand; PAM type: YTN; PAM sequence: CTC
ctctgcccttgtggtgtagg

SEQ ID NO: 20606 - DNA, 20 bp, Artificial Sequence
  Description of Artificial Sequence: Synthetic oligonucleotide
  Target: DMPK; (+) strand; PAM type: YTN; PAM sequence: CTC
tgcccttgtggtgtaggggt

SEQ ID NO: 20607 - DNA, 20 bp, Artificial Sequence
  Description of Artificial Sequence: Synthetic oligonucleotide
  Target: DMPK; (+) strand; PAM type: YTN; PAM sequence: CTG
cccttgtggtgtaggggtca

SEQ ID NO: 20608 - DNA, 20 bp, Artificial Sequence
  Description of Artificial Sequence: Synthetic oligonucleotide
  Target: DMPK; (+) strand; PAM type: YTN; PAM sequence: CTT
gtggtgtaggggtcaaaggc

SEQ ID NO: 20609 - DNA, 20 bp, Artificial Sequence
  Description of Artificial Sequence: Synthetic oligonucleotide
  Target: DMPK; (+) strand; PAM type: YTN; PAM sequence: TTG
tggtgtaggggtcaaaggcc

SEQ ID NO: 20610 - DNA, 20 bp, Artificial Sequence
  Description of Artificial Sequence: Synthetic oligonucleotide
  Target: DMPK; (+) strand; PAM type: YTN; PAM sequence: TTG
acccaggacttgtggccatg

SEQ ID NO: 20611 - DNA, 20 bp, Artificial Sequence
  Description of Artificial Sequence: Synthetic oligonucleotide
  Target: DMPK; (+) strand; PAM type: YTN; PAM sequence: CTT
gtggccatggcctcgagcca

SEQ ID NO: 20612 - DNA, 20 bp, Artificial Sequence
  Description of Artificial Sequence: Synthetic oligonucleotide
  Target: DMPK; (+) strand; PAM type: YTN; PAM sequence: TTG
tggccatggcctcgagccac

SEQ ID NO: 20613 - DNA, 20 bp, Artificial Sequence
  Description of Artificial Sequence: Synthetic oligonucleotide
  Target: DMPK; (+) strand; PAM type: YTN; PAM sequence: CTC
gagccaccacgcggccctcg

SEQ ID NO: 20614 - DNA, 20 bp, Artificial Sequence
  Description of Artificial Sequence: Synthetic oligonucleotide
  Target: DMPK; (+) strand; PAM type: YTN; PAM sequence: CTC
ggtgaaggaccacacggtga

SEQ ID NO: 20615 - DNA, 20 bp, Artificial Sequence
  Description of Artificial Sequence: Synthetic oligonucleotide
  Target: DMPK; (+) strand; PAM type: YTN; PAM sequence: CTT
cgccacccgtcaccacgtag

SEQ ID NO: 20616 - DNA, 20 bp, Artificial Sequence
  Description of Artificial Sequence: Synthetic oligonucleotide
  Target: DMPK; (+) strand; PAM type: YTN; PAM sequence: TTC
gccacccgtcaccacgtagc

SEQ ID NO: 20617 - DNA, 20 bp, Artificial Sequence
  Description of Artificial Sequence: Synthetic oligonucleotide
  Target: DMPK; (+) strand; PAM type: YTN; PAM sequence: CTC
cagcacacacacagcaggcc

SEQ ID NO: 20618 - DNA, 20 bp, Artificial Sequence
  Description of Artificial Sequence: Synthetic oligonucleotide
  Target: DMPK; (+) strand; PAM type: YTN; PAM sequence: CTC
ttcatgagcccacgcaggag

SEQ ID NO: 20619 - DNA, 20 bp, Artificial Sequence
  Description of Artificial Sequence: Synthetic oligonucleotide
  Target: DMPK; (+) strand; PAM type: YTN; PAM sequence: CTT
catgagcccacgcaggagca

SEQ ID NO: 20620 - DNA, 20 bp, Artificial Sequence
  Description of Artificial Sequence: Synthetic oligonucleotide
  Target: DMPK; (+) strand; PAM type: YTN; PAM sequence: TTC
atgagcccacgcaggagcat

SEQ ID NO: 20621 - DNA, 20 bp, Artificial Sequence
  Description of Artificial Sequence: Synthetic oligonucleotide
  Target: DMPK; (+) strand; PAM type: YTN; PAM sequence: CTG
gctcacacaggccaggtgcc

SEQ ID NO: 20622 - DNA, 20 bp, Artificial Sequence
  Description of Artificial Sequence: Synthetic oligonucleotide
  Target: DMPK; (+) strand; PAM type: YTN; PAM sequence: CTC
acacaggccaggtgccggcc

SEQ ID NO: 20623 - DNA, 20 bp, Artificial Sequence
  Description of Artificial Sequence: Synthetic oligonucleotide
  Target: DMPK; (+) strand; PAM type: YTN; PAM sequence: CTC
gttgaggggcccctcaccca

SEQ ID NO: 20624 - DNA, 20 bp, Artificial Sequence
  Description of Artificial Sequence: Synthetic oligonucleotide
  Target: DMPK; (+) strand; PAM type: YTN; PAM sequence: TTG
aggggcccctcacccaccgc

SEQ ID NO: 20625 - DNA, 20 bp, Artificial Sequence
  Description of Artificial Sequence: Synthetic oligonucleotide
  Target: DMPK; (+) strand; PAM type: YTN; PAM sequence: CTC
acccaccgcccacttggcca

SEQ ID NO: 20626 - DNA, 20 bp, Artificial Sequence
  Description of Artificial Sequence: Synthetic oligonucleotide
  Target: DMPK; (+) strand; PAM type: YTN; PAM sequence: CTT
ggccagcgggttgcggggtg

SEQ ID NO: 20627 - DNA, 20 bp, Artificial Sequence
  Description of Artificial Sequence: Synthetic oligonucleotide
  Target: DMPK; (+) strand; PAM type: YTN; PAM sequence: TTG
gccagcgggttgcggggtgc

SEQ ID NO: 20628 - DNA, 20 bp, Artificial Sequence
  Description of Artificial Sequence: Synthetic oligonucleotide
  Target: DMPK; (+) strand; PAM type: YTN; PAM sequence: TTG
cggggtgccttgctcttggc

SEQ ID NO: 20629 - DNA, 20 bp, Artificial Sequence
  Description of Artificial Sequence: Synthetic oligonucleotide
  Target: DMPK; (+) strand; PAM type: YTN; PAM sequence: CTT
gctcttggcagcatagacag

SEQ ID NO: 20630 - DNA, 20 bp, Artificial Sequence
  Description of Artificial Sequence: Synthetic oligonucleotide
  Target: DMPK; (+) strand; PAM type: YTN; PAM sequence: TTG
ctcttggcagcatagacaga

SEQ ID NO: 20631 - DNA, 20 bp, Artificial Sequence
  Description of Artificial Sequence: Synthetic oligonucleotide
  Target: DMPK; (+) strand; PAM type: YTN; PAM sequence: CTC
ttggcagcatagacagagaa

SEQ ID NO: 20632 - DNA, 20 bp, Artificial Sequence
  Description of Artificial Sequence: Synthetic oligonucleotide
  Target: DMPK; (+) strand; PAM type: YTN; PAM sequence: CTT
ggcagcatagacagagaagc

SEQ ID NO: 20633 - DNA, 20 bp, Artificial Sequence
  Description of Artificial Sequence: Synthetic oligonucleotide
  Target: DMPK; (+) strand; PAM type: YTN; PAM sequence: TTG
gcagcatagacagagaagcc

SEQ ID NO: 20634 - DNA, 20 bp, Artificial Sequence
  Description of Artificial Sequence: Synthetic oligonucleotide
  Target: DMPK; (+) strand; PAM type: YTN; PAM sequence: CTC
gccctgcttcagcaggctgt

SEQ ID NO: 20635 - DNA, 20 bp, Artificial Sequence
  Description of Artificial Sequence: Synthetic oligonucleotide
  Target: DMPK; (+) strand; PAM type: YTN; PAM sequence: CTG
cttcagcaggctgtactggg

SEQ ID NO: 20636 - DNA, 20 bp, Artificial Sequence
  Description of Artificial Sequence: Synthetic oligonucleotide
  Target: DMPK; (+) strand; PAM type: YTN; PAM sequence: CTT
cagcaggctgtactggggcg

SEQ ID NO: 20637 - DNA, 20 bp, Artificial Sequence
  Description of Artificial Sequence: Synthetic oligonucleotide
  Target: DMPK; (+) strand; PAM type: YTN; PAM sequence: TTC
agcaggctgtactggggcgg

SEQ ID NO: 20638 - DNA, 20 bp, Artificial Sequence
  Description of Artificial Sequence: Synthetic oligonucleotide
  Target: DMPK; (+) strand; PAM type: YTN; PAM sequence: CTG
tactggggcggggccgaggc

SEQ ID NO: 20639 - DNA, 20 bp, Artificial Sequence
  Description of Artificial Sequence: Synthetic oligonucleotide
  Target: DMPK; (+) strand; PAM type: YTN; PAM sequence: CTG
gggcggggccgaggcgcagg

SEQ ID NO: 20640 - DNA, 20 bp, Artificial Sequence
  Description of Artificial Sequence: Synthetic oligonucleotide
  Target: DMPK; (+) strand; PAM type: YTN; PAM sequence: CTG
acgttgtacaggtacaggtg

SEQ ID NO: 20641 - DNA, 20 bp, Artificial Sequence
  Description of Artificial Sequence: Synthetic oligonucleotide
  Target: DMPK; (+) strand; PAM type: YTN; PAM sequence: TTG
tacaggtacaggtggccact

SEQ ID NO: 20642 - DNA, 20 bp, Artificial Sequence
  Description of Artificial Sequence: Synthetic oligonucleotide
  Target: DMPK; (+) strand; PAM type: YTN; PAM sequence: CTG
gcgtgtgatgccaggaacag

SEQ ID NO: 20643 - DNA, 20 bp, Artificial Sequence
  Description of Artificial Sequence: Synthetic oligonucleotide
  Target: DMPK; (+) strand; PAM type: YTN; PAM sequence: CTC
tccgactcaggcagccactt

SEQ ID NO: 20644 - DNA, 20 bp, Artificial Sequence
  Description of Artificial Sequence: Synthetic oligonucleotide
  Target: DMPK; (+) strand; PAM type: YTN; PAM sequence: CTC
cgactcaggcagccacttca

SEQ ID NO: 20645 - DNA, 20 bp, Artificial Sequence
  Description of Artificial Sequence: Synthetic oligonucleotide
  Target: DMPK; (+) strand; PAM type: YTN; PAM sequence: CTC
aggcagccacttcagatatg

SEQ ID NO: 20646 - DNA, 20 bp, Artificial Sequence
  Description of Artificial Sequence: Synthetic oligonucleotide
  Target: DMPK; (+) strand; PAM type: YTN; PAM sequence: CTT
cagatatgtcaccttggtct

SEQ ID NO: 20647 - DNA, 20 bp, Artificial Sequence
  Description of Artificial Sequence: Synthetic oligonucleotide
  Target: DMPK; (+) strand; PAM type: YTN; PAM sequence: TTC
agatatgtcaccttggtctt

SEQ ID NO: 20648 - DNA, 20 bp, Artificial Sequence
  Description of Artificial Sequence: Synthetic oligonucleotide
  Target: DMPK; (+) strand; PAM type: YTN; PAM sequence: CTT
ggtcttgtcgatcaaccgct

SEQ ID NO: 20649 - DNA, 20 bp, Artificial Sequence
  Description of Artificial Sequence: Synthetic oligonucleotide
  Target: DMPK; (+) strand; PAM type: YTN; PAM sequence: TTG
gtcttgtcgatcaaccgctg

SEQ ID NO: 20650 - DNA, 20 bp, Artificial Sequence
  Description of Artificial Sequence: Synthetic oligonucleotide
  Target: DMPK; (+) strand; PAM type: YTN; PAM sequence: CTT
gtcgatcaaccgctgccagg

SEQ ID NO: 20651 - DNA, 20 bp, Artificial Sequence
  Description of Artificial Sequence: Synthetic oligonucleotide
  Target: DMPK; (+) strand; PAM type: YTN; PAM sequence: TTG
tcgatcaaccgctgccaggg

SEQ ID NO: 20652 - DNA, 20 bp, Artificial Sequence
  Description of Artificial Sequence: Synthetic oligonucleotide
  Target: DMPK; (+) strand; PAM type: YTN; PAM sequence: CTG
ccaggggagacagtgtgggg

SEQ ID NO: 20653 - DNA, 20 bp, Artificial Sequence
  Description of Artificial Sequence: Synthetic oligonucleotide
  Target: DMPK; (+) strand; PAM type: YTN; PAM sequence: TTG
ggagaaggcagtaaaaccca

SEQ ID NO: 20654 - DNA, 20 bp, Artificial Sequence
  Description of Artificial Sequence: Synthetic oligonucleotide
  Target: DMPK; (+) strand; PAM type: YTN; PAM sequence: CTT
ctccccgacccaaagtcccc

SEQ ID NO: 20655 - DNA, 20 bp, Artificial Sequence
  Description of Artificial Sequence: Synthetic oligonucleotide
  Target: DMPK; (+) strand; PAM type: YTN; PAM sequence: TTC
tccccgacccaaagtcccca

SEQ ID NO: 20656 - DNA, 20 bp, Artificial Sequence
  Description of Artificial Sequence: Synthetic oligonucleotide
  Target: DMPK; (+) strand; PAM type: YTN; PAM sequence: CTC
cccgacccaaagtccccaag

SEQ ID NO: 20657 - DNA, 20 bp, Artificial Sequence
  Description of Artificial Sequence: Synthetic oligonucleotide
  Target: DMPK; (+) strand; PAM type: YTN; PAM sequence: TTG
gacatggccccgctcacaca

SEQ ID NO: 20658 - DNA, 20 bp, Artificial Sequence
  Description of Artificial Sequence: Synthetic oligonucleotide
  Target: DMPK; (+) strand; PAM type: YTN; PAM sequence: CTC
acacagcaggtgccacacca

SEQ ID NO: 20659 - DNA, 20 bp, Artificial Sequence
  Description of Artificial Sequence: Synthetic oligonucleotide
  Target: DMPK; (+) strand; PAM type: YTN; PAM sequence: CTC
ctcggagagaagctcccaaa

SEQ ID NO: 20660 - DNA, 20 bp, Artificial Sequence
  Description of Artificial Sequence: Synthetic oligonucleotide
  Target: DMPK; (+) strand; PAM type: YTN; PAM sequence: CTC
ggagagaagctcccaaactg

SEQ ID NO: 20661 - DNA, 20 bp, Artificial Sequence
  Description of Artificial Sequence: Synthetic oligonucleotide
  Target: DMPK; (+) strand; PAM type: YTN; PAM sequence: CTC
ccaaactggggaagacagat

SEQ ID NO: 20662 - DNA, 20 bp, Artificial Sequence
  Description of Artificial Sequence: Synthetic oligonucleotide
  Target: DMPK; (+) strand; PAM type: YTN; PAM sequence: CTG
gggaagacagatggacacca

SEQ ID NO: 20663 - DNA, 20 bp, Artificial Sequence
  Description of Artificial Sequence: Synthetic oligonucleotide
  Target: DMPK; (+) strand; PAM type: YTN; PAM sequence: CTG
ctgcaaggtggccacagggt

SEQ ID NO: 20664 - DNA, 20 bp, Artificial Sequence
  Description of Artificial Sequence: Synthetic oligonucleotide
  Target: DMPK; (+) strand; PAM type: YTN; PAM sequence: CTG
caaggtggccacagggtgct

SEQ ID NO: 20665 - DNA, 20 bp, Artificial Sequence
  Description of Artificial Sequence: Synthetic oligonucleotide
  Target: DMPK; (+) strand; PAM type: YTN; PAM sequence: CTC
caaggagcctcgatgtccca

SEQ ID NO: 20666 - DNA, 20 bp, Artificial Sequence
  Description of Artificial Sequence: Synthetic oligonucleotide
  Target: DMPK; (+) strand; PAM type: YTN; PAM sequence: CTC
gatgtcccatctttggcgag

SEQ ID NO: 20667 - DNA, 20 bp, Artificial Sequence
  Description of Artificial Sequence: Synthetic oligonucleotide
  Target: DMPK; (+) strand; PAM type: YTN; PAM sequence: CTT
tggcgaggggacagtcctgc

SEQ ID NO: 20668 - DNA, 20 bp, Artificial Sequence
  Description of Artificial Sequence: Synthetic oligonucleotide
  Target: DMPK; (+) strand; PAM type: YTN; PAM sequence: TTT
ggcgaggggacagtcctgct

SEQ ID NO: 20669 - DNA, 20 bp, Artificial Sequence
  Description of Artificial Sequence: Synthetic oligonucleotide
  Target: DMPK; (+) strand; PAM type: YTN; PAM sequence: TTG
gcgaggggacagtcctgctt

SEQ ID NO: 20670 - DNA, 20 bp, Artificial Sequence
  Description of Artificial Sequence: Synthetic oligonucleotide
  Target: DMPK; (+) strand; PAM type: YTN; PAM sequence: CTG
cttgccacagaattgtcctg

SEQ ID NO: 20671 - DNA, 20 bp, Artificial Sequence
  Description of Artificial Sequence: Synthetic oligonucleotide
  Target: DMPK; (+) strand; PAM type: YTN; PAM sequence: CTT
gccacagaattgtcctgtat

SEQ ID NO: 20672 - DNA, 20 bp, Artificial Sequence
  Description of Artificial Sequence: Synthetic oligonucleotide
  Target: DMPK; (+) strand; PAM type: YTN; PAM sequence: TTG
ccacagaattgtcctgtatc

SEQ ID NO: 20673 - DNA, 20 bp, Artificial Sequence
  Description of Artificial Sequence: Synthetic oligonucleotide
  Target: DMPK; (+) strand; PAM type: YTN; PAM sequence: TTG
tcctgtatctcggggtcctc

SEQ ID NO: 20674 - DNA, 20 bp, Artificial Sequence
  Description of Artificial Sequence: Synthetic oligonucleotide
  Target: DMPK; (+) strand; PAM type: YTN; PAM sequence: CTG
tatctcggggtcctcaacct

SEQ ID NO: 20675 - DNA, 20 bp, Artificial Sequence
  Description of Artificial Sequence: Synthetic oligonucleotide
  Target: DMPK; (+) strand; PAM type: YTN; PAM sequence: CTC
ggggtcctcaacctccgggc

SEQ ID NO: 20676 - DNA, 20 bp, Artificial Sequence
  Description of Artificial Sequence: Synthetic oligonucleotide
  Target: DMPK; (+) strand; PAM type: YTN; PAM sequence: CTC
aacctccgggccatggaaca

SEQ ID NO: 20677 - DNA, 20 bp, Artificial Sequence
  Description of Artificial Sequence: Synthetic oligonucleotide
  Target: DMPK; (+) strand; PAM type: YTN; PAM sequence: CTC
cgggccatggaacagtagtg

SEQ ID NO: 20678 - DNA, 20 bp, Artificial Sequence
  Description of Artificial Sequence: Synthetic oligonucleotide
  Target: DMPK; (+) strand; PAM type: YTN; PAM sequence: CTG
ttaggaaccaggccatgcag

SEQ ID NO: 20679 - DNA, 20 bp, Artificial Sequence
  Description of Artificial Sequence: Synthetic oligonucleotide
  Target: DMPK; (+) strand; PAM type: YTN; PAM sequence: TTA
ggaaccaggccatgcagcag

SEQ ID NO: 20680 - DNA, 20 bp, Artificial Sequence
  Description of Artificial Sequence: Synthetic oligonucleotide
  Target: DMPK; (+) strand; PAM type: YTN; PAM sequence: TTA
cagcctgagcccagcctcct

SEQ ID NO: 20681 - DNA, 20 bp, Artificial Sequence
  Description of Artificial Sequence: Synthetic oligonucleotide
  Target: DMPK; (+) strand; PAM type: YTN; PAM sequence: CTG
agcccagcctcctaccggag

SEQ ID NO: 20682 - DNA, 20 bp, Artificial Sequence
  Description of Artificial Sequence: Synthetic oligonucleotide
  Target: DMPK; (+) strand; PAM type: YTN; PAM sequence: CTC
ctaccggagcagcgcaccat

SEQ ID NO: 20683 - DNA, 20 bp, Artificial Sequence
  Description of Artificial Sequence: Synthetic oligonucleotide
  Target: DMPK; (+) strand; PAM type: YTN; PAM sequence: CTA
ccggagcagcgcaccattca

SEQ ID NO: 20684 - DNA, 20 bp, Artificial Sequence
  Description of Artificial Sequence: Synthetic oligonucleotide
  Target: DMPK; (+) strand; PAM type: YTN; PAM sequence: TTC
aatcctcgtaagagtgcgaa

SEQ ID NO: 20685 - DNA, 20 bp, Artificial Sequence
  Description of Artificial Sequence: Synthetic oligonucleotide
  Target: DMPK; (+) strand; PAM type: YTN; PAM sequence: CTC
gtaagagtgcgaaccccacc

SEQ ID NO: 20686 - DNA, 20 bp, Artificial Sequence
  Description of Artificial Sequence: Synthetic oligonucleotide
  Target: DMPK; (+) strand; PAM type: YTN; PAM sequence: CTA
tgcatgcgagggatctaggt

SEQ ID NO: 20687 - DNA, 20 bp, Artificial Sequence
  Description of Artificial Sequence: Synthetic oligonucleotide
  Target: DMPK; (+) strand; PAM type: YTN; PAM sequence: CTA
ggtgtgcgctccttattaga

SEQ ID NO: 20688 - DNA, 20 bp, Artificial Sequence
  Description of Artificial Sequence: Synthetic oligonucleotide
  Target: DMPK; (+) strand; PAM type: YTN; PAM sequence: CTC
cttattagaatctaacacct

SEQ ID NO: 20689 - DNA, 20 bp, Artificial Sequence
  Description of Artificial Sequence: Synthetic oligonucleotide
  Target: DMPK; (+) strand; PAM type: YTN; PAM sequence: CTT
attagaatctaacacctgat

SEQ ID NO: 20690 - DNA, 20 bp, Artificial Sequence
  Description of Artificial Sequence: Synthetic oligonucleotide
  Target: DMPK; (+) strand; PAM type: YTN; PAM sequence: TTA
ttagaatctaacacctgatg

SEQ ID NO: 20691 - DNA, 20 bp, Artificial Sequence
  Description of Artificial Sequence: Synthetic oligonucleotide
  Target: DMPK; (+) strand; PAM type: YTN; PAM sequence: TTA
gaatctaacacctgatgatc

SEQ ID NO: 20692 - DNA, 20 bp, Artificial Sequence
  Description of Artificial Sequence: Synthetic oligonucleotide
  Target: DMPK; (+) strand; PAM type: YTN; PAM sequence: CTA
acacctgatgatcagaggca

SEQ ID NO: 20693 - DNA, 20 bp, Artificial Sequence
  Description of Artificial Sequence: Synthetic oligonucleotide
  Target: DMPK; (+) strand; PAM type: YTN; PAM sequence: CTG
atgatcagaggcagaacggt

SEQ ID NO: 20694 - DNA, 20 bp, Artificial Sequence
  Description of Artificial Sequence: Synthetic oligonucleotide
  Target: DMPK; (+) strand; PAM type: YTN; PAM sequence: TTT
catcccaaaaccatcccccc

SEQ ID NO: 20695 - DNA, 20 bp, Artificial Sequence
  Description of Artificial Sequence: Synthetic oligonucleotide
  Target: DMPK; (+) strand; PAM type: YTN; PAM sequence: TTC
atcccaaaaccatcccccca

SEQ ID NO: 20696 - DNA, 20 bp, Artificial Sequence
  Description of Artificial Sequence: Synthetic oligonucleotide
  Target: DMPK; (+) strand; PAM type: YTN; PAM sequence: CTG
tggaaaaactgtcttccata

SEQ ID NO: 20697 - DNA, 20 bp, Artificial Sequence
  Description of Artificial Sequence: Synthetic oligonucleotide
  Target: DMPK; (+) strand; PAM type: YTN; PAM sequence: CTG
tcttccataagaccagtccc

SEQ ID NO: 20698-20727 - skipped (30 entries)

SEQ ID NO: 20728 - DNA, 23 bp, Artificial Sequence
  Description of Artificial Sequence: Synthetic oligonucleotide
  modified_base (1)..(21): a, c, t, g, unknown or other
nnnnnnnnnnnnnnnnnnnnnrg

SEQ ID NO: 20729 - RNA, 100 nt, Artificial Sequence
  chemically synthesized
  modified_base (1)..(20): n is a, c, g, u, or other
nnnnnnnnnnnnnnnnnnnnguuuuagagcuagaaauagcaaguuaaaauaaggcuaguccguuaucaacuugaaaaaguggcaccgagucggugcuuuu

SEQ ID NO: 20730 - RNA, 96 nt, Artificial Sequence
  chemically synthesized
  modified_base (1)..(20): n is a, c, g, u, or other
nnnnnnnnnnnnnnnnnnnnguuuuagagcuagaaauagcaaguuaaaauaaggcuaguccguuaucaacuugaaaaaguggcaccgagucggugc

SEQ ID NO: 20731 - RNA, 114 nt, Artificial Sequence
  chemically synthesized
  modified_base (1)..(30): n is a, c, g, u, or other and this region may encompass 17-30 nucleotides;
  modified_base (107)..(114): This region may encompass 1-8 urasil;
nnnnnnnnnnnnnnnnnnnnnnnnnnnnnnguuuuagagcuagaaauagcaaguuaaaauaaggcuaguccguuaucaacuugaaaaaguggcaccgagucggugcuuuuuuuu
